United States Patent 11,446,398 (REGULATED BIOCIRCUIT SYSTEMS) - sequence listing, part 25

SEQ ID NO: 106052 - DNA, 7313 bp, Homo sapiens
  Payload ID: 788
  Gene Symbol: AFF2
  Gene Name: AF4/FMR2 family, member 2
  Uniprot ID: P51816
  ENST ID: ENST00000342251
  CDS Start-End: 391-4221
gccgctgcctctgccccggccgcccccgccgccgctgccgccgccggcccgcagccagccaggcgggcggcccagcccgcctgagcccgcagcggctgccgccgcagcgtcgggtcgctgggtgcgcgggctaccgcggaccgagcggacccgagtgggcgaccaggcgcttgcccgcccagtgccactgccgccgcttcctcgccggagcacaggaccagacacctccagcgcccgctgctgctgccgatgcggcccggacacttttagctgggcgggagggctggagagccgggggccgccgagaaccgccagcgagctgtgccgagagccgcgccgacccgctgcgatcagggacaggcgcccgcccgccgccgccgcctggccgctatggatctattcgactttttcagagactgggacttggagcagcagtgtcactatgaacaagaccgtagtgcacttaaaaaaagggaatgggagcggaggaatcaagaagtccagcaagaagacgatctcttttcttcaggctttgatctttttggggagccatacaagacaaacaaaggtgatgcacttgccaaccgagtccagaacacgcttggaaactatgatgaaatgaagaatttgctaactaaccattctaatcagaatcacctagtgggaattccaaagaattctgtgccccagaatcccaacaacaaaaatgaaccaagcttttttccagaacaaaagaacagaataattccacctcaccaggataatacccatccttcagcaccaatgcctccaccttctgttgtgatactgaattcaactctaatacacagcaacagaaaatcaaaacctgagtggtcacgtgatagtcataaccctagcactgtactggcaagccaggccagtggtcagccaaacaagatgcagactttgacacaggaccagtctcaagccaaactggaagacttctttgtctacccagctgaacagccccagattggagaagttgaagagtcaaacccatctgcaaaggaagacagtaaccctaattctagtggagaagatgctttcaaagaaatctttcaatccaattcaccggaagaatctgaattcgccgtgcaagcgcctgggtctcccctagtggcttcctctttattagctcctagcagtggcctttcagttcaaaacttcccaccagggctttactgcaaaacaagcatggggcagcaaaagccaactgcatacgtcagacccatggatggccaggaccaggcaccggacatctcaccaacactgaaaccttcaattgaatttgagaacagctttgggaatctgtcatttggaacactcttggatggaaaacccagtgcagccagttcaaagactaaactgccaaagttcaccatcctccaaacaagtgaagtaagccttcccagtgatccaagctgtgttgaagaaatcttgcgggaatcgcagcatctgaccccaggattcaccttacaaaagtggaatgacccaaccaccagagcttctacaaagtcagtgtctttcaaatcgatgcttgaggatgacctgaagctgagcagtgatgaagatgaccttgagcctgtgaagaccttgaccactcagtgcactgccactgagctctaccaggctgttgaaaaggcaaaacctaggaataatcctgtgaacccacccttggccactccccagcccccacctgcagtgcaagccagcgggggttctggcagctccagcgaatcggagagcagctctgagtcggattcagacactgaaagtagcaccactgacagcgaatctaatgaggcacctcgtgtggcaactccagagcctgagccaccctcaaccaacaagtggcaactggataaatggcttaacaaagtgacatcccagaacaagtcttttatttgtggccaaaatgaaacacccatggagactatttctctgcctcctccaatcatccaaccaatggaagtccagatgaaagtgaagacgaatgccagtcaggtcccagctgaacccaaagaaaggcctctcctcagtctcattagggagaaagcccgtccacggcccactcagaaaattccagaaacaaaggctttgaagcataagttgtcaacaactagtgagacagtgtctcaaaggacaattgggaaaaaacagcccaaaaaagttgagaagaacaccagcactgacgagtttacctggcccaaaccaaatattaccagcagcactcccaaagaaaaagaaagtgtggagcttcatgacccaccaagaggccgcaacaaagccactgcccacaaaccagcccctaggaaagaaccaagacctaacatccctttggctcccgagaagaagaagtacagagggcctggcaagattgtgccaaagtctcgggaattcattgaaacagattcatctacatctgactccaacacagatcaggaagagaccctgcaaatcaaagtcctgcctccgtgcattatttctggaggtaatactgccaaatccaaggaaatctgtggtgccagcctgaccctcagcaccttaatgagtagcagtggcagcaacaacaacttatccatcagtaatgaagagccaacattttcacctattcctgtcatgcaaactgaaatcctgtcccctctgcgagatcatgagaacctgaaaaacctctgggtgaagattgaccttgacttactctctagagtacctggccacagctcactccatgcagcacctgccaagccagaccacaaggagactgccacaaaacccaagcgtcagacagctgtcacagctgtggagaaaccagcccctaagggcaaacgtaagcacaagccaatagaagttgcagagaagatccctgagaagaagcagcgcctggaggaggccacaactatctgcttgctccctccttgcatctcaccagccccaccccacaagcctcccaacactagagaaaataattcatccaggagagcaaatagaagaaaggaagaaaaactatttcctcctccactttccccactgccagaggaccctccacgccgcagaaatgtcagtggcaataatggtccctttggtcaagacaaaaacatcgccatgactggacaaatcacatctaccaaacctaagagaactgaaggcaaattctgtgctactttcaaagggatatcggagggagacactccaaaaaaggcatcctctgccaccatcactgtcaccaatactgctattgccactgctactgtcactgctactgccattgtcaccaccactgtcacagctactgccaccgccacggccaccaccacaactactaccactaccatttccaccatcacctctaccatcactactggcctcatggatagcagtcacctggagatgacgtcctgggcggctctgccccttctatccagcagcagcactaatgtccggagacccaagctcacttttgatgactcggttcacaatgctgattattacatgcaagaagctaagaagctgaagcacaaagctgatgcactgttcgagaaatttggcaaagctgtgaattatgctgatgccgccctctccttcactgaatgtggcaatgccatggaacgcgaccctctggaagcaaagtccccatacaccatgtactctgagactgtggagctcctcaggtatgcaatgaggctgaagaactttgcaagtcccttggcttcggatggggacaaaaagctagcagtactatgctaccgatgtttatcactcctctatttgagaatgtttaagctgaagaaggaccatgctatgaagtactccagatcactgatggaatattttaagcaaaatgcttcaaaagtcgcacagataccctctccatgggtaagcaatggaaagaacactccatccccagtgtctctcaacaacgtctcccccatcaacgcaatggggaactgtaacaatggcccagtcaccattccccagcgcattcaccacatggctgccagccacgtcaacatcactagcaatgtgttacggggctatgaacactgggatatggccgacaaactgacaagagaaaacaaagaattctttggtgatctggacacgctgatggggcctctgacccagcacagcagcatgaccaatcttgtccgctacgttcgccaaggactgtgttggctgcgcatcgatgcccacttgttgtagtgggtgttctcagatctctagcatcacgacccatcactctacctctaccagcgcactgatggtcactggtggaactccactcactggggaacgttctctttggttatgtttgtttttatgcttcttttgttatctgtaaaaaacagaagtcattgtaagttgacactacaacttaagggcagtgtacgttttattacttagtcattttttttcttttagcatttgatatgcatttctcagattccaccatctttttgtgctttatggaatgacagtccctacaatattgttttaagcccacactacccaaaacaaagaatgggaagcacttgtgataaagacaggctcctgagaaatgcaacaagtggtcttacatatacatgagaacttagacacaagggaccatcccccaaactctactcttatacccagaaaagaacatatttcagaatctgtcaaacttttgtgtatcccacagattcaatcttcaggtgagaattttcattgtcaaaacccactggttagatgttgtagcaacatcataaaatcaagagtatcaagaaaataaatgagcatagcaatgctactcttaaaaagatgctatgccacacaaccagaggactttcttgttagcatccctttcctgattccctattttgttaattttaatgataagaagaaagggtgacatttattttgacaagttttaggcatcagctggcatcagtgtttttcaactccattatttgaagtgtaaatcctcacctggggttctctgtgtgcaaagctgtccttttgaagaacagtttggttgatgcatgccttagtagccaaaatgctacactctagacttacaagtgggagttaagagaggtctggaaagtgtccaacaaggaattcacacctctgcctcctttgcaacaacaacatttacacagttggtaagtgggtccataactggcaggatttttaaattgtattttgctcaaatctatgggaacaaaagtcaaggtatcactacctagaagtaatgatatacagttttcttcctagtggcttgaaaatctggacttcctcaattattattcacattttctctcttataggttttctgttttctactttcttttttctcttatctgtgtttccctttcctttgtttggctcattaacttttgactgaattacaattactccttttattaaagtccatattattgtgaatcatttccatgaaaatttctaagaaaactccaaactctctaaatagtagctaacttttatttttttaaaatgagtcgtggggtagtgcttcaccttgagatgctttgaaagagccctaaacattgggaaccattcacctaatttggagacatttctcactggttgtgactacccccttatgatccttcacattcattttatgtccctaaacatcacaatgtaaatatcatttttgatgttccagctcaccagaagattcttacacttggggtaaacactatccatgcattacttactggtaattacctgctggtatataattccatgtagcctttaatatgctgggttatcaaattctgttcactgagttatgaccagataaataatagatatgcacatgaaagatgcaaacttgtgtgattattaaagccagccatgcaggtccatgatagaaacagcaggtgatgactctgcactctcattgtcaaggttagatatatccccagttgcaaaacagccagacttgagctgtgctctggtcatctttgagtttaaggccttttgttgtataaggctgtggaagttgtactccaatggctgaagccatgttgttaatatggctgatgggagcatccctgcagctgaacccagcactttttatgctcccactgtggttgagctttatgtttacagtctcagcaacaacacttatgcatccaaacactcacaaatgaaacctgaaagaatcttttctgagcctcttaaaagaggaaaatgatgataacattaaagactctgaacacccaaggttggtgtcacatataaaaattaagctgatgactttgcagtgactcaagttgtctctttatcatggtttaccaggtagagtgcctggctattactatataatgaagcccactggcttgacttgtaagttcaacctaaaccacaatcctagaccatcatggatttaggagtagattcttcttgaaatcccacatccagaaactagacattagaatgttgaggcagtttcccagagaaacaagcatattgcctcatggatgaaagacttgtagttctagtttcagtgacttgttatatctacttacatacaacagggaggcaagaggattctctgtcatctctggtgactgagtgtaaaatatgtgccaagtctgcagcacagtgaccaaatctgacaatcgagctctggatcaccacttgattatgtagtagactcatttataaagcagcttaggaactaattaaacatggaggatgaattaccttcctatcccttgagataagacatctttcagtttcatgattaaggattgttgctgttttatagttactctgttcatcacagtgtaaatggtgatgcgtgtcgtaggtgtgcagctatttgagggactaagggatggagatattctgtcaaatgaatctcttcagtataccagtttgtgggagggatatgagacatgtggatggcagtgagagatcgtgcctctagatcttgatggaggcttggtgagacacacttaaataagcacgtggaggttagaatagagggcagagtaaaaggaagctccatctgagcaagtacaccaaatgatctcagccctgcaacttgacccaggtagggccaccactacgccttcacttgtcacccaagctccaaccacagagagtttgacaagtttgtgttatgatgttggcttggctttgtatttttaattaactttggatttttagtggttttgtcatataactgtctgagtttggtaggtaggattactttgaaaagggtttactagtgtggtcctccgggtagaatttagctgtaagcatgttgttagccagcc

SEQ ID NO: 106053 - DNA, 3952 bp, Homo sapiens
  Payload ID: 788
  Gene Symbol: AFF2
  Gene Name: AF4/FMR2 family, member 2
  Uniprot ID: P51816
  ENST ID: ENST00000370457
  CDS Start-End: 52-3882
acccgctgcgatcagggacaggcgcccgcccgccgccgccgcctggccgctatggatctattcgactttttcagagactgggacttggagcagcagtgtcactatgaacaagaccgtagtgcacttaaaaaaagggaatgggagcggaggaatcaagaagtccagcaagaagacgatctcttttcttcaggctttgatctttttggggagccatacaaggtagctgaatatacaaacaaaggtgatgcacttgccaaccgagtccagaacacgcttggaaactatgatgaaatgaagaatttgctaactaaccattctaatcagaatcacctagtgggaattccaaagaattctgtgccccagaatcccaacaacaaaaatgaaccaagcttttttccagaacaaaagaacagaataattccacctcaccaggataatacccatccttcagcaccaatgcctccaccttctgttgtgatactgaattcaactctaatacacagcaacagaaaatcaaaacctgagtggtcacgtgatagtcataaccctagcactgtactggcaagccaggccagtggtcagccaaacaagatgcagactttgacacaggaccagtctcaagccaaactggaagacttctttgtctacccagctgaacagccccagattggagaagttgaagagtcaaacccatctgcaaaggaagacagtaaccctaattctagtggagaagatgctttcaaagaaatctttcaatccaattcaccggaagaatctgaattcgccgtgcaagcgcctgggtctcccctagtggcttcctctttattagctcctagcagtggcctttcagttcaaaacttcccaccagggctttactgcaaaacaagcatggggcagcaaaagccaactgcatacgtcagacccatggatggccaggaccaggcaccggacatctcaccaacactgaaaccttcaattgaatttgagaacagctttgggaatctgtcatttggaacactcttggatggaaaacccagtgcagccagttcaaagactaaactgccaaagttcaccatcctccaaacaagtgaagtaagccttcccagtgatccaagctgtgttgaagaaatcttgcgggaatcgcagcatctgaccccaggattcaccttacaaaagtggaatgacccaaccaccagagcttctacaaagatgcttgaggatgacctgaagctgagcagtgatgaagatgaccttgagcctgtgaagaccttgaccactcagtgcactgccactgagctctaccaggctgttgaaaaggcaaaacctaggaataatcctgtgaacccacccttggccactccccagcccccacctgcagtgcaagccagcgggggttctggcagctccagcgaatcggagagcagctctgagtcggattcagacactgaaagtagcaccactgacagcgaatctaatgaggcacctcgtgtggcaactccagagcctgagccaccctcaaccaacaagtggcaactggataaatggcttaacaaagtgacatcccagaacaagtcttttatttgtggccaaaatgaaacacccatggagactatttctctgcctcctccaatcatccaaccaatggaagtccagatgaaagtgaagacgaatgccagtcaggtcccagctgaacccaaagaaaggcctctcctcagtctcattagggagaaagcccgtccacggcccactcagaaaattccagaaacaaaggctttgaagcataagttgtcaacaactagtgagacagtgtctcaaaggacaattgggaaaaaacagcccaaaaaagttgagaagaacaccagcactgacgagtttacctggcccaaaccaaatattaccagcagcactcccaaagaaaaagaaagtgtggagcttcatgacccaccaagaggccgcaacaaagccactgcccacaaaccagcccctaggaaagaaccaagacctaacatccctttggctcccgagaagaagaagtacagagggcctggcaagattgtgccaaagtctcgggaattcattgaaacagattcatctacatctgactccaacacagatcaggaagagaccctgcaaatcaaagtcctgcctccgtgcattatttctggaggtaatactgccaaatccaaggaaatctgtggtgccagcctgaccctcagcaccttaatgagtagcagtggcagcaacaacaacttatccatcagtaatgaagagccaacattttcacctattcctgtcatgcaaactgaaatcctgtcccctctgcgagatcatgagaacctgaaaaacctctgggtgaagattgaccttgacttactctctagagtacctggccacagctcactccatgcagcacctgccaagccagaccacaaggagactgccacaaaacccaagcgtcagacagctgtcacagctgtggagaaaccagcccctaagggcaaacgtaagcacaagccaatagaagttgcagagaagatccctgagaagaagcagcgcctggaggaggccacaactatctgcttgctccctccttgcatctcaccagccccaccccacaagcctcccaacactagagaaaataattcatccaggagagcaaatagaagaaaggaagaaaaactatttcctcctccactttccccactgccagaggaccctccacgccgcagaaatgtcagtggcaataatggtccctttggtcaagacaaaaacatcgccatgactggacaaatcacatctaccaaacctaagagaactgaaggcaaattctgtgctactttcaaagggatatcggtaaatgagggagacactccaaaaaaggcatcctctgccaccatcactgtcaccaatactgctattgccactgctactgtcactgctactgccattgtcaccaccactgtcacagctactgccaccgccacggccaccaccacaactactaccactaccatttccaccatcacctctaccatcactactggcctcatggatagcagtcacctggagatgacgtcctgggcggctctgccccttctatccagcagcagcactaatgtccggagacccaagctcacttttgatgactcggttcacaatgctgattattacatgcaagaagctaagaagctgaagcacaaagctgatgcactgttcgagaaatttggcaaagctgtgaattatgctgatgccgccctctccttcactgaatgtggcaatgccatggaacgcgaccctctggaagcaaagtccccatacaccatgtactctgagactgtggagctcctcaggtatgcaatgaggctgaagaactttgcaagtcccttggcttcggatggggacaaaaagctagcagtactatgctaccgatgtttatcactcctctatttgagaatgtttaagctgaagaaggaccatgctatgaagtactccagatcactgatggaatattttaagcaaaatgcttcaaaagtcgcacagataccctctccatgggtaagcaatggaaagaacactccatccccagtgtctctcaacaacgtctcccccatcaacgcaatggggaactgtaacaatggcccagtcaccattccccagcgcattcaccacatggctgccagccacgtcaacatcactagcaatgtgttacggggctatgaacactgggatatggccgacaaactgacaagagaaaacaaagaattctttggtgatctggacacgctgatggggcctctgacccagcacagcagcatgaccaatcttgtccgctacgttcgccaaggactgtgttggctgcgcatcgatgcccacttgttgtagtgggtgttctcagatctctagcatcacgacccatcactctacctctaccagcgcactgatggtcactggt

SEQ ID NO: 106054 - DNA, 1488 bp, Homo sapiens
  Payload ID: 788
  Gene Symbol: AFF2
  Gene Name: AF4/FMR2 family, member 2
  Uniprot ID: P51816
  ENST ID: ENST00000370458
  CDS Start-End: 90-1373
ccgagaaccgccagcgagctgtgccgagagccgcgccgacccgctgcgatcagggacaggcgcccgcccgccgccgccgcctggccgctatggatctattcgactttttcagagactgggacttggagcagcagtgtcactatgaacaagaccgtagtgcacttaaaaaaagggaatgggagcggaggaatcaagaagtccagcaagaagacgatctcttttcttcaggctttgatctttttggggagccatacaagacaaacaaaggtgatgcacttgccaaccgagtccagaacacgcttggaaactatgatgaaatgaagaatttgctaactaaccattctaatcagaatcacctagtgggaattccaaagaattctgtgccccagaatcccaacaacaaaaatgaaccaagcttttttccagaacaaaagaacagaataattccacctcaccaggataatacccatccttcagcaccaatgcctccaccttctgttgtgatactgaattcaactctaatacacagcaacagaaaatcaaaacctgagtggtcacgtgatagtcataaccctagcactgtactggcaagccaggccagtggtcagccaaacaagatgcagactttgacacaggaccagtctcaagccaaactggaagacttctttgtctacccagctgaacagccccagattggagaagttgaagagtcaaacccatctgcaaaggaagacagtaaccctaattctagtggagaagatgctttcaaagaaatctttcaatccaattcaccggaagaatctgaattcgccgtgcaagcgcctgggtctcccctagtggcttcctctttattagctcctagcagtggcctttcagttcaaaacttcccaccagggctttactgcaaaacaagcatggggcagcaaaagccaactgcatacgtcagacccatggatggccaggaccaggcaccggacatctcaccaacactgaaaccttcaattgaatttgagaacagctttgggaatctgtcatttggaacactcttggatggaaaacccagtgcagccagttcaaagactaaactgccaaagttcaccatcctccaaacaagtgaagtaagccttcccagtgatccaagctgtgttgaagaaatcttgcgggaatcgcagcatctgaccccaggattcaccttacaaaagtggaatgacccaaccaccagagcttctacaaagatgcttgaggatgacctgaagctgagcagtgatgaagatgaccttgagcctgtgaagaccttgaccactcagtgcactgccactgagctctaccaggctgttgaaaaggcaaaacctaggaataatcctgtgaagtaagttattatttttattagttgcaaatgttaattttaacggactcgatgcatgtgaaaaaataaggtcataaaagagaccttggattttgagttaatctctattcatgacaatttaa

SEQ ID NO: 106055 - DNA, 13746 bp, Homo sapiens
  Payload ID: 788
  Gene Symbol: AFF2
  Gene Name: AF4/FMR2 family, member 2
  Uniprot ID: P51816
  ENST ID: ENST00000370460
  CDS Start-End: 480-4415
cgccgcctgtgcagccgctgccgccgccgccgccgccgccgccgccgccgccgccgccgccgccgctgccgccccggctgccgcgccgcgccgctgcctctgccccggccgcccccgccgccgctgccgccgccggcccgcagccagccaggcgggcggcccagcccgcctgagcccgcagcggctgccgccgcagcgtcgggtcgctgggtgcgcgggctaccgcggaccgagcggacccgagtgggcgaccaggcgcttgcccgcccagtgccactgccgccgcttcctcgccggagcacaggaccagacacctccagcgcccgctgctgctgccgatgcggcccggacacttttagctgggcgggagggctggagagccgggggccgccgagaaccgccagcgagctgtgccgagagccgcgccgacccgctgcgatcagggacaggcgcccgcccgccgccgccgcctggccgctatggatctattcgactttttcagagactgggacttggagcagcagtgtcactatgaacaagaccgtagtgcacttaaaaaaagggaatgggagcggaggaatcaagaagtccagcaagaagacgatctcttttcttcaggctttgatctttttggggagccatacaaggtagctgaatatacaaacaaaggtgatgcacttgccaaccgagtccagaacacgcttggaaactatgatgaaatgaagaatttgctaactaaccattctaatcagaatcacctagtgggaattccaaagaattctgtgccccagaatcccaacaacaaaaatgaaccaagcttttttccagaacaaaagaacagaataattccacctcaccaggataatacccatccttcagcaccaatgcctccaccttctgttgtgatactgaattcaactctaatacacagcaacagaaaatcaaaacctgagtggtcacgtgatagtcataaccctagcactgtactggcaagccaggccagtggtcagccaaacaagatgcagactttgacacaggaccagtctcaagccaaactggaagacttctttgtctacccagctgaacagccccagattggagaagttgaagagtcaaacccatctgcaaaggaagacagtaaccctaattctagtggagaagatgctttcaaagaaatctttcaatccaattcaccggaagaatctgaattcgccgtgcaagcgcctgggtctcccctagtggcttcctctttattagctcctagcagtggcctttcagttcaaaacttcccaccagggctttactgcaaaacaagcatggggcagcaaaagccaactgcatacgtcagacccatggatggccaggaccaggcaccggacatctcaccaacactgaaaccttcaattgaatttgagaacagctttgggaatctgtcatttggaacactcttggatggaaaacccagtgcagccagttcaaagactaaactgccaaagttcaccatcctccaaacaagtgaagtaagccttcccagtgatccaagctgtgttgaagaaatcttgcgggagatgacccattcctggcctactcctctcacttccatgcatactgctggacactctgagcagagcaccttttccatcccaggacaggaatcgcagcatctgaccccaggattcaccttacaaaagtggaatgacccaaccaccagagcttctacaaagtcagtgtctttcaaatcgatgcttgaggatgacctgaagctgagcagtgatgaagatgaccttgagcctgtgaagaccttgaccactcagtgcactgccactgagctctaccaggctgttgaaaaggcaaaacctaggaataatcctgtgaacccacccttggccactccccagcccccacctgcagtgcaagccagcgggggttctggcagctccagcgaatcggagagcagctctgagtcggattcagacactgaaagtagcaccactgacagcgaatctaatgaggcacctcgtgtggcaactccagagcctgagccaccctcaaccaacaagtggcaactggataaatggcttaacaaagtgacatcccagaacaagtcttttatttgtggccaaaatgaaacacccatggagactatttctctgcctcctccaatcatccaaccaatggaagtccagatgaaagtgaagacgaatgccagtcaggtcccagctgaacccaaagaaaggcctctcctcagtctcattagggagaaagcccgtccacggcccactcagaaaattccagaaacaaaggctttgaagcataagttgtcaacaactagtgagacagtgtctcaaaggacaattgggaaaaaacagcccaaaaaagttgagaagaacaccagcactgacgagtttacctggcccaaaccaaatattaccagcagcactcccaaagaaaaagaaagtgtggagcttcatgacccaccaagaggccgcaacaaagccactgcccacaaaccagcccctaggaaagaaccaagacctaacatccctttggctcccgagaagaagaagtacagagggcctggcaagattgtgccaaagtctcgggaattcattgaaacagattcatctacatctgactccaacacagatcaggaagagaccctgcaaatcaaagtcctgcctccgtgcattatttctggaggtaatactgccaaatccaaggaaatctgtggtgccagcctgaccctcagcaccttaatgagtagcagtggcagcaacaacaacttatccatcagtaatgaagagccaacattttcacctattcctgtcatgcaaactgaaatcctgtcccctctgcgagatcatgagaacctgaaaaacctctgggtgaagattgaccttgacttactctctagagtacctggccacagctcactccatgcagcacctgccaagccagaccacaaggagactgccacaaaacccaagcgtcagacagctgtcacagctgtggagaaaccagcccctaagggcaaacgtaagcacaagccaatagaagttgcagagaagatccctgagaagaagcagcgcctggaggaggccacaactatctgcttgctccctccttgcatctcaccagccccaccccacaagcctcccaacactagagaaaataattcatccaggagagcaaatagaagaaaggaagaaaaactatttcctcctccactttccccactgccagaggaccctccacgccgcagaaatgtcagtggcaataatggtccctttggtcaagacaaaaacatcgccatgactggacaaatcacatctaccaaacctaagagaactgaaggcaaattctgtgctactttcaaagggatatcggtaaatgagggagacactccaaaaaaggcatcctctgccaccatcactgtcaccaatactgctattgccactgctactgtcactgctactgccattgtcaccaccactgtcacagctactgccaccgccacggccaccaccacaactactaccactaccatttccaccatcacctctaccatcactactggcctcatggatagcagtcacctggagatgacgtcctgggcggctctgccccttctatccagcagcagcactaatgtccggagacccaagctcacttttgatgactcggttcacaatgctgattattacatgcaagaagctaagaagctgaagcacaaagctgatgcactgttcgagaaatttggcaaagctgtgaattatgctgatgccgccctctccttcactgaatgtggcaatgccatggaacgcgaccctctggaagcaaagtccccatacaccatgtactctgagactgtggagctcctcaggtatgcaatgaggctgaagaactttgcaagtcccttggcttcggatggggacaaaaagctagcagtactatgctaccgatgtttatcactcctctatttgagaatgtttaagctgaagaaggaccatgctatgaagtactccagatcactgatggaatattttaagcaaaatgcttcaaaagtcgcacagataccctctccatgggtaagcaatggaaagaacactccatccccagtgtctctcaacaacgtctcccccatcaacgcaatggggaactgtaacaatggcccagtcaccattccccagcgcattcaccacatggctgccagccacgtcaacatcactagcaatgtgttacggggctatgaacactgggatatggccgacaaactgacaagagaaaacaaagaattctttggtgatctggacacgctgatggggcctctgacccagcacagcagcatgaccaatcttgtccgctacgttcgccaaggactgtgttggctgcgcatcgatgcccacttgttgtagtgggtgttctcagatctctagcatcacgacccatcactctacctctaccagcgcactgatggtcactggtggaactccactcactggggaacgttctctttggttatgtttgtttttatgcttcttttgttatctgtaaaaaacagaagtcattgtaagttgacactacaacttaagggcagtgtacgttttattacttagtcattttttttcttttagcatttgatatgcatttctcagattccaccatctttttgtgctttatggaatgacagtccctacaatattgttttaagcccacactacccaaaacaaagaatgggaagcacttgtgataaagacaggctcctgagaaatgcaacaagtggtcttacatatacatgagaacttagacacaagggaccatcccccaaactctactcttatacccagaaaagaacatatttcagaatctgtcaaacttttgtgtatcccacagattcaatcttcaggtgagaattttcattgtcaaaacccactggttagatgttgtagcaacatcataaaatcaagagtatcaagaaaataaatgagcatagcaatgctactcttaaaaagatgctatgccacacaaccagaggactttcttgttagcatccctttcctgattccctattttgttaattttaatgataagaagaaagggtgacatttattttgacaagttttaggcatcagctggcatcagtgtttttcaactccattatttgaagtgtaaatcctcacctggggttctctgtgtgcaaagctgtccttttgaagaacagtttggttgatgcatgccttagtagccaaaatgctacactctagacttacaagtgggagttaagagaggtctggaaagtgtccaacaaggaattcacacctctgcctcctttgcaacaacaacatttacacagttggtaagtgggtccataactggcaggatttttaaattgtattttgctcaaatctatgggaacaaaagtcaaggtatcactacctagaagtaatgatatacagttttcttcctagtggcttgaaaatctggacttcctcaattattattcacattttctctcttataggttttctgttttctactttcttttttctcttatctgtgtttccctttcctttgtttggctcattaacttttgactgaattacaattactccttttattaaagtccatattattgtgaatcatttccatgaaaatttctaagaaaactccaaactctctaaatagtagctaacttttatttttttaaaatgagtcgtggggtagtgcttcaccttgagatgctttgaaagagccctaaacattgggaaccattcacctaatttggagacatttctcactggttgtgactacccccttatgatccttcacattcattttatgtccctaaacatcacaatgtaaatatcatttttgatgttccagctcaccagaagattcttacacttggggtaaacactatccatgcattacttactggtaattacctgctggtatataattccatgtagcctttaatatgctgggttatcaaattctgttcactgagttatgaccagataaataatagatatgcacatgaaagatgcaaacttgtgtgattattaaagccagccatgcaggtccatgatagaaacagcaggtgatgactctgcactctcattgtcaaggttagatatatccccagttgcaaaacagccagacttgagctgtgctctggtcatctttgagtttaaggccttttgttgtataaggctgtggaagttgtactccaatggctgaagccatgttgttaatatggctgatgggagcatccctgcagctgaacccagcactttttatgctcccactgtggttgagctttatgtttacagtctcagcaacaacacttatgcatccaaacactcacaaatgaaacctgaaagaatcttttctgagcctcttaaaagaggaaaatgatgataacattaaagactctgaacacccaaggttggtgtcacatataaaaattaagctgatgactttgcagtgactcaagttgtctctttatcatggtttaccaggtagagtgcctggctattactatataatgaagcccactggcttgacttgtaagttcaacctaaaccacaatcctagaccatcatggatttaggagtagattcttcttgaaatcccacatccagaaactagacattagaatgttgaggcagtttcccagagaaacaagcatattgcctcatggatgaaagacttgtagttctagtttcagtgacttgttatatctacttacatacaacagggaggcaagaggattctctgtcatctctggtgactgagtgtaaaatatgtgccaagtctgcagcacagtgaccaaatctgacaatcgagctctggatcaccacttgattatgtagtagactcatttataaagcagcttaggaactaattaaacatggaggatgaattaccttcctatcccttgagataagacatctttcagtttcatgattaaggattgttgctgttttatagttactctgttcatcacagtgtaaatggtgatgcgtgtcgtaggtgtgcagctatttgagggactaagggatggagatattctgtcaaatgaatctcttcagtataccagtttgtgggagggatatgagacatgtggatggcagtgagagatcgtgcctctagatcttgatggaggcttggtgagacacacttaaataagcacgtggaggttagaatagagggcagagtaaaaggaagctccatctgagcaagtacaccaaatgatctcagccctgcaacttgacccaggtagggccaccactacgccttcacttgtcacccaagctccaaccacagagagtttgacaagtttgtgttatgatgttggcttggctttgtatttttaattaactttggatttttagtggttttgtcatataactgtctgagtttggtaggtaggattactttgaaaagggtttactagtgtggtcctccgggtagaatttagctgtaagcatgttgttagccagcctgtagactgttaattacttaataatctcattgggaaaatactagtagttttatatttggatgacataattggaaaagcagattagctgctactacttttaaaagacttaaggtcgggatgcctttttttccatgtaaggaaatgaaaagaccaaaatcttcaggcaaaaagcaagttgcaaaattagaaaccattggctaaaaatgtgttttgttgagtttccaaatggatgaattttcatttggacattacatcactaaattcattagattttgtctgcattggaaagatactcttctagcatatctttcccaaagatatctaatttggattctgtttcatgcaaatttgcatcccggaggttgaagttggagtttgaggttggaaaatatctttgaaggcagaatcagttgagttgtgagggtgaagcctcacatacttctcaacagacatgataaaattcacctgcatgagttggcaggtgggagaaccaaactggatcactgggtaagactactcagtaaagcaatgaactgcttgcttagagaagcatcactatccccattgagaaaaatgtgtggcaagatgatacagctacacagtatcaaatgaatgggtcaattcagcacccccaaatttaattctgtggggaaaaattattgagccagttgtcagtgttctgttacatgactggcagactaaattcttcatcgttgttgttattgttgttgttgtttctcattttcactcgcacggccttattctcataattaaaatctaattcattttctctttagtgttagtagactccaacaacagaagtggcatctgtgtattcataatcagcatttaccctggcaggagactaatcagataggccggtctcagacattaatcctaccatctgatatttttggtgaaggaaaaagtattaattctctttccatcctcctcctcagaaatatagaagccctctttaccaaaatcatcacattttactctgtaatctaccagctaaaagaaaattgcattgtggggagggcagaaagggggtgggggtgggggcgggggggtggggggtggggaagccccacaaagccagattgcagttcttgcccctttttgcgtctgacatgagatgttaaagaattattcatagtgctcacattgggttaggggacactgaactgctttttagatccatgatcagtcatcattcttctaagagattggagctttgctgtttcattaactgtgcagtgtagactaatggtgtttaataaaaatcattcaaaatttcaaactcttttgccagtgacctcaattttgttggctctgtgatttgtatcagactttgaggagggaagggggaagtgaaggaagcctacgtccaggcccctgacaggatgctgcagtagcaagctcaagctcgcctgcctgccagcagttgctggtgagcagcagcatgcagaccagctgtgggaagcctcctgaagaatgccccagctgatgctttcagctgggaatagtttgttcctattggggaactcattgttctccagtctctgcagcaggaagccagctgtcatattcggagggaatttcagatgctttacctttttggttttgtcctgcatcactcatgtggctacgaaagtgtctctgagaatagagcccaatgtggtgacaatgggtagtcaaatgcaccccagatgctcaagccctgttgtggttctgcagtgtttatgaaattgggaggaaggagaccctggacagtaagcaaaattggagacactccaacgaggctaagttaatgccgtgttgcccagaacaagatctagcttctcatttggtcagcctagcatgcaaccagtggtgtgctggtaaaatgtttaacaaccagctcgctgagaatagaaagcacctggtttgcaccatttgccaatttccatggcataaatactaccactttagatgattttaagctaccaactgtgatgtcactgaacacatggttggaaagagatgcacgcagttggctcttgcaagcctgggcaaaaatgcttcaacacgccactggatgcagccagtcagagggttcatatttaatatatgtgttcatgtggacacacacagacacacacacacaaactcacccttacacacacacttcgatgactaaaacaattacatagttttaagatatgaatcaatgtgtgaatgtagaaagcttatgataaggccctagaggtatgggttgccctggaagcctaggttttaagcaggagaatagctgagaagaatgaagccctcctgagctgaaaggagagatggatcaatggagatggttccatcatctccttccatatctcacaggtaaaatgggcactcagaaaaccctcacgattgattttttaaaaagataagtgagtgttttttattttattattattgtcatcattattttgatttacaaatgctatttgtaacttttacatgtaactaggataaagtatttacgggaactctatggagaatagcacaatccagaatttactgtgtttttcttttatgtgacgtggaaactcagtaattctcccaccttcacattgttgttcataagaattttactttagttattagggaatctaagttttttgttaacatttgtttttagttaaaagtatctacttactgttttagctctgaactcaaaccagaatatctctgtatcaattgcatgactattcagaaacaataatccaaaccaaaataattctttttccacccagtacgaagaaaactaagctcagtaacaagaaggcataaactaaagtatataatgaggctttcattaaatacacacacacacacactcacacacacacacatacactttttaaatttttaaattaggcctccacacataaatcattttgaaagtagaatagaaaatctcaaagaattcattctcctggtcctgtgcatcttctgcagttaataagaggtttgtatctggaaagatggaagaacttgttctaaaatcttatttttcaaaaaaaaatttccattttctctctgggcctgtatccatggttgaatgttagccctggaggagatccatgtcttactcgctctttctggcccttctgtcttttgcctctgcaattctttttgtagctggcacgatagcagggactgggggtctatcctttcatggtattgctacaatatttgtccttactggaaaatggtaacatccgggtctgatttaattggcattacacttacacagggactctgagcacccccgtcaccacaccagacagtggaccagttttcacagctacaaagagctagaaatgtgtttaacatcatccagtgcatcccctaattcaaaaccatcctcactaatcaatcatattcacccataaatattacaaatgagattgattccatctcaagacaatttgtcaaatacttaattttcttcctggatgattctacttactggatattttagaaagagaaatgtctgagataaaatccctcacatttactcaatataacaaattactgtttctactcctattctgagtagtgcttctgaagattgtttgctgtagtgttgtctttgataaaatgaatgtcagtagtgagccttttagagataccatgctcagaaatcctctttgggatcagaagatacctaaaattctccccttttgcccacttggttagatgagtgatatattctttggatcctgcaaagaagagattggtttattttcttttctggtggtggtagtggttgtatctgtggctgtgatggttgttgttacttgtctctctctctctctggctctggcttttgctttcctgctagtgttctttctctttccaaacaaatagttaaattaaatgtgagcttctgaattgtacttgttcatactttcaaaacataacagattaataaaaatagatgtgtcctgatttaaaacatgccccctggaaaggcatgctgtattatgaaatcgtgataatataactgcattattacatggcagtataaatattagtctgttgaattcatttgtccaattgtataactttgtggagcagtgttttgacctttgatacataattctggagcaagtggagtggttgcaggcagatgagacagtgttatatcaggatttttcaatcaactttagttggaggcctggcaattacaaacatcttcagatgtttctgtaaccattataaatatgaaaaaaacctcttcaaaaaatttcccatagtacttcagtcaagactttttaggtttatcttttttttttcatttctccttttccttttccattatttttcgatgggggggttgttatcattgactgaagaaatattttgattgcaatggtctctctctctctccccctctctctctctctcctctattctttcctccttccctctgtccatcacccctcattaaaatattgaaatctggagtctttgataaatctgcattagaccaggctatatgctaggaatgaaatctgggcaaatatcgatgggttttcaaagaatgctccatgttcattgggccctttcacaccccacagtgataaatgaaaaggatagaggtagttttttcaaaagagcactttaataatatcctctgagacctaatgcagtttaacaaatgactccacctatttttccagtaggtaaattgactgagacttgcaaaatacccctgagagttgtcaggggtgtcttctgcctggtctatagcgtgtgtgtttgctttgtatctaacaggcacattcacgtctcgtgtactcatatgaagtatttcctaacattcccattagcctgtatataagaatcagaaagataatcccaacatgttgtaaatgaagatgtgactctataacctttctcttcttcctggaaaaaaaaggacattttcatgcatattttaaacagaaattttgtatatttaagtgtcatagaaaatatttattgagtaactgggacacaaatgggaatttaattgtcatcatatgctttgtgtgtggggatgcttaccaacaccatgtcgctggaccattgtggcaagccataactgcacaaagagtacacatcgtcagtgtgtgtgtgtgtgtgtgtgtgcgcgcacacacgtgcgtgtgtgtgtccctgcatgtgcaacatgtctagcttgctgtccttcatgggattttagctttcccttcttgaaaaacattattttacagttccaggaggccctggttacattactatatgaaggcagtgatttgaaatgaaaattcctttcctcttggaagctttggtcataatatcatggttcaattaaacggattccaccggactttgtgatgaaaaaggctctgttaaaatccaattgagtttccaagaggaaattgtagtaggtcaagatgcatgagagggaagatggaggccacctcaactggagaacatgagctgagttgagccctcagtgttgaagttgacttgctccaagctgcagtctaaaaccctggggcccgtgcctggcctatgctccctcccaagtaagtagaggagcagaaccatcaggaacagcctgcctggctcctatgaagaaaacttcctgacgtcctgtccccaaaggaagaccctttccccaagggcaccccaggtggccattaaattgtgatgatcattcagaaagtgcccccttggctttatgagaatccaattagtcttctgaaccaccttttcttgggtgcagatttccaacattcatgctcattgcagatccaccaactgtcactgttcttaacaagcatgctcgtcttgtcagaatttcagtaagttccaatttcctgtacagaccagggtaaactgttctaaaatcaatcaattaatgaaatgttatctggtttttaaaagctggtttcatgtgctttatgtgtataaaactatatctgcctgtgtggctttgcatttcaaatgtgtggcgcacaagcgttttgttggtgctttgttctcagtacagtaactctgtgtacaaacattttaatgtggttttgttgttttccaacaagatgtctctgtaaaaatgatattggctgagctggtgcgttggtttctctcatagaggcattaactatactgccaatgcattgaattatttaaaaatgcaaaataaaatttttatgaaaatctca

SEQ ID NO: 106056 - DNA, 8135 bp, Homo sapiens
  Payload ID: 789
  Gene Symbol: AFF3
  Gene Name: AF4/FMR2 family, member 3
  Uniprot ID: P51826
  ENST ID: ENST00000317233
  CDS Start-End: 237-3917
cgccagcgagaagagagctccacgctcagcctcagaagaaagacgttcaacgacttactggggagagaaagaaaaggaacgggagctgagagctgatcacctgcctttccagaccggagacgggcggcaagtttgaagtcgacacccagaggccagtttgtcccccttcccgcgcgcgggcggcccgagcctcggcggcggcggtagcggcggcggcgacgctgacacctcccaccatggacagcttcgacttagccctgctccaggaatgggacctcgagtcactgtgtgtctatgaaccagatagaaatgcattacggaggaaagaacgagaaagaagaaatcaagaaactcaacaggatgatggcacgtttaattctagttactctctcttcagtgagccctacaagactaacaagggggatgaactctccaaccggatccagaacactttaggcaattatgatgaaatgaaagactttttaactgatagatccaatcagagtcatctcgttggagttcccaaacctggggttcctcagactcctgtgaacaagatcgatgaacattttgttgcagattcaagagcccagaaccagccctcgtctatctgtagcactacaacttccacaccagcagctgtccccgtgcagcagagtaagagaggcactatgggctggcagaaggctgggcacccaccctctgacggccaacagagagcaacacaacagggctctctcaggaccttgcttggagatggtgttggcagacagcagcctcgggccaaacaagtgtgcaatgtggaggtgggccttcagacccaggagaggccacctgccatggcggccaagcacagcagcagcggacactgtgttcagaactttcctccatccctagcttcaaaacccagcctggtccagcagaaaccgaccgcgtatgtgaggccaatggacggccaagatcaggcccctgatgagtctcctaagctgaagtcgtcttcggaaaccagcgtgcactgcacatcatacaggggagtccctgccagcaagccggagcctgccagagccaaggccaagctctccaagttcagcatccccaagcagggggaggagagtagatctggagaaaccaacagctgtgttgaagaaataatccgggagatgacctggcttccaccactttctgctattcaagcacctggcaaagtggaaccaaccaaatttccatttccaaataaggactctcagcttgtatcctctggacacaataatccaaagaaaggtgatgcagagccagagagtccagacaatggcacatcgaatacatcaatgctggaagatgaccttaagctaagcagtgatgaagaggagaatgaacagcaggcagctcagagaacggctctccgcgctctctctgacagcgccgtggtccagcagcccaactgcagaacctcggtgccttccagcaagggcagcagcagcagcagcagcagcggcagcagcagctcctccagcgactcagagagcagctccggatctgactcggagaccgagagcagctccagcgagagtgagggcagcaagcccccccacttctccagccccgaggctgaaccggcatcctctaacaagtggcagctggataaatggctaaacaaagttaatccccacaagcctcctattctgatccaaaatgaaagccacgggtcagagagcaatcagtactacaacccggtgaaagaggacgtccaggactgtgggaaagtccccgacgtttgccagcccagcctgagagagaaggagatcaagagcacttgcaaggaggagcaaaggccaaggacagccaacaaggcccctgggagtaaaggcgtgaagcagaagtccccgcccgcggccgtggccgtggcggtgagcgcagccgccccgccacccgcagtgccctgtgcgcccgcggagaacgcgcccgcgcctgcccggaggtccgcgggcaagaagcccaccaggcgcaccgagaggacctcagccggggacggcgccaactgccaccggcccgaggagcccgcggccgcggacgcgctggggacgagcgtggtggtccccccggagcccaccaaaaccaggccctgtggcaacaacagagcgagccaccgcaaggagctgcgctcctccgtgacctgcgagaagcgccgcacgcgggggctaagcaggatcgtccccaaatccaaggagttcattgagacagagtcgtcatcttcatcctcctcctcggactccgacctggagtccgagcaggaggagtaccctctgtccaaagcacagaccgtggctgcctctgcctcctccgggaatgatcagaggctgaaggaggccgctgccaacgggggcagtggtcctagggcccctgtaggctccatcaacgccaggaccaccagtgacatcgccaaggagctggaggagcagttctacacactggtcccctttggccggaacgaacttctctcccctctaaaggacagtgatgagatcaggtctctctgggtcaaaatcgacctgaccctcctgtccaggatcccagaacacctgccccaggagccaggggtattgagcgcccctgccaccaaggactctgagagcgcaccgcccagccacacctcggacacacctgcagaaaaggctttgccaaaatccaagaggaaacgcaagtgtgacaacgaagacgactacagggagatcaagaagtcccagggagagaaagacagctcttcaagactggccacctccaccagtaatactttgtctgcaaaccactgcaacatgaacatcaacagtgtggcaataccaataaataaaaatgaaaaaatgcttcggtcgcccatctcacccctctctgatgcatctaaacacaaatacaccagcgaggacttaacttcttccagccgacctaatggcaacagtttgtttacttcagcctcttccagcaaaaagcctaaggccgacagccagctgcagcctcacggcggagacctcacgaaagcagctcacaacaattctgaaaacattcccctccacaagtcacggccgcagacgaagccgtggtctccaggctccaacggccacagggactgcaagaggcagaaacttgtcttcgatgatatgcctcgcagtgccgattattttatgcaagaagctaaacgaatgaagcataaagcagatgcaatggtggaaaagtttggaaaggctttgaactatgctgaagcagcattgtcgtttatcgagtgtggaaatgcaatggaacaaggccccatggaatccaaatctccttatacgatgtattcagaaacagtagagctcatcaggtatgctatgagactaaaaacccactcaggccccaatgccacaccagaagacaaacaactggctgcattatgttaccgatgcctggccctcctgtactggcggatgtttcgactcaaaagggaccacgctgtaaagtattcaaaagcactaatcgactatttcaagaactcatctaaagccgcccaagccccatctccgtggggggccagtggaaagagcactggaaccccatcccccatgtctcccaacccctctcccgccagctccgtggggtctcagggcagcctctccaacgccagcgccctgtccccgtcgaccatcgtcagcatcccacagcgcatccaccagatggcggccaaccacgtcagcatcaccaacagcatcctgcacagctacgactactgggagatggccgacaacctggccaaggaaaaccgagaattcttcaacgacctggatctgctcatggggccggtcaccctgcacagcagcatggagcacctggtccagtactcccaacagggcctgcactggctgcggaacagcgcccacctgtcatagggacctcaccctggggccagagtgggctctggtctccacagatggctcaacgtttttggacactgtgctactgaaactcccagccacagcatttatcagactgcggtgaacatttcctcagcattgaacaatgatcttttgcagggcatgtgtgtttgtatgtgtgggtatataagaagccgcctgtgtatgtgtgtaagatacacagctcttcagaacacaccttctttgtctagtttccataatcccaggctagacaaagtgatcagaggtttctgactagaggaagtacacacacacacacacacacacacacacaccgtacactcacacacaatcacagacacacactttctattccattccagtgctaaaccgtgacttcttagaaaattcaaccaaaatctcatgggttagttaaccaggtgcaatacagcacaccaaaagcttgactgccagtgaagatggacctgctcttatactgttgattactttcagtattaatatactattccccaattattttttgattggtatgtattaatgggtaattgaataatgaaaataagccaggtatttttgtgccggaagtttactagattgcatgttaccaaataccctgctcttcctctaattcccttcccccatctgactctattatcaactaaatgcattccaggcaaacagatggacactcacagcccttcccagccccacctccaagtagtatgcaaatggcactgagatttagcaaaaacgcggcgtctttgaaagttaacagacactaaggtagcagtgcctgtgtgttggagctcagttaggagttgaagttttctgcacctgtgataacaagcccaccagccacatgcatttcttcttcctgccactgtgactcggtggctgtagagccacatggcatttgtcagccaatctgtttcaagtcttttctttccaccaatagctttcttacagattttcttggctaaatgaggccattacctagattgtcccttcagtaggagcctgaatccttcgcttaccaggctgagagctatttgccatgataatgctgattctctcactcctcatgcagaatgtgcacctgcagccctttgatgcgttttgatttgggggcgatttttcaggctttgattagcaggctgcttgcaatgcagaagatcacagttcctttctggggcagcagcaaccagagcctcttcctgtgtcctgtgtgtctggtatgtttacaccttgctctgagtttttctcttgttttctttttttaattaagtttacattttagtttctttgacatcttgtttacagtttttgtctgatgttttttcttttgtagtgtcttatgccctagatttagtcatcttgttaaatatatttggatatgaaatcttgacgaaaagaaaataactcctgaaaaagagggtctatcttgccacacgttaaaaacaaaaataatgtccttgtggcctcttacttgataaagttgcaccaggacggtctgagaaaggcaggcggtgtaatatgtggtgcaatccattttttcaaggtgatgacggcacaaaatacttagactagatgctgatccataaacattcactgatattcttacaggttggtttgcagtgttaacatttttgttagcctgatctgtaggtgggaagtaagatcatcataattccttagctctgagcactgattcaaaattgtataaatgactgaacaacttagatgatttgaaattaattgaaaataagaagggcttgtggaatttgcatttggctttggccttcaagcatttggaaatattaagagaatttccattttacatgtctccaactggggtgcttcttacaaccctttcactttttttttgagacgagtttcgctctgttgcccaggctggagtgcagtggcacgatctcggctcactgcatcctctgcctcctgggttcaagtgattgtcccgcctcagcctcccaagtagctgggattacaggtgtgcactaccatgcccagctaatttttgtgtttttagtagagactgggtttcaccatgttggccaggctcgtctcaaactcctgacctcaggtgatctacccgcctccacctcccaaagtgttgtgattacaggcgtgagccaccacacccagccctttcactaatttttggcagagttcacaatcccatcctatgtcagaaacttgaacctaacttaagaaattttgagtcatttttttggaggactgaggctttgttctacctactcttgaagaatcctgatgaaatattcaaacacataaagggatggccctggaggtctatcctgcatacctggagagcttctctggtcctgcccaccttgaaagttgcagactttgttgtaacatctatgtgatgagcttccctgtgaagccccatttgacaggtgggccagcagtgttttatcagcactctgatggcccacatttcccaggaaaacttcttgaaacttaccgttgtgggcagtggtcagagcgtgtagttcttatgactgtcttgtttcatctgtggagcacgtgtggagcacgttggtacagcagtttctgtggggtttggcatgggtgattttggttagtaaccatcctccaattgttgcttgtgaaagtcattcataacttgttccttttacttagttttgttgttactgctgttgttgttggtttggttggttttgagaccgggtctggctctgtagcccaagctggaatgcggtggcgcgatcatggctccctgcagcctcaaactcctgggctcaagcaatcctcctgcctcagcctcccaagcagctgggaagataggcacgtgccaccacacccggctaattttttctttattttttttgtagagatgggggtctcactatgttgcccaggctggtctcaaactcctgggctcaagcgatcctttggcctcggcctcccaaagtgcatgagccaccatgcctggcctgtttagttttgtttcaagttgaaatacctttcttgtgttttctaattagaaaagtaatatctactcattgtaaaaactcaaacagtgcagaaatgtagaaagtagaaagtgtaagtccctggttgtcccttctgcctgagacaaccactgctcacagtttgatgtatatccttccagagactctcaaatttaagcaaataatttttattaccatgtctttttatttgaagacgtacatttgcctccaaagttcaacacaagttcaactgaccatatccttccatgacctgaatagatgctatcctttatcacgatgttcaattgcctttgaaagagagtagtccaggtatattcctgatcaaaatttggcatttttgatgatactactctacacagatcagactcatgtgcagaatcgtgcctggagagagaggtttggttaagacagagatttctggaaacattcaaattgcaaatggaaacttgaaacccacaatctaatgaggaatgtactggaaaaataatctgaagagttgacaaattgtgtactagattgaacacatggaatgcaatgcaatgagactttctgcactaaaacttatcctcatatgtacaacaatgatgtgtgtattatataacagtgatgtgtacatttctgacaccccatacataatatacacagtttgtataaatgcatacatttaaaaatatatatgtacaatacagctaacataaaactgtagtacgcctgaaggatattactagtgcctaatattgagtatgagtcactgcgtgttcgcatcaacttggaagtgcagtaattgttataaaattaatcagtgcagccaacattatttatgaatcacatctttgaaactgtgcagtagcatatacatatatatttttaaataacatttttcacagttttccagagttactgttgaaatctgcatcaccaaaaaaaaaaaaaagcaagatttttttaacaatgtagacactcttcagacccagtaatctgcgtgtgatttcctatttgtagattcccaagagactttagcagtcaccagccttaatgcatgtacaggatattattgtgacttaatttatctgcagtttttaatccatgtgaaattggaatttataaacggacttggattaaacatgtctgcctttctaaggttgcaaatgttacattaaatgatttatgttgt

SEQ ID NO: 106057 - DNA, 4342 bp, Homo sapiens
  Payload ID: 789
  Gene Symbol: AFF3
  Gene Name: AF4/FMR2 family, member 3
  Uniprot ID: P51826
  ENST ID: ENST00000409579
  CDS Start-End: 234-3989
aaatccgatctcaaataggaaagaagtctcattggccttttggtcttctacctgtgtcctgaattgagtttgttaatcctcattcggagctgatcacctgcctttccagaccggagacgggcggcaagtttgaagtcgacacccagaggccagtttgtcccccttcccgcgcgcgggcggcccgagcctcggcggcggcggtagcggcggcggcgacgctgacacctcccaccatggacagcttcgacttagccctgctccaggaatgggacctcgagtcactgtggggtgaagacatcttaaaccagaggaatgactctctagttgtggaatttcagtcatcagccagcagatgcaggagtgtctatgaaccagatagaaatgcattacggaggaaagaacgagaaagaagaaatcaagaaactcaacaggatgatggcacgtttaattctagttactctctcttcagtgagccctacaagactaacaagggggatgaactctccaaccggatccagaacactttaggcaattatgatgaaatgaaagactttttaactgatagatccaatcagagtcatctcgttggagttcccaaacctggggttcctcagactcctgtgaacaagatcgatgaacattttgttgcagattcaagagcccagaaccagccctcgtctatctgtagcactacaacttccacaccagcagctgtccccgtgcagcagagtaagagaggcactatgggctggcagaaggctgggcacccaccctctgacggccaacagagagcaacacaacagggctctctcaggaccttgcttggagatggtgttggcagacagcagcctcgggccaaacaagtgtgcaatgtggaggtgggccttcagacccaggagaggccacctgccatggcggccaagcacagcagcagcggacactgtgttcagaactttcctccatccctagcttcaaaacccagcctggtccagcagaaaccgaccgcgtatgtgaggccaatggacggccaagatcaggcccctgatgagtctcctaagctgaagtcgtcttcggaaaccagcgtgcactgcacatcatacaggggagtccctgccagcaagccggagcctgccagagccaaggccaagctctccaagttcagcatccccaagcagggggaggagagtagatctggagaaaccaacagctgtgttgaagaaataatccgggagatgacctggcttccaccactttctgctattcaagcacctggcaaagtggaaccaaccaaatttccatttccaaataaggactctcagcttgtatcctctggacacaataatccaaagaaaggtgatgcagagccagagagtccagacaatggcacatcgaatacatcaatgctggaagatgaccttaagctaagcagtgatgaagaggagaatgaacagcaggcagctcagagaacggctctccgcgctctctctgacagcgccgtggtccagcagcccaactgcagaacctcggtgccttccagcaagggcagcagcagcagcagcagcagcggcagcagcagctcctccagcgactcagagagcagctccggatctgactcggagaccgagagcagctccagcgagagtgagggcagcaagcccccccacttctccagccccgaggctgaaccggcatcctctaacaagtggcagctggataaatggctaaacaaagttaatccccacaagcctcctattctgatccaaaatgaaagccacgggtcagagagcaatcagtactacaacccggtgaaagaggacgtccaggactgtgggaaagtccccgacgtttgccagcccagcctgagagagaaggagatcaagagcacttgcaaggaggagcaaaggccaaggacagccaacaaggcccctgggagtaaaggcgtgaagcagaagtccccgcccgcggccgtggccgtggcggtgagcgcagccgccccgccacccgcagtgccctgtgcgcccgcggagaacgcgcccgcgcctgcccggaggtccgcgggcaagaagcccaccaggcgcaccgagaggacctcagccggggacggcgccaactgccaccggcccgaggagcccgcggccgcggacgcgctggggacgagcgtggtggtccccccggagcccaccaaaaccaggccctgtggcaacaacagagcgagccaccgcaaggagctgcgctcctccgtgacctgcgagaagcgccgcacgcgggggctaagcaggatcgtccccaaatccaaggagttcattgagacagagtcgtcatcttcatcctcctcctcggactccgacctggagtccgagcaggaggagtaccctctgtccaaagcacagaccgtggctgcctctgcctcctccgggaatgatcagaggctgaaggaggccgctgccaacgggggcagtggtcctagggcccctgtaggctccatcaacgccaggaccaccagtgacatcgccaaggagctggaggagcagttctacacactggtcccctttggccggaacgaacttctctcccctctaaaggacagtgatgagatcaggtctctctgggtcaaaatcgacctgaccctcctgtccaggatcccagaacacctgccccaggagccaggggtattgagcgcccctgccaccaaggactctgagagcgcaccgcccagccacacctcggacacacctgcagaaaaggctttgccaaaatccaagaggaaacgcaagtgtgacaacgaagacgactacagggagatcaagaagtcccagggagagaaagacagctcttcaagactggccacctccaccagtaatactttgtctgcaaaccactgcaacatgaacatcaacagtgtggcaataccaataaataaaaatgaaaaaatgcttcggtcgcccatctcacccctctctgatgcatctaaacacaaatacaccagcgaggacttaacttcttccagccgacctaatggcaacagtttgtttacttcagcctcttccagcaaaaagcctaaggccgacagccagctgcagcctcacggcggagacctcacgaaagcagctcacaacaattctgaaaacattcccctccacaagtcacggccgcagacgaagccgtggtctccaggctccaacggccacagggactgcaagaggcagaaacttgtcttcgatgatatgcctcgcagtgccgattattttatgcaagaagctaaacgaatgaagcataaagcagatgcaatggtggaaaagtttggaaaggctttgaactatgctgaagcagcattgtcgtttatcgagtgtggaaatgcaatggaacaaggccccatggaatccaaatctccttatacgatgtattcagaaacagtagagctcatcaggtatgctatgagactaaaaacccactcaggccccaatgccacaccagaagacaaacaactggctgcattatgttaccgatgcctggccctcctgtactggcggatgtttcgactcaaaagggaccacgctgtaaagtattcaaaagcactaatcgactatttcaagaactcatctaaagccgcccaagccccatctccgtggggggccagtggaaagagcactggaaccccatcccccatgtctcccaacccctctcccgccagctccgtggggtctcagggcagcctctccaacgccagcgccctgtccccgtcgaccatcgtcagcatcccacagcgcatccaccagatggcggccaaccacgtcagcatcaccaacagcatcctgcacagctacgactactgggagatggccgacaacctggccaaggaaaaccgagaattcttcaacgacctggatctgctcatggggccggtcaccctgcacagcagcatggagcacctggtccagtactcccaacagggcctgcactggctgcggaacagcgcccacctgtcatagggacctcaccctggggccagagtgggctctggtctccacagatggctcaacgtttttggacactgtgctactgaaactcccagccacagcatttatcagactgcggtgaacatttcctcagcattgaacaatgatcttttgcagggcatgtgtgtttgtatgtgtgggtatataagaagccgcctgtgtatgtgtgtaagatacacagctcttcagaacacaccttctttgtctagtttccataatcccaggctagacaaagtgatcagaggtttctgactagaggaagtacacacacacacacacacacacacacacaccgtacactcacacacaatcacagacacacactt

SEQ ID NO: 106058 - DNA, 9849 bp, Homo sapiens
  Payload ID: 789
  Gene Symbol: AFF3
  Gene Name: AF4/FMR2 family, member 3
  Uniprot ID: P51826
  ENST ID: ENST00000409236
  CDS Start-End: 114-3794
gagctcgctgctctctcttgagtgtgcctgcgcgcaagccggggagcggcgcgcgggcggcccgagcctcggcggcggcggtagcggcggcggcgacgctgacacctcccaccatggacagcttcgacttagccctgctccaggaatgggacctcgagtcactgtgtgtctatgaaccagatagaaatgcattacggaggaaagaacgagaaagaagaaatcaagaaactcaacaggatgatggcacgtttaattctagttactctctcttcagtgagccctacaagactaacaagggggatgaactctccaaccggatccagaacactttaggcaattatgatgaaatgaaagactttttaactgatagatccaatcagagtcatctcgttggagttcccaaacctggggttcctcagactcctgtgaacaagatcgatgaacattttgttgcagattcaagagcccagaaccagccctcgtctatctgtagcactacaacttccacaccagcagctgtccccgtgcagcagagtaagagaggcactatgggctggcagaaggctgggcacccaccctctgacggccaacagagagcaacacaacagggctctctcaggaccttgcttggagatggtgttggcagacagcagcctcgggccaaacaagtgtgcaatgtggaggtgggccttcagacccaggagaggccacctgccatggcggccaagcacagcagcagcggacactgtgttcagaactttcctccatccctagcttcaaaacccagcctggtccagcagaaaccgaccgcgtatgtgaggccaatggacggccaagatcaggcccctgatgagtctcctaagctgaagtcgtcttcggaaaccagcgtgcactgcacatcatacaggggagtccctgccagcaagccggagcctgccagagccaaggccaagctctccaagttcagcatccccaagcagggggaggagagtagatctggagaaaccaacagctgtgttgaagaaataatccgggagatgacctggcttccaccactttctgctattcaagcacctggcaaagtggaaccaaccaaatttccatttccaaataaggactctcagcttgtatcctctggacacaataatccaaagaaaggtgatgcagagccagagagtccagacaatggcacatcgaatacatcaatgctggaagatgaccttaagctaagcagtgatgaagaggagaatgaacagcaggcagctcagagaacggctctccgcgctctctctgacagcgccgtggtccagcagcccaactgcagaacctcggtgccttccagcaagggcagcagcagcagcagcagcagcggcagcagcagctcctccagcgactcagagagcagctccggatctgactcggagaccgagagcagctccagcgagagtgagggcagcaagcccccccacttctccagccccgaggctgaaccggcatcctctaacaagtggcagctggataaatggctaaacaaagttaatccccacaagcctcctattctgatccaaaatgaaagccacgggtcagagagcaatcagtactacaacccggtgaaagaggacgtccaggactgtgggaaagtccccgacgtttgccagcccagcctgagagagaaggagatcaagagcacttgcaaggaggagcaaaggccaaggacagccaacaaggcccctgggagtaaaggcgtgaagcagaagtccccgcccgcggccgtggccgtggcggtgagcgcagccgccccgccacccgcagtgccctgtgcgcccgcggagaacgcgcccgcgcctgcccggaggtccgcgggcaagaagcccaccaggcgcaccgagaggacctcagccggggacggcgccaactgccaccggcccgaggagcccgcggccgcggacgcgctggggacgagcgtggtggtccccccggagcccaccaaaaccaggccctgtggcaacaacagagcgagccaccgcaaggagctgcgctcctccgtgacctgcgagaagcgccgcacgcgggggctaagcaggatcgtccccaaatccaaggagttcattgagacagagtcgtcatcttcatcctcctcctcggactccgacctggagtccgagcaggaggagtaccctctgtccaaagcacagaccgtggctgcctctgcctcctccgggaatgatcagaggctgaaggaggccgctgccaacgggggcagtggtcctagggcccctgtaggctccatcaacgccaggaccaccagtgacatcgccaaggagctggaggagcagttctacacactggtcccctttggccggaacgaacttctctcccctctaaaggacagtgatgagatcaggtctctctgggtcaaaatcgacctgaccctcctgtccaggatcccagaacacctgccccaggagccaggggtattgagcgcccctgccaccaaggactctgagagcgcaccgcccagccacacctcggacacacctgcagaaaaggctttgccaaaatccaagaggaaacgcaagtgtgacaacgaagacgactacagggagatcaagaagtcccagggagagaaagacagctcttcaagactggccacctccaccagtaatactttgtctgcaaaccactgcaacatgaacatcaacagtgtggcaataccaataaataaaaatgaaaaaatgcttcggtcgcccatctcacccctctctgatgcatctaaacacaaatacaccagcgaggacttaacttcttccagccgacctaatggcaacagtttgtttacttcagcctcttccagcaaaaagcctaaggccgacagccagctgcagcctcacggcggagacctcacgaaagcagctcacaacaattctgaaaacattcccctccacaagtcacggccgcagacgaagccgtggtctccaggctccaacggccacagggactgcaagaggcagaaacttgtcttcgatgatatgcctcgcagtgccgattattttatgcaagaagctaaacgaatgaagcataaagcagatgcaatggtggaaaagtttggaaaggctttgaactatgctgaagcagcattgtcgtttatcgagtgtggaaatgcaatggaacaaggccccatggaatccaaatctccttatacgatgtattcagaaacagtagagctcatcaggtatgctatgagactaaaaacccactcaggccccaatgccacaccagaagacaaacaactggctgcattatgttaccgatgcctggccctcctgtactggcggatgtttcgactcaaaagggaccacgctgtaaagtattcaaaagcactaatcgactatttcaagaactcatctaaagccgcccaagccccatctccgtggggggccagtggaaagagcactggaaccccatcccccatgtctcccaacccctctcccgccagctccgtggggtctcagggcagcctctccaacgccagcgccctgtccccgtcgaccatcgtcagcatcccacagcgcatccaccagatggcggccaaccacgtcagcatcaccaacagcatcctgcacagctacgactactgggagatggccgacaacctggccaaggaaaaccgagaattcttcaacgacctggatctgctcatggggccggtcaccctgcacagcagcatggagcacctggtccagtactcccaacagggcctgcactggctgcggaacagcgcccacctgtcatagggacctcaccctggggccagagtgggctctggtctccacagatggctcaacgtttttggacactgtgctactgaaactcccagccacagcatttatcagactgcggtgaacatttcctcagcattgaacaatgatcttttgcagggcatgtgtgtttgtatgtgtgggtatataagaagccgcctgtgtatgtgtgtaagatacacagctcttcagaacacaccttctttgtctagtttccataatcccaggctagacaaagtgatcagaggtttctgactagaggaagtacacacacacacacacacacacacacacaccgtacactcacacacaatcacagacacacactttctattccattccagtgctaaaccgtgacttcttagaaaattcaaccaaaatctcatgggttagttaaccaggtgcaatacagcacaccaaaagcttgactgccagtgaagatggacctgctcttatactgttgattactttcagtattaatatactattccccaattattttttgattggtatgtattaatgggtaattgaataatgaaaataagccaggtatttttgtgccggaagtttactagattgcatgttaccaaataccctgctcttcctctaattcccttcccccatctgactctattatcaactaaatgcattccaggcaaacagatggacactcacagcccttcccagccccacctccaagtagtatgcaaatggcactgagatttagcaaaaacgcggcgtctttgaaagttaacagacactaaggtagcagtgcctgtgtgttggagctcagttaggagttgaagttttctgcacctgtgataacaagcccaccagccacatgcatttcttcttcctgccactgtgactcggtggctgtagagccacatggcatttgtcagccaatctgtttcaagtcttttctttccaccaatagctttcttacagattttcttggctaaatgaggccattacctagattgtcccttcagtaggagcctgaatccttcgcttaccaggctgagagctatttgccatgataatgctgattctctcactcctcatgcagaatgtgcacctgcagccctttgatgcgttttgatttgggggcgatttttcaggctttgattagcaggctgcttgcaatgcagaagatcacagttcctttctggggcagcagcaaccagagcctcttcctgtgtcctgtgtgtctggtatgtttacaccttgctctgagtttttctcttgttttctttttttaattaagtttacattttagtttctttgacatcttgtttacagtttttgtctgatgttttttcttttgtagtgtcttatgccctagatttagtcatcttgttaaatatatttggatatgaaatcttgacgaaaagaaaataactcctgaaaaagagggtctatcttgccacacgttaaaaacaaaaataatgtccttgtggcctcttacttgataaagttgcaccaggacggtctgagaaaggcaggcggtgtaatatgtggtgcaatccattttttcaaggtgatgacggcacaaaatacttagactagatgctgatccataaacattcactgatattcttacaggttggtttgcagtgttaacatttttgttagcctgatctgtaggtgggaagtaagatcatcataattccttagctctgagcactgattcaaaattgtataaatgactgaacaacttagatgatttgaaattaattgaaaataagaagggcttgtggaatttgcatttggctttggccttcaagcatttggaaatattaagagaatttccattttacatgtctccaactggggtgcttcttacaaccctttcactttttttttgagacgagtttcgctctgttgcccaggctggagtgcagtggcacgatctcggctcactgcatcctctgcctcctgggttcaagtgattgtcccgcctcagcctcccaagtagctgggattacaggtgtgcactaccatgcccagctaatttttgtgtttttagtagagactgggtttcaccatgttggccaggctcgtctcaaactcctgacctcaggtgatctacccgcctccacctcccaaagtgttgtgattacaggcgtgagccaccacacccagccctttcactaatttttggcagagttcacaatcccatcctatgtcagaaacttgaacctaacttaagaaattttgagtcatttttttggaggactgaggctttgttctacctactcttgaagaatcctgatgaaatattcaaacacataaagggatggccctggaggtctatcctgcatacctggagagcttctctggtcctgcccaccttgaaagttgcagactttgttgtaacatctatgtgatgagcttccctgtgaagccccatttgacaggtgggccagcagtgttttatcagcactctgatggcccacatttcccaggaaaacttcttgaaacttaccgttgtgggcagtggtcagagcgtgtagttcttatgactgtcttgtttcatctgtggagcacgtgtggagcacgttggtacagcagtttctgtggggtttggcatgggtgattttggttagtaaccatcctccaattgttgcttgtgaaagtcattcataacttgttccttttacttagttttgttgttactgctgttgttgttggtttggttggttttgagaccgggtctggctctgtagcccaagctggaatgcggtggcgcgatcatggctccctgcagcctcaaactcctgggctcaagcaatcctcctgcctcagcctcccaagcagctgggaagataggcacgtgccaccacacccggctaattttttctttattttttttgtagagatgggggtctcactatgttgcccaggctggtctcaaactcctgggctcaagcgatcctttggcctcggcctcccaaagtgcatgagccaccatgcctggcctgtttagttttgtttcaagttgaaatacctttcttgtgttttctaattagaaaagtaatatctactcattgtaaaaactcaaacagtgcagaaatgtagaaagtagaaagtgtaagtccctggttgtcccttctgcctgagacaaccactgctcacagtttgatgtatatccttccagagactctcaaatttaagcaaataatttttattaccatgtctttttatttgaagacgtacatttgcctccaaagttcaacacaagttcaactgaccatatccttccatgacctgaatagatgctatcctttatcacgatgttcaattgcctttgaaagagagtagtccaggtatattcctgatcaaaatttggcatttttgatgatactactctacacagatcagactcatgtgcagaatcgtgcctggagagagaggtttggttaagacagagatttctggaaacattcaaattgcaaatggaaacttgaaacccacaatctaatgaggaatgtactggaaaaataatctgaagagttgacaaattgtgtactagattgaacacatggaatgcaatgcaatgagactttctgcactaaaacttatcctcatatgtacaacaatgatgtgtgtattatataacagtgatgtgtacatttctgacaccccatacataatatacacagtttgtataaatgcatacatttaaaaatatatatgtacaatacagctaacataaaactgtagtacgcctgaaggatattactagtgcctaatattgagtatgagtcactgcgtgttcgcatcaacttggaagtgcagtaattgttataaaattaatcagtgcagccaacattatttatgaatcacatctttgaaactgtgcagtagcatatacatatatatttttaaataacatttttcacagttttccagagttactgttgaaatctgcatcaccaaaaaaaaaaaaaagcaagatttttttaacaatgtagacactcttcagacccagtaatctgcgtgtgatttcctatttgtagattcccaagagactttagcagtcaccagccttaatgcatgtacaggatattattgtgacttaatttatctgcagtttttaatccatgtgaaattggaatttataaacggacttggattaaacatgtctgcctttctaaggttgcaaatgttacattaaatgatttatgttgtaaatgagagaagttgagttgtacgtaaaagacatccaccaatttctgtgaatatttttacacggaaacttgagaatcaaaatacgttcaagtcagttgttctggctcccagtttataatctcgaaaagcaatctttttgtttcataaatggcttaaatgtagctcccacagattatcagtatgaagtctgacatttttcatggaaaagaagtatgtttttcttcattataactatagtttactatttgtctttgctatttcctgatacatacacatacgcacacacgcgcgcacatgcatgcacgtatgcacatgcacgctcccagtgtcccagtgaaggctcaacaggaagcttgagaaggtcatctcaatggccacagggttcctgttcaaccagtagccctgggatgccgctttgcttgtcattctttagtgtcacaagttagttccctgacttgtgtgcagtcagggaactgcacacaactgaaaccaacatggtggaatcatgtttgcaatatttggttgagtaaaataagataattttgaactaaagaagacggaggcattagaccagtggcttgacatgaagcatcccctatgtgggagggtaagtttgttaacttcatttttagtcttatctccaacccttttccttatcctcctccccaaactaaagaagcagaaacagcaacaaaagcaaaaccatcccttcacctgatccagcccatgtccttagattcaaatatcctttgtctttttcccattataccatctgacataactcactcgtgtctagagagaaaaatgcagaaagggtttgtttgcagatgggcagttcagttgagtcctcattaaccaggcagaggggtgcagaagaagcctgactcagggtcaccatggagaactcctcatcccagagatgggtgggacaggaacttggctttgcttcaccaaccactgagcttgatactctttcagaggtggtttgtgctaagaaacacccagcagtctttcaagaacgttctcttctgtagctttgcctgctacacagctgaagtctgtccctataagaattatatttgtaaaaagtaatacattttcgaagaaacccggatcaagtggaatcttgaaagtttttttaatgaaaggggaaaaacaacctgaccacataaactgcacttccaaccatttggaaccagagtttatgtcctcattttcccattctcagaagagcacagtttttcaatattacaacttcctggcaaatagcacaagaaatgttcagacttgagatttgtgttccctttgtccagattattctgtatatgtcaccaaaggggttaacttgtttgcttggcatgaggaaaattataaactccgttctcaaactaattacatctgcccacggttttggtttttattattttaattggcactccgaggcagcagggggtaaattttgtgttggctgcaaggggatttaggttcacagctcttactcacagtaatgggaatcaagggattaaatctctgtgtgttactttgaaaatccacctcttacagccaattttatagacattgatctgagggttgaattcagggcactaattgccagtcagtacaagggtcagcatttgtgttgaagcaccaggggtattgatgtagcctgaaaagctgaatcagggacttgggttttgttttgttttgttttttttacccatttttaaaataggaaagctcatccagaaatacttggatctagacatgatataacatagcaccaatgtttaggatttttagagtgctgttgggtaattaaaataatatcaatgttcta

SEQ ID NO: 106059 - DNA, 591 bp, Homo sapiens
  Payload ID: 789
  Gene Symbol: AFF3
  Gene Name: AF4/FMR2 family, member 3
  ENST ID: ENST00000440445
  CDS Start-End: 125-591
ggtgagaatccggagctgtggccaagaggtcaggagagtcagggggccttggaggggcttccggttctaggccaactgtggagaagcagaggtagggccctgatggagacatgcgcttctcagcatgtctaaaaaactgatcacctgcctttccagaccggagacgggcggcaagtttgaagtcgacacccagaggccagtttgtcccccttcccgcgcgcgggcggcccgagcctcggcggcggcggtagcggcggcggcgacgctgacacctcccaccatggacagcttcgacttagccctgctccaggaatgggacctcgagtcactgtggggtgaagacatcttaaaccagaggaatgactctctagttgtggaatttcagtcatcagccagcagatgcaggagtgtctatgaaccagatagaaatgcattacggaggaaagaacgagaaagaagaaatcaagaaactcaacaggatgatggcacgtttaattctagttactctctcttcagtgagccctacaagactaacaagggggatgaactctccaaccggatccagaacactttaggcaattatgatgaaat

SEQ ID NO: 106060 - DNA, 545 bp, Homo sapiens
  Payload ID: 789
  Gene Symbol: AFF3
  Gene Name: AF4/FMR2 family, member 3
  ENST ID: ENST00000416492
  CDS Start-End: 248-545
agaaagctcgccagcgagaagagagctccacgctcagcctcagaagaaagacgttcaacgacttactggggagagaaagaaaaggaacgggagctgagagaaagtttcacacatatgatttagaccttacgatcagccattgtttacatcgggaagcatcaatccggagtaactggcaagcagcgcgcgggcggcccgagcctcggcggcggcggtagcggcggcggcgacgctgacacctcccaccatggacagcttcgacttagccctgctccaggaatgggacctcgagtcactgtgtgtctatgaaccagatagaaatgcattacggaggaaagaacgagaaagaagaaatcaagaaactcaacaggatgatggcacgtttaattctagttactctctcttcagtgagccctacaagactaacaagggggatgaactctccaaccggatccagaacactttaggcaattatgatgaaatgaaagactttttaactgatagatccaatcagagtcatctcgttggagttcccaaacctgggg

SEQ ID NO: 106061 - DNA, 702 bp, Homo sapiens
  Payload ID: 789
  Gene Symbol: AFF3
  Gene Name: AF4/FMR2 family, member 3
  ENST ID: ENST00000423966
  CDS Start-End: 237-702
cgccagcgagaagagagctccacgctcagcctcagaagaaagacgttcaacgacttactggggagagaaagaaaaggaacgggagctgagagctgatcacctgcctttccagaccggagacgggcggcaagtttgaagtcgacacccagaggccagtttgtcccccttcccgcgcgcgggcggcccgagcctcggcggcggcggtagcggcggcggcgacgctgacacctcccaccatggacagcttcgacttagccctgctccaggaatgggacctcgagtcactgtgtgtctatgaaccagatagaaatgcattacggaggaaagaacgagaaagaagaaatcaagaaactcaacaggatgatggcacgtttaattctagttactctctcttcagtgagccctacaagactaacaagggggatgaactctccaaccggatccagaacactttaggcaattatgatgaaatgaaagactttttaactgatagatccaatcagagtcatctcgttggagttcccaaacctggggttcctcagactcctgtgaacaagatcgatgaacattttgttgcagattcaagagcccagaaccagccctcgtctatctgtagcactacaacttccacaccagcagctgtccccgtgcagcagagtaagagaggcactatgggctggcagaaggctgggcacccaccct

SEQ ID NO: 106062 - DNA, 543 bp, Homo sapiens
  Payload ID: 789
  Gene Symbol: AFF3
  Gene Name: AF4/FMR2 family, member 3
  ENST ID: ENST00000441400
  CDS Start-End: 158-543
aaaccgcaacggagagcaggtccgggtggaagaggtttcctccgcgccgccgctttatttcgctgaacttgcgggctccagagaccttaaacgcgcgcgggcggcccgagcctcggcggcggcggtagcggcggcggcgacgctgacacctcccaccatggacagcttcgacttagccctgctccaggaatgggacctcgagtcactgtgtgtctatgaaccagatagaaatgcattacggaggaaagaacgagaaagaagaaatcaagaaactcaacaggatgatggcacgtttaattctagttactctctcttcagtgagccctacaagactaacaagggggatgaactctccaaccggatccagaacactttaggcaattatgatgaaatgaaagactttttaactgatagatccaatcagagtcatctcgttggagttcccaaacctggggttcctcagactcctgtgaacaagatcgatgaacattttgttgcagattcaagagcccagaaccagccctcgtctatctgtagcactac

SEQ ID NO: 106063 - DNA, 559 bp, Homo sapiens
  Payload ID: 789
  Gene Symbol: AFF3
  Gene Name: AF4/FMR2 family, member 3
  ENST ID: ENST00000432037
  CDS Start-End: 77-559
ctttcgttgcagcgcgcgggcggcccgagcctcggcggcggcggtagcggcggcggcgacgctgacacctcccaccatggacagcttcgacttagccctgctccaggaatgggacctcgagtcactgtgtgtctatgaaccagatagaaatgcattacggaggaaagaacgagaaagaagaaatcaagaaactcaacaggatgatggcacgtttaattctagttactctctcttcagtgagccctacaagactaacaagggggatgaactctccaaccggatccagaacactttaggcaattatgatgaaatgaaagactttttaactgatagatccaatcagagtcatctcgttggagttcccaaacctggggttcctcagactcctgtgaacaagatcgatgaacattttgttgcagattcaagagcccagaaccagccctcgtctatctgtagcactacaacttccacaccagcagctgtccccgtgcagcagagtaagagaggcactatgggctggcagaaggctgggcacccaccctctgacggccaacagaga

SEQ ID NO: 106064 - DNA, 574 bp, Homo sapiens
  Payload ID: 789
  Gene Symbol: AFF3
  Gene Name: AF4/FMR2 family, member 3
  ENST ID: ENST00000415384
  CDS Start-End: 26-574
attcggaggtgggtgaggtgagaggatgactcttcggcttgacgctggagggatcccgtcacttgcacccagggtttacatttctggcagccccagtcagcggttcttgcccagaaaaaggaacaaaggggagagtgctggaagggactcccttttggcggggagtgcgaggtttggttcgcgtggtgaggcacaactgcagggctctgagctgctctctaggaattctggggaatccctggtgagaatccggagctgtggccaagagctgatcacctgcctttccagaccggagacgggcggcaagtttgaagtcgacacccagaggccagtttgtcccccttcccgcgcgcgggcggcccgagcctcggcggcggcggtagcggcggcggcgacgctgacacctcccaccatggacagcttcgacttagccctgctccaggaatgggacctcgagtcactgtggggtgaagacatcttaaaccagaggaatgactctctagttgtggaatttcagtcatcagccagcagatgcaggagtgtctatgaaccagatagaaatgcattacggagg

SEQ ID NO: 106065 - DNA, 551 bp, Homo sapiens
  Payload ID: 789
  Gene Symbol: AFF3
  Gene Name: AF4/FMR2 family, member 3
  ENST ID: ENST00000424600
  CDS Start-End: 210-551
aaacggtttgtttggggcgctgctgcgggcggcacagctcactctccccgcgcctgggcggccggggaattcccccgcacccacccgggtccgccgcccgcgggagcgcccagcagggtcaagtggattctgggccgcgggagaacgcgcgggcggcccgagcctcggcggcggcggtagcggcggcggcgacgctgacacctcccaccatggacagcttcgacttagccctgctccaggaatgggacctcgagtcactgtgtgtctatgaaccagatagaaatgcattacggaggaaagaacgagaaagaagaaatcaagaaactcaacaggatgatggcacgtttaattctagttactctctcttcagtgagccctacaagactaacaagggggatgaactctccaaccggatccagaacactttaggcaattatgatgaaatgaaagactttttaactgatagatccaatcagagtcatctcgttggagttcccaaacctggggttcctcagactcctgtgaacaagatcgatgaacattttgttgca

SEQ ID NO: 106066 - DNA, 730 bp, Homo sapiens
  Payload ID: 789
  Gene Symbol: AFF3
  Gene Name: AF4/FMR2 family, member 3
  ENST ID: ENST00000430789
  CDS Start-End: 1-538
agcttcaaaacccagcctggtccagcagaaaccgaccgcgtatgtgaggccaatggacggccaagatcaggcccctgatgagtctcctaagctgaagtcgtcttcggaaaccagcgtgcactgcacatcatacaggggagtccctgccagcaagccggagcctgccagagccaaggccaagctctccaagttcagcatccccaagcagggggaggagagtagatctggagaaaccaacagctgtgttgaagaaataatccgggagatgacctggcttccaccactttctgctattcaagcacctggcaaagtggaaccaaccaaatttccatttccaaataaggactctcagcttgtatcctctggacacaataatccaaagaaaggtgatgcagagccagagagtccagacaatggcacatcgaatacatcaatgctggaagatgaccttaagctaagcagtgatgaagaggagaatgaacagcaggcagctcagagaacggctctccgcgctctctctgacagccttagctggtagctgcttccttctgaaatgccctcctctgtctcagctccactgaccattgaaaccctgtgttctctgctacgtcacttcttctacaagacgtgccttgcttccccttcaccttccgccatgattgtaagtgtcctgaggcctccccagccatgtggaactgtgagtcaattaaatttgtttctttataaatta

SEQ ID NO: 106067 - DNA, 528 bp, Homo sapiens
  Payload ID: 789
  Gene Symbol: AFF3
  Gene Name: AF4/FMR2 family, member 3
  ENST ID: ENST00000427118
  CDS Start-End: 476-528
attcggaggtgggtgaggtgagaggatgactcttcggcttgacgctggagggatcccgtcacttgcacccagggtttacatttctggcagccccagtcagcggttcttgcccagaaaaaggaacaaaggggagagtgctggaagggactcccttttggcggggagtgcgaggtttggttcgcgtggtgaggcacaactgcagggctctgagctgctctctaggaattctggggaatccctggtgagaatccggagctgtggccaagaggtcaggagagtcagggggccttggaggggcttccggttctaggccaactgtggagaagcagagctgatcacctgcctttccagaccggagacgggcggcaagtttgaagtcgacacccagaggccagtttgtcccccttcccgcgcgcgggcggcccgagcctcggcggcggcggtagcggcggcggcgacgctgacacctcccaccatggacagcttcgacttagccctgctccaggaatgggacctcgagtcactgtg

SEQ ID NO: 106068 - DNA, 555 bp, Homo sapiens
  Payload ID: 789
  Gene Symbol: AFF3
  Gene Name: AF4/FMR2 family, member 3
  ENST ID: ENST00000445815
  CDS Start-End: 1-555
ggccacagggactgcaagaggcagaaacttgtcttcgatgatatgcctcgcagtgccgattattttatgcaagaagctaaacgaatgaagcataaagcagatgcaatggtggaaaagtttggaaaggctttgaactatgctgaagcagcattgtcgtttatcgagtgtggaaatgcaatggaacaaggccccatggaatccaaatctccttatacgatgtattcagaaacagtagagctcatcaggtatgctatgagactaaaaacccactcaggccccaatgccacaccagaagacaaacaactggctgcattatgttaccgatgcctggccctcctgtactggcggatgtttcgactcaaaagggaccacgctgtaaagtattcaaaagcactaatcgactatttcaagaactcatctaaagccgcccaagccccatctccgtggggggccagtggaaactccgtggggtctcagggcagcctctccaacgccagcgccctgtccccgtcgaccatcgtcagcatcccacagcgcatccaccagatggcggcc

SEQ ID NO: 106069 - DNA, 9552 bp, Homo sapiens
  Payload ID: 790
  Gene Symbol: AFF4
  Gene Name: AF4/FMR2 family, member 4
  Uniprot ID: Q9UHB7
  ENST ID: ENST00000265343
  CDS Start-End: 381-3872
gtcagtcacagccctggctgcaggagtccagctgccgtcgccgccgccagcggacggggcggggatcctggtgccaggtcttcgttaacccgcccccgccgcctcagtcagctgtcccagcccgggcccgaccgtcatggagcggtgcggggcctacgcctgttccgtgtgaggcgcatcgctgccgccgccgccgacgccgccttcgtttgtcgaggcctccggaacccccgccgcctcccggagcccctcgcccttggcagcctgtcaccgccccctgggcgggctcgaatgcgcgtccggtgaaggtgcaggcccggcgccgccactgccgcagccaggagatggttcgggcctagcggagccgggactggagcaacatgaaccgtgaagaccggaatgtgctgcgtatgaaagaacgggaaaggcggaatcaggaaattcagcagggcgaagacgccttcccacctagctctcctctctttgcagagccatacaaagttactagcaaagaagataagttatcaagtcgtattcagagtatgcttggaaactacgatgaaatgaaggatttcataggagacagatctataccaaagcttgttgcaattcccaagcctacagtaccaccatcagcagatgaaaaatctaacccaaatttctttgaacagagacatggaggctctcatcagagtagcaaatggactccagtaggacccgcacccagcacttctcagtctcagaaacggtcctcaggcttacagagtggacatagtagccagcggaccagcgcaggtagcagtagtggcactaacagtagtggtcagaggcacgaccgtgagtcatataacaatagtgggagcagtagccggaaaaaaggccagcatggatcagaacactccaaatcacgttcttccagccctggaaaaccccaggctgtttcttcattaaactctagtcattccaggtctcatgggaatgatcaccatagcaaggaacatcaacgctccaaatcacctcgggaccctgatgcaaactgggattctccttcccgtgtacctttttcaagtgggcagcactcaactcaatctttcccaccctcattgatgtcaaagtccaattcaatgttacagaaacccactgcctatgtgcggcccatggacggacaggagtccatggaaccaaagctgtcctctgagcactacagcagccaatcccatggcaacagcatgactgagctgaagcccagcagcaaagcacatctcaccaagctgaaaataccttcccaaccactggatgcatcagcttctggtgatgtgagctgtgtggatgaaatcctaaaagagatgacgcattcatggcctccccctctaacggctattcatacaccatgcaaaacagaaccttccaaatttccttttccaactaaggagtctcagcagtccaattttggcactggagaacaaaaaagatataatccttctaaaacttcaaatgggcaccagtctaaatctatgttaaaagatgacttaaaactaagcagcagtgaagacagtgatggggaacaggattgtgataagacaatgccgaggagtacaccaggaagtaactctgaaccttcacaccataatagtgaaggagcagataactccagggatgattctagtagccacagtggatctgaaagcagctctggatctgactcagagagtgaaagtagttccagtgacagtgaggcaaatgagccatcccagagtgcatctcccgagcctgaacccccgccaacaaacaaatggcaacttgataattggctgaataaagtgaacccacataaagtgtcacccgcctcttcagtggacagtaacatcccatcatctcaaggctacaaaaaggaaggccgagagcagggcactgggaatagctacactgatacaagtggacctaaagaaacgagttccgctactccgggacgagactccaaaaccatccaaaagggatcagaaagtgggcgtgggaggcagaaatctcctgcacagagtgacagcacaacacagagaagaactgtaggcaaaaaacaacccaaaaaggctgagaaggcagctgctgaagagcctcgtggaggcctgaagatagaaagtgaaacccctgtagacttggctagcagcatgccctccagcagacacaaagcagccaccaaaggctcaaggaaacccaatataaagaaggagtctaagtcttcccctcgacctacagcagagaaaaagaaatataagtcaacaagtaaatcttcccagaaatcaagggaaatcatagaaacagatacctcatcctcagattcagatgaaagtgagagccttcctccttcctcacaaactcctaagtaccccgagagcaataggactcctgttaaaccctcctcagtggaggaagaagatagcttttttcggcaacgaatgttctctcctatggaagagaaggaacttctttcacccctcagtgagcctgatgacaggtacccacttattgtgaagattgacctgaatcttttgactagaataccaggaaagccttacaaagaaacagagccgcccaagggggaaaagaaaaatgtgccagaaaagcacacgagagaggctcagaaacaagcctcagaaaaagtttccaacaaaggcaagaggaagcataagaatgaagatgataaccgagccagtgagagcaagaaacccaaaacggaggacaagaattcagcaggccataagccatccagcaacagagagtcatctaagcagagtgctgcaaaagaaaaggatttgttgccttctcccgctgggcctgttccttcaaaagatccaaaaacagagcatggctctcggaagaggactattagtcagtcttcttccttaaagtcaagcagtaacagcaacaaggagacgagtggcagcagcaaaaacagttcctccacatcaaagcagaagaagaccgaagggaagacttccagtagctccaaggaggttaaggaaaaggctccaagtagctcctctaactgtcctccatctgcaccaactcttgattcttctaagcctcggagaacaaagcttgtctttgatgacagaaattattcagcagaccattatttacaagaagcaaaaaagctaaagcacaatgcagatgcattgtctgataggtttgagaaagctgtatactatcttgatgctgtggtatctttcattgaatgtgggaatgcattagagaagaatgctcaggaatccaaatccccattccctatgtattcagagacggtggatctcatcaaatacactatgaagctaaagaattacttggcaccagatgctacagctgcagataaacgactcacagtactttgcctgcgatgcgagtctttgctgtacctgaggctgttcaaactgaagaaggaaaatgctctgaagtactcaaagacactgacagagcacctgaagaattcttataataattctcaagcaccatcgcctggcttgggaagcaaagctgtggggatgccttcccctgtttctccaaagctgtcaccaggcaattcaggaaattattcatctggggccagtagtgcttctgcaagtggttcttcagtgaccattccacagaagatccaccagatggcagccagctatgttcaggtcacatccaacttcctctatgccaccgaaatttgggaccaagctgaacagctttccaaagagcaaaaagaattctttgctgaactggataaagtaatgggccctctcatctttaatgcaagcatcatgacagatctagttcgttatacccggcagggactgcactggcttcgccaggatgccaagttgatatcttgaactgaacacattctcgttgcctctgattttctccacaacactgtgtcacatcacgaaggaaaactgccataacataccacctagtcgacactaagaatgaggaatagttttctcctcgttggttcatgtgttgttgtttttgataatccaaagcgatcatgtcagttggccctttaatatttccaatgtgaaagattatttaaatgcttttaaatctgcagcacattgataagatggtttccgtgagctatgataagattgaaattccagttgcaattcataactaatgaattgaaattttatttattttaatttttttaagttcccagattggggctagtttaagacttagttatttctgcctataaatttactctgttgaatatttagcataaatttaatgtagacatttttatttatataccttgggagctttattacctaatatctttttgtggtagctgttctaagagtaagaattggttcgtctaaaataaggacatattctttctacacctgctacctgacctgatatttgaaatcttaactccaattttattattgtggaatttacagttagtattaaggatattcttctacacatgaaaaaatcacttaaatatgagaaaatggcattctacatgtatgtactatgaaatgtgtctgatttggtatgcattatttcaaaaactgtgaatgtgtgttaataacactacagcaatcacacagtgactatagcttgcatttaatgcattacaaaagagggaggacaaactttctagaagaagcatttcatgttgaagggtttcataaaaggacaatcctgaacgttacggattttattaaaaccatatgttattttttgttgctaatcatttgacacttaatcgaaacagaataagttactgtggaaaaaaggatgatccaactcctgaggattgccgcctgtgtgtctttaattgattatctttgatagttagagttatttttcagatttttccccctcatactggattgtgatgctctgatatgagcatgcaatgactgatacagaaataggctggagcttcggtgtgtgcttttgctatacagcttacagttctaatgcctgatgtagagatgatgaatttctcctttttaaacctatcttctgtttactccttttgcattatgaaggccctcttcaatgatgtatgtttctgatggaatcagaaaatttcacactagaaaagtgtacctaacttgattcagtgtgagctcttgggacagggagtggagccaggggtagagcttaaagaagctggctctgtaagagttgtatatcaaagtaccttttgctacaaggtgcatatagaagtctaagataagaaatgtaccctctatactttatttttcatgcccctatcatgtttggtgtgccttaaatcttacctttaaatgaagactctatggattgtttacaaatgaagttttacactaggaccagatcgtccatacatgattggtcttctacaataataatgttcaattctttcattttaaatctttctttagggtcatataaagattagttctttcagaaaagctattgctttggtacatgacttagtctaaccagttgggtaatgctgctttgaaaaatagtttgtccctctccccattccaaaaatgaatccattcagtcagaaaaaaagattatcctactatttgtagatgattgctaaggcttgaaataggaaaggggaaagaagggatagaaaagtttcaagtccagtagtgcagtgaatcctttgtgtttgagacttttttacacttatttctgaagttagtgaactttcattgtccctgtggcctcatatttatagagcttcttaactgttttgtacctcagattgtttttagatgtcattgaagattgagatgtacaaattatgttgaatttaacctgtttctcttggagaaattgcctctgatatctttctaacttaatcttagtgtgttctaggaacagttttccataagaggacaacttctcaatgatcatgatagttatttagtaagaaataatggttgttaatcaaatacatgttatgtcttgtccttctctgatttttctgacttggattccttaatttgcagtgatgtcttagaaatggaaaaagtatcctctgggctttcagactttcagcaacaacagccagtgggatacctctgagttcttgtgttctagtctcttgtatgtcctgaaaggcagcaggagcatttttggggtcacactgatattttgttaaagcagagtttcctgcatggtttatggtgctgctctaatattttctctttaaaactgtgtcaatttttggagaatgaatttttcaaccttttcattgtggaggatttttcccacaaggtagtaatgggcaatggatcaaaatcctatcataaatgattgaattttcaatgtcatagtgtgtggaaatactactccctttcctccatgtctatcttcttagatgttctgtctttgtcatcatctgctccagcacatactttggactcctttacaggtgaccttcccccctccctcctcaataggtgtcctcagtgttttctaagcatttaaaactgaatttgacaagtggctaaaaacttagtctgagacttgtacttagtatatggttaattatagaaacaacaactattttaaacagttactctgttgactgctctttatgactacacttgtatgccaggaggcagcagcctatacaccattagactctttacaagcaaccaacgaaccaattgcagtggttgcagttgtcacagtagtcttgcctgggccagactgggctgggctgtgggaagcattccccttcaggggagtttccacagctcagcccaggctccagtctggctagagagcatccagcccattccttgcctcagtgccacctttttctgggcaagtagccaagaagtgactttatatgcagtgagtacttcagataaacttacagctacagctgccgaagagtggagaaggttgaccaccatttatttaattctctagtgtaaaaacaattgagagcagtgtgcgtgagcccacagacacctgtgtttctgggagctctggcagtggcggattcataggcacttgggctgcactttgaatgacacacttggctttattagattcactagtttttaaaaaattgttgttcgtttcttttcattaaaggtttaatcagacagatcagacagcataattttgtatttaatgacagaaacgttggtacatttcttcatgaatgagcttgcattctgaagcaagagcctacaaaaggcacttgttataaatgaaagttctggctctagaggccagtactctggagtttcagagcagccagtgattgttccagtcagtgatgcctagttatatagaggaggagtacactgtgcactcttctaggtgtaagggtatgcaactttggatcttaaaattctgtacacatacacactttatatatatgtatgtatgtatgaaaacatgaaattagtttgtcaaatatgtgtgtgtttagtattttagcttagtgcaactatttccacattatttattaaattgatctaagacactttcttgttgacaccttgaatattaatgttcaagggtgcaatgtgtattcctttagattgttaaagcttaattactatgatttgtagtaaattaacttttaaaatgtatttgagcccttctgtagtgtcgtagggctcttacagggtgggaaagattttaattttccagttgctaattgaacagtatggcctcattatatattttgatttataggagtttgtgtctgggtcccaggaacatctactggggatgactgttaggcagcttgtgatgatgttttttaaaaaacctaagtaacttggggagacagagcatttcaaacccatatagacacctatcatacctgtatatcccctaatacatggaacataaatttcatttcagctttatgcattaatgtattgaagaggcaggctttttttccagtaataatactgtacatctaaggttgctattcagtaaaactaatagaagagataattattgaataccttggaatatgtagtgagaagaggccaaatttttcatgtttgtgagcatgtctttcagatactcgctaatggagaaattcactttagacctctagaccccaaaaccaagttagcaagtgacaaaaagtaaattattaatagtctgtaaagtggatgctggtcttacaaagctcctattcacatgaaccctatggttaattagaaagaacttgctgtctccagaaaagggaatggaaataataactatgtatcttcttttcatgtaatttggtcacagaataaggtattcaagttaagtctaatccaagtcttagagatctttaagtatcctaaaatagcagcctaagtagtcatcatgtaaagaagttgactttcaggaatgtcagcattgacctctccttgccactgttactcagctaaacataacttgccattcttaaaaataaaaaagctcccacccagaaactctagtgatactcagttttgacctcttactgcttccatgtgggacttcttttcagcttttaaccattggaattttctacctgctatgttcctctctggaaaatatcaatttggaaatgctgcctttcaaatcaatgccatgatcatccatattgttgagtttgttgttggtgttccagaagtgtccccattttacaactttatgcacacacctggcaaatcattaacatgagcattcaacagtactgggatgggtggggtgggggtagggggctcaccaacagaactggccagttgacattgcctgaaaaggcaccacctttaagggccagttgtggggttggtaagcacagttatgaaaatttctatctagcctccgttttgaatggttttaagaaattttgtatatggaggatggaaatgcttatatatttattgaaaatccttttatttgaaattaaaattatttggtatataattgtttgatatttggggagggttttggaggggagataatgtcactgataaattaaaagcctgttgattttgcagaaaggtactgttagtgactgataaggatgcctttgttttgtacatgaaccaaatctttgttttacatttcttttatccaaaatatttaggcatctgacattttcaaccagaatttcaattatatactgtgatttttatttgttgcaatacattacaatttcagaggtactttggggctcaaaagctaggatttctaagtcagtatgtgcatttcacacgataaagctgttaatggtgagcaaagtattatatactaactagatttttccacatctgtatagtatattatatgtattttgtggtattgagagtatagaaagtttagagtgtcaaacatgcgtttaatgtgtatttttaaacaaatttatggcaattaaaatatttggagacaagggtatcacatttcaatttgtaaagatctttttaactctactgtgtcattaagatgctttgtacaatgccaaaccatagttggagaaactaagtttaataaatatcaaatagattttctgtattaaagttactgaacactgta

SEQ ID NO: 106070 - DNA, 3348 bp, Homo sapiens
  Payload ID: 790
  Gene Symbol: AFF4
  Gene Name: AF4/FMR2 family, member 4
  Uniprot ID: Q9UHB7
  ENST ID: ENST00000378595
  CDS Start-End: 365-3067
gctgcaggagtccagctgccgtcgccgccgccagcggacggggcggggatcctggtgccaggtcttcgttaacccgcccccgccgcctcagtcagctgtcccagcccgggcccgaccgtcatggagcggtgcggggcctacgcctgttccgtgtgaggcgcatcgctgccgccgccgccgacgccgccttcgtttgtcgaggcctccggaacccccgccgcctcccggagcccctcgcccttggcagcctgtcaccgccccctgggcgggctcgaatgcgcgtccggtgaaggtgcaggcccggcgccgccactgccgcagccaggagatggttcgggcctagcggagccgggactggagcaacatgaaccgtgaagaccggaatgtgctgcgtatgaaagaacgggaaaggcggaatcaggaaattcagcagggcgaagacgccttcccacctagctctcctctctttgcagagccatacaaagttactagcaaagaagataagttatcaagtcgtattcagagtatgcttggaaactacgatgaaatgaaggatttcataggagacagatctataccaaagcttgttgcaattcccaagcctacagtaccaccatcagcagatgaaaaatctaacccaaatttctttgaacagagacatggaggctctcatcagagtagcaaatggactccagtaggacccgcacccagcacttctcagtctcagaaacggtcctcaggcttacagagtggacatagtagccagcggaccagcgcaggtagcagtagtggcactaacagtagtggtcagaggcacgaccgtgagtcatataacaatagtgggagcagtagccggaaaaaaggccagcatggatcagaacactccaaatcacgttcttccagccctggaaaaccccaggctgtttcttcattaaactctagtcattccaggtctcatgggaatgatcaccatagcaaggaacatcaacgctccaaatcacctcgggaccctgatgcaaactgggattctccttcccgtgtacctttttcaagtgggcagcactcaactcaatctttcccaccctcattgatgtcaaagtccaattcaatgttacagaaacccactgcctatgtgcggcccatggacggacaggagtccatggaaccaaagctgtcctctgagcactacagcagccaatcccatggcaacagcatgactgagctgaagcccagcagcaaagcacatctcaccaagctgaaaataccttcccaaccactggatgcatcagcttctggtgatgtgagctgtgtggatgaaatcctaaaagagatgacgcattcatggcctccccctctaacggctattcatacaccatgcaaaacagaaccttccaaatttccttttccaactaaggagtctcagcagtccaattttggcactggagaacaaaaaagatataatccttctaaaacttcaaatgggcaccagtctaaatctatgttaaaagatgacttaaaactaagcagcagtgaagacagtgatggggaacaggattgtgataagacaatgccgaggagtacaccaggaagtaactctgaaccttcacaccataatagtgaaggagcagataactccagggatgattctagtagccacagtggatctgaaagcagctctggatctgactcagagagtgaaagtagttccagtgacagtgaggcaaatgagccatcccagagtgcatctcccgagcctgaacccccgccaacaaacaaatggcaacttgataattggctgaataaagtgaacccacataaagtgtcacccgcctcttcagtggacagtaacatcccatcatctcaaggctacaaaaaggaaggccgagagcagggcactgggaatagctacactgatacaagtggacctaaagaaacgagttccgctactccgggacgagactccaaaaccatccaaaagggatcagaaagtgggcgtgggaggcagaaatctcctgcacagagtgacagcacaacacagagaagaactgtaggcaaaaaacaacccaaaaaggctgagaaggcagctgctgaagagcctcgtggaggcctgaagatagaaagtgaaacccctgtagacttggctagcagcatgccctccagcagacacaaagcagccaccaaaggctcaaggaaacccaatataaagaaggagtctaagtcttcccctcgacctacagcagagaaaaagaaatataagtcaacaagtaaatcttcccagaaatcaagggaaatcatagaaacagatacctcatcctcagattcagatgaaagtgagagccttcctccttcctcacaaactcctaagtaccccgagagcaataggactcctgttaaaccctcctcagtggaggaagaagatagcttttttcggcaacgaatgttctctcctatggaagagaaggaacttctttcacccctcagtgagcctgatgacaggtacccacttattgtgaagattgacctgaatcttttgactagaataccaggaaagccttacaaagaaacagagccgcccaagggggaaaagaaaaatgtgccagaaaagcacacgagagaggctcagaaacaagcctcagaaaaagtttccaacaaaggcaagaggaagcataagaatgaagatgataaccgagccagtgagagcaagaaacccaaaacggaggacaagaattcagcaggccataagccatccagcaacagagagtcatctaagcagagtgctgcaaaagaaaaggatttgttgccttctcccgctgggcctgttccttcaaaagatccaaaaacagagcatggctctcggaagaggactattagtcagtcttcttccttaaagtcaagcagtaacagcaacaaggagacgagtggcagcagcaaaaacagttcctccacatcaaagcagaagaagaccgaagggaagacttccagtagctccaaggaggttaaggtaaagtgttgggggcctggggcttttgaaaatcattcaacttgccatgtgacttttccagggtgacactgtgctttgaaattattgtaacatctcagtaaatatataggcctatgtcttttaccctctatatgtaataatcctgataaatgaatacagtgatataagactgtgaaggtggtaagtcagctggtcacatacatattgaaagaaaaacccttgggtacagtggctcatacctgtagtcccagctatttgggaggctaagatggaaggatcatttgaggaatttgagtccagcctgggcaatgtggtgagaccctgtctgtaaaagaactttaaaattt

SEQ ID NO: 106071 - DNA, 541 bp, Homo sapiens
  Payload ID: 790
  Gene Symbol: AFF4
  Gene Name: AF4/FMR2 family, member 4
  ENST ID: ENST00000421773
  CDS Start-End: 97-541
ggaatctagagcaacagcaaagctgaggtcaaactaccgtaaggatggacaccaaggaagctgtgtttgggacaaaaagaaatcaagataagcaacatgaaccgtgaagaccggaatgtgctgcgtatgaaagaacgggaaaggcggaatcaggaaattcagcagggcgaagacgccttcccacctagctctcctctctttgcagagccatacaaagttactagcaaagaagataagttatcaagtcgtattcagagtatgcttggaaactacgatgaaatgaaggatttcataggagacagatctataccaaagcttgttgcaattcccaagcctacagtaccaccatcagcagatgaaaaatctaacccaaatttctttgaacagagacatggaggctctcatcagagtagcaaatggactccagtaggacccgcacccagcacttctcagtctcagaaacggtcctcaggcttacagagtggacatagtagccagcggaccagcgcaggtagcagtagtggcactaacagtagtggtc

SEQ ID NO: 106072 - DNA, 513 bp, Homo sapiens
  Payload ID: 790
  Gene Symbol: AFF4
  Gene Name: AF4/FMR2 family, member 4
  ENST ID: ENST00000425658
  CDS Start-End: 1-513
gcagccaatcccatggcaacagcatgactgagctgaagcccagcagcaaagcacatctcaccaagctgaaaataccttcccaaccactggatgcatcagcttctggtgatgtgagctgtgtggatgaaatcctaaaagagtctcagcagtccaattttggcactggagaacaaaaaagatataatccttctaaaacttcaaatgggcaccagtctaaatctatgttaaaagatgacttaaaactaagcagcagtgaagacagtgatggggaacaggattgtgataagacaatgccgaggagtacaccaggaagtaactctgaaccttcacaccataatagtgaaggagcagataactccagggatgattctagtagccacagtggatctgaaagcagctctggatctgactcagagagtgaaagtagttccagtgacagtgaggcaaatgagccatcccagagtgcatctcccgagcctgaacccccgccaacaaacaaatggcaacttgata

SEQ ID NO: 106073 - DNA, 2059 bp, Homo sapiens
  Payload ID: 791
  Gene Symbol: AFM
  Gene Name: afamin
  Uniprot ID: P43652
  ENST ID: ENST00000226355
  CDS Start-End: 94-1893
gttacttttttactgataatgtgaaagaatgatataaaaacttgattttcctcaacaacattactttcttttgtaaatgtggtttctacaaagatgaaactactaaaacttacaggttttatttttttcttgttttttttgactgaatccctaaccctgcccacacaacctcgggatatagagaacttcaatagtactcaaaaatttatagaagataatattgaatacatcaccatcattgcatttgctcagtatgttcaggaagcaacctttgaagaaatggaaaagctggtgaaagacatggtagaatacaaagacagatgtatggctgacaagacgctcccagagtgttcaaaattacctaataatgttttacaggaaaaaatatgtgctatggaggggctgccacaaaagcataatttctcacactgctgcagtaaggttgatgctcaaagaagactctgtttcttctataacaagaaatctgatgtgggatttctgcctcctttccctaccctggatcccgaagagaaatgccaggcttatgaaagtaacagagaatcccttttaaatcactttttatatgaagttgccagaaggaacccatttgtcttcgcccctacacttctaactgttgctgttcattttgaggaggtggccaaatcatgttgtgaagaacaaaacaaagtcaactgccttcaaacaagggcaatacctgtcacacaatatttaaaagcattttcttcttatcaaaaacatgtctgtggggcacttttgaaatttggaaccaaagttgtacactttatatatattgcgatactcagtcaaaaattccccaagattgaatttaaggagcttatttctcttgtagaagatgtttcttccaactatgatggatgctgtgaaggggatgttgtgcagtgcatccgtgacacgagcaaggttatgaaccatatttgttcaaaacaagattctatctccagcaaaatcaaagagtgctgtgaaaagaaaataccagagcgcggccagtgcataattaactcaaacaaagatgatagaccaaaggatttatctctaagagaaggaaaatttactgacagtgaaaatgtgtgtcaagaacgagatgctgacccagacaccttctttgcgaagtttacttttgaatactcaaggagacatccagacctgtctataccagagcttttaagaattgttcaaatatacaaagatctcctgagaaattgctgcaacacagaaaaccctccaggttgttaccgttacgcggaagacaaattcaatgagacaactgagaaaagcctcaagatggtacaacaagaatgtaaacatttccagaatttggggaaggatggtttgaaataccattacctcatcaggctcacgaagatagctccccaactctccactgaagaactggtgtctcttggcgagaaaatggtgacagctttcactacttgctgtacgctaagtgaagagtttgcctgtgttgataatttggcagatttagtttttggagagttatgtggagtaaatgaaaatcgaactatcaaccctgctgtggaccactgctgtaaaacaaactttgccttcagaaggccctgctttgagagtttgaaagctgataaaacatatgtgcctccacctttctctcaagatttatttacctttcacgcagacatgtgtcaatctcagaatgaggagcttcagaggaagacagacaggtttcttgtcaacttagtgaagctgaagcatgaactcacagatgaagagctgcagtctttgtttacaaatttcgcaaatgtagtggataagtgctgcaaagcagagagtcctgaagtctgctttaatgaagagagtccaaaaattggcaactgaagccagctgctggagatatgtaaagaaaaaagcaccaaagggaaggcttcctatctgtgtggtgatgaatcgcatttcctgagaacaaaataaaaggatttttctgtaactgtcacctgaaataatacattgcagcaagcaataaacacaacattttgtaaagtta

SEQ ID NO: 106074 - DNA, 3247 bp, Homo sapiens
  Payload ID: 792
  Gene Symbol: AFG3L2
  Gene Name: AFG3-like AAA ATPase 2
  Uniprot ID: Q9Y4W6
  ENST ID: ENST00000269143
  CDS Start-End: 233-2626
gcactggcggaggtcgcggcgggcctcggagaggagacgccgacgtcagcgcgccggggcggggctggcggcaggagacgccgcgttgagagcttgggctcctccgtgagccgccggcgcgcttcgctgcctggcggcctttccccgagccgagcccgcttcccgaggccgccagtcgtcgcctgcccgcgcctgcgcagcgtcccgggccgagagggccacggcggcggccatggcgcaccgctgtttgcggctgtggggccggggcggctgctggccccgcggcctacagcagctcctcgtgcctggcggcgtgggcccgggcgagcagccctgcctccggacgctttaccgatttgttacaactcaagcaagggccagcagaaattctcttttgacagatataattgctgcttatcaaagattctgttctcgacccccaaaaggatttgaaaaatactttcctaatggaaaaaatggaaaaaaagctagtgaacctaaagaagttatgggagagaaaaaagaatcaaagccagctgctaccacacgctcttctggaggaggaggtggtggcggtggaaaacgaggtggcaagaaagatgattctcactggtggtccaggtttcagaagggtgacattccatgggacgacaaggatttcaggatgttcttcctctggactgctctgttctggggtggagtcatgttttacttgctgctcaagagatccgggagagaaatcacttggaaggactttgtcaataactatctttcaaaaggagtagtagacagattggaagtcgtcaacaagcgttttgttcgagtgacctttacaccaggaaaaactcctgttgatgggcaatacgtttggtttaatattggcagtgtggacacctttgaacggaatctggaaactttacagcaggaattgggcatagaaggagaaaatcgggtgcctgttgtctacattgctgaaagtgatggctcttttctgctgagcatgctgcctacggtgctcatcatcgccttcttgctctacaccatcagaagagggcctgctggcattggccggacaggccgagggatgggcggactcttcagtgtcggagaaaccactgccaaggtcttaaaggatgaaattgatgtgaagttcaaagatgtggctggctgtgaggaggccaagctagagatcatggaatttgtgaatttcttgaaaaacccaaagcagtatcaagacctaggagcaaaaatcccaaagggtgccattctcactggtcctccaggcactgggaagacgctgctagctaaggccacagccggagaagccaatgtccccttcatcaccgttagtggatctgagtttttggagatgttcgttggtgtgggccctgctagagtccgagacttatttgcccttgctcggaagaatgccccttgcatcctcttcatcgatgaaatcgatgcggtgggaaggaagagaggaagaggcaactttggagggcagagtgagcaggagaacacactcaaccagctgctggtggagatggatggttttaatacaacaacaaatgtcgtcattttggccggcaccaatcgaccagatatcctggaccccgcgctgcttaggccggggcgtttcgacaggcagatctttattggaccaccagacataaaaggaagagcttctattttcaaagttcatctccgaccgctaaaactggacagtaccctggagaaggataaattggcaagaaaactggcatctttaactccagggttttcaggtgctgatgttgctaatgtctgtaatgaagctgcgttgattgctgcaaggcatctgtcagattccataaatcagaaacactttgaacaggcaattgaacgagtgattggtggcttagagaagaaaacgcaggttctgcagcctgaggagaagaagactgtggcataccacgaagcaggccatgcggttgccggctggtatctggagcacgcagacccgcttttaaaggtatccatcatcccacgtggcaaaggactaggttatgctcagtatttaccaaaagaacaatacctctataccaaagagcagctcttggataggatgtgtatgactttaggtggtcgagtctctgaagaaatcttctttggaagaattacaactggtgctcaagatgacttgagaaaagtaactcagagtgcatatgcccaaattgttcagtttggcatgaatgaaaaggttgggcaaatctcctttgacctcccacgtcagggggacatggtattggagaaaccttacagtgaagccactgcaagattgatagatgatgaagtacgaatacttattaatgatgcttataaaagaacagtagctcttctcacagaaaagaaagctgacgtggagaaggttgctcttctgttgttagaaaaagaagtattagataagaatgatatggttgaacttttgggccccagaccatttgcggaaaaatctacctatgaagaatttgtggaaggcactggcagcttggatgaggacacctcacttccagaaggccttaaggactggaacaaggagcgggaaaaggagaaagaggagcccccgggtgagaaagttgccaactagaggcccagagggaggccatctcagtctgtccactgtggtttcagctggtgcattatttcagctgtggctttcagaagaatgggaatgctgcgctgattttagccagccactggcccagctgaaatgatggggaaaggagtccttagtcctttcagcctcagaggtcacagtgggtggcaggtgactttccggaggccttgagggaaatgcacactgtcccatagcctcattgggctcccagacgtgctggaaaggttgagcccagagtggccgaggctggaccctgtggcaccaagtggggtcggctgaccgtgtggcagggatcgttgcactggactcttggcgtgtgggaagggatgctttctctttgtcgcccactcttcattcctgtttctcctcagttcccctgtgcagatgggctgtgaaattaaattggagtcttgataagaacattttaatttgacttaatattttaaagattgaatccagatcacttgttgctgtcttaatggaatggttttctacaggagctgtaacatacttaaaaatatgaatgtattatgtaaatatggcttctttacataaaaaataaaatgtcaacactgtacttttctgaacaca

SEQ ID NO: 106075 - DNA, 627 bp, Homo sapiens
  Payload ID: 792
  Gene Symbol: AFG3L2
  Gene Name: AFG3-like AAA ATPase 2
  ENST ID: ENST00000590811
  CDS Start-End: 1-627
cgtgggcccgggcgagcagccctgcctccggacgggtgacattccatgggacgacaaggatttcaggatgttcttcctctggactgctctgttctggggtggagtcatgttttacttgctgctcaagagatccgggagagaaatcacttggaaggactttgtcaataactatctttcaaaaggagtagtagacagattggaagtcgtcaacaagcgttttgttcgagtgacctttacaccaggaaaaactcctgttgatgggcaatacgtttggtttaatattggcagtgtggacacctttgaacggaatctggaaactttacagcaggaattgggcatagaaggagaaaatcgggtgcctgttgtctacattgctgaaagtgatggctcttttctgctgagcatgctgcctacggtgctcatcatcgccttcttgctctacaccatcagaagagggcctgctggcattggccggacaggccgagggatgggcggactcttcagtgtcggagaaaccactgccaaggtcttaaaggatgaaattgatgtgaagttcaaagatgtggctggctgtgaggaggccaagctagagatcatggaatttgtgaatttcttgaaaaacccaaa

SEQ ID NO: 106076 - DNA, 4113 bp, Homo sapiens
  Payload ID: 793
  Gene Symbol: AFTPH
  Gene Name: aftiphilin
  Uniprot ID: Q6ULP2
  ENST ID: ENST00000238855
  CDS Start-End: 341-3151
gtgtcggcggcagcggttcccccgctgcatgatgggagagtgtgtggagtgggcggggggtctccgcggaggaggtggaggaggcggcggcggcggcggaagagggcggagggtagtgggatgggggtcccgcggcagcggtgaaactccgggtgggcgtccatggtgctgctgcgctgacagggctgtgagcagccggccttccgctctcaccagttccgcgtcggaatagacggtccttccccggggagtcagttcctccccgggcccctgagccatgcccatcgcagccgccccgaaggagccaggtgtaaattaattatttgaaagcaactgaacaatggagccagacatcattcgaatgtactcttcatccccaccaccattagacaatggagcagaggatgatgatgatgatgaatttggggaatttggtgggttttcagaagttagcccttctggtgtagggtttgttgatttcgatacaccagattatactcgtcccaaggaagagtttgtaccttcaaaccattttatgccaattcatgaattctcagaaaatgtagatagccttacaagctttaagtccattaaaaatggtaatgataaggacatcactgctgaactttctgctcctgtgaaaggacagtctgatgttttactttctaccaccagcaaagaaataatttcatctgaaatgttagctacttccattgatggcatggaaagaccaggaaatttaaataaagtagtggagcagagacagaatgttggaacacttgaaagtttctctccaggagattttagaactaatatgaatgttgttcatcaaaacaagcagttagagagctgcaatggtgaaaagcctccttgtctggagattctaacaaatgggtttgcagtgttggaaactgtaaatcctcagggaacagatgatctggacaatgtagctgattcaaagggacggaagcctcttagcactcatagcactgagtataatttagactctgtacctagtcctgctgaggaatttgcagattttgccacattttccaaaaaggaaaggatacaattagaagaaatagaatgtgcagttttaaatgatagagaagcactaaccattcgggaaaacaataaaattaatagagtcaatgaactgaattctgtaaaagaagtggctttgggtagaagcttggataacaaaggagacactgatggagaggatcaggtttgtgtttcagaaataagcatagtgactaacagaggtttcagtgttgaaaaacaaggccttccaacactgcaacaggatgaatttttacagtcaggtgttcagtcaaaggcttggagtttggtagactcagctgataattcagaagccattaggagagaacaatgtaaaactgaagaaaaacttgacttacttacttctaaatgtgctcacctatgcatggattctgttaaaacttctgatgatgaagttggttctcccaaagaagaaagtagaaagtttactaatttccaaagcccaaacattgaccccacagaagaaaatgatttggatgattctttaagtgtaaaaaatggtgatagtagtaatgactttgtgacttgcaatgatatcaatgaagatgattttggtgattttggtgactttggctctgccagtggctcaactccaccttttgttactggtactcaagattcaatgagtgatgccacttttgaagagtcttcagagcactttccacattttagtgaaccaggtgatgactttggagaatttggggatataaatgctgtttcttgccaagaggagacaatattaacaaagtcagacctaaaacagacttctgataatttatcagaagaatgtcaattggcaagaaaatctagtggaacaggcactgaacctgttgcaaaacttaaaaatgggcaagaaggtgagattggacattttgattctgtgccaaatattcaggatgactgcaatggttttcaagactctgatgattttgcagacttcagttcagctggtcctagccaagttgtagattggaatgcttttgaggatgaacaaaaagatagttgttcttgggctgcttttggagaccagcaggctactgaatctcatcatcgaaaggaagcctggcagtcacataggacagatgaaaatattgatactccaggaacccccaaaacgcacagtgtaccttcagcaacttccaaaggagcagttgctagtggccatttacaggaatcagccacttcagttcagacagctttattaaaccgcctggagcgaattttcgaagcatgttttccttccatacttgtccctgatgctgaagaggaagttacttccctgaagcacttgctggaaacaagcactttgccaataaaaacgagagaggccttacctgaaagtggggaattgctagatgtgtggactgagctacaggatatccatgatgcacatggcttgagataccagtggggcggctcccatagcaacaagaagcttttgtcctccttgggaatagacacccgaaacattctcttcacgggcaataagaagcagcctgttatagtgcccatgtatgcagcaggattgggtatgttagagcccaccaaggaaccactgaaaccactttctgctgcagaaaaaatagcttccatcggtcagacagccaccatgtcaccagatatgaacacatgtacatctgatcagttccaggagtctctaccacccgtccagtttgactggagtagcagtggccttactaaccctttagatgctagtggaggttccactcttctgaaccttgatttctttgggcccgtggatgacagtagctctagcagcagcaccacaatcccaggtgtggatccggagttgtatgagttaacaacttctaagctggaaatctccacctcaagcctcaaagtgactgatgcatttgcaagactcatgtctacagtagagaagacaagcacatctaccaggaaaccgaaaagagaagagcacctaagtgaagaagctatcaaggtgatcgctggccttcctgacttaacattcatgcatgccaaggtgttgatgttcccagccacgttaacaccttccacaagctctcaagaaaaagcagacggataactgatgtgaattggacagtttctattgcttttccttttttccatcccttccctaccatcaaaagcatacctgctctaattaaaaaaaaaaaaaaaaaaaattcaagttcagctgatttgttggtaagccgcactagaaaggtatacatagtaatgtatatttatttacatactgaagtcctaaatttatattagaaaaatgtaaataatcgggggtaaacatttttgaagatttattctttttgtgttgctggggtgtatacatttatgtctttgtgaaatacactggtggtgtccttcttacaaaacttttgaaataaaaaaaaaactcaaatcttcactgtctgtgaaatccccttcagtcttttcagattgcattgactgtcctcttgatttttcatattacatgtcaaattacttttgctatcataaataagctccaaagtcccccatttaatttttttttaattttgtgtatgatgggtttcagatctggcttttgttaacattttggggcttttttaatcttttcaatctggcgtattgctgtttgaccttttgcaaggtacttaattgctcttttgttatagggtatggatcattgtcagaacttgattggaggggtttaaagagattgtgtctgtttaaaatcagtatgattcagagaaggaccaaattatatgaatgtcttacaatggaatttacttgttactgatttttttgttctattgtaccactattttttgaggattttgcacagtgtaaaatgacataatcatagattgctatggtttaggctgtatatacagtgaaaactatgggttttaaatgtttggggaaattcctatggaaaaaagagagacatgtagaagaacctctaacaaggttaatgtgcatgcccaaggtcttttgaaatttcagtgtgtaaatttccttttagcttatacaaaaataaaataattt

SEQ ID NO: 106077 - DNA, 4040 bp, Homo sapiens
  Payload ID: 793
  Gene Symbol: AFTPH
  Gene Name: aftiphilin
  Uniprot ID: Q6ULP2
  ENST ID: ENST00000238856
  CDS Start-End: 341-3070
gtgtcggcggcagcggttcccccgctgcatgatgggagagtgtgtggagtgggcggggggtctccgcggaggaggtggaggaggcggcggcggcggcggaagagggcggagggtagtgggatgggggtcccgcggcagcggtgaaactccgggtgggcgtccatggtgctgctgcgctgacagggctgtgagcagccggccttccgctctcaccagttccgcgtcggaatagacggtccttccccggggagtcagttcctccccgggcccctgagccatgcccatcgcagccgccccgaaggagccaggtgtaaattaattatttgaaagcaactgaacaatggagccagacatcattcgaatgtactcttcatccccaccaccattagacaatggagcagaggatgatgatgatgatgaatttggggaatttggtgggttttcagaagttagcccttctggtgtagggtttgttgatttcgatacaccagattatactcgtcccaaggaagagtttgtaccttcaaaccattttatgccaattcatgaattctcagaaaatgtagatagccttacaagctttaagtccattaaaaatggtaatgataaggacatcactgctgaactttctgctcctgtgaaaggacagtctgatgttttactttctaccaccagcaaagaaataatttcatctgaaatgttagctacttccattgatggcatggaaagaccaggaaatttaaataaagtagtggagcagagacagaatgttggaacacttgaaagtttctctccaggagattttagaactaatatgaatgttgttcatcaaaacaagcagttagagagctgcaatggtgaaaagcctccttgtctggagattctaacaaatgggtttgcagtgttggaaactgtaaatcctcagggaacagatgatctggacaatgtagctgattcaaagggacggaagcctcttagcactcatagcactgagtataatttagactctgtacctagtcctgctgaggaatttgcagattttgccacattttccaaaaaggaaaggatacaattagaagaaatagaatgtgcagttttaaatgatagagaagcactaaccattcgggaaaacaataaaattaatagagtcaatgaactgaattctgtaaaagaagtggctttgggtagaagcttggataacaaaggagacactgatggagaggatcaggtttgtgtttcagaaataagcatagtgactaacagaggtttcagtgttgaaaaacaaggccttccaacactgcaacaggatgaatttttacagtcaggtgttcagtcaaaggcttggagtttggtagactcagctgataattcagaagccattaggagagaacaatgtaaaactgaagaaaaacttgacttacttacttctaaatgtgctcacctatgcatggattctgttaaaacttctgatgatgaagttggttctcccaaagaagaaagtagaaagtttactaatttccaaagcccaaacattgaccccacagaagaaaatgatttggatgattctttaagtgtaaaaaatggtgatagtagtaatgactttgtgacttgcaatgatatcaatgaagatgattttggtgattttggtgactttggctctgccagtggctcaactccaccttttgttactggtactcaagattcaatgagtgatgccacttttgaagagtcttcagagcactttccacattttagtgaaccaggtgatgactttggagaatttggggatataaatgctgtttcttgccaagaggagacaatattaacaaagtcagacctaaaacagacttctgataatttatcagaagaatgtcaattggcaagaaaatctagtggaacaggcactgaacctgttgcaaaacttaaaaatgggcaagaaggtgagattggacattttgattctgtgccaaatattcaggatgactgcaatggttttcaagactctgatgattttgcagacttcagttcagctggtcctagccaagttgtagattggaatgcttttgaggatgaacaaaaagatagttgttcttgggctgcttttggagaccagcaggctactgaatctcatcatcgaaaggaagcctggcagtcacataggacagatgaaaatattgatactccaggaacccccaaaacgcacagtgtaccttcagcaacttccaaaggagcagttgctagtggccatttacaggaatcagccacttcagttcagacagctttattaaaccgcctggagcgaattttcgaagcatgttttccttccatacttgtccctgatgctgaagaggaagttacttccctgaagcacttgctggaaacaagcactttgccaataaaaacgagagaggccttacctgaaagtggggaattgctagatgtgtggactgagctacaggatatccatgatgcacatggcttgagataccagtggggcggctcccatagcaacaagaagcttttgtcctccttgggaatagacacccgaaacattctcttcacgggcaataagaagcagcctgttatagtgcccatgtatgcagcaggattgggtatgttagagcccaccaaggaaccactgaaaccactttctgctgcagaaaaaatagcttccatcggtcagacagccaccatgtcaccagatatgaacacatgtacatctgatcagttccaggagtctctaccacccgtccagtttgactggagtagcagtggccttactaaccctttagatggtgtggatccggagttgtatgagttaacaacttctaagctggaaatctccacctcaagcctcaaagtgactgatgcatttgcaagactcatgtctacagtagagaagacaagcacatctaccagtaggaaaccgaaaagagaagagcacctaagtgaagaagctatcaaggtgatcgctggccttcctgacttaacattcatgcatgccaaggtgttgatgttcccagccacgttaacaccttccacaagctctcaagaaaaagcagacggataactgatgtgaattggacagtttctattgcttttccttttttccatcccttccctaccatcaaaagcatacctgctctaattaaaaaaaaaaaaaaaaaaaattcaagttcagctgatttgttggtaagccgcactagaaaggtatacatagtaatgtatatttatttacatactgaagtcctaaatttatattagaaaaatgtaaataatcgggggtaaacatttttgaagatttattctttttgtgttgctggggtgtatacatttatgtctttgtgaaatacactggtggtgtccttcttacaaaacttttgaaataaaaaaaaaactcaaatcttcactgtctgtgaaatccccttcagtcttttcagattgcattgactgtcctcttgatttttcatattacatgtcaaattacttttgctatcataaataagctccaaagtcccccatttaatttttttttaattttgtgtatgatgggtttcagatctggcttttgttaacattttggggcttttttaatcttttcaatctggcgtattgctgtttgaccttttgcaaggtacttaattgctcttttgttatagggtatggatcattgtcagaacttgattggaggggtttaaagagattgtgtctgtttaaaatcagtatgattcagagaaggaccaaattatatgaatgtcttacaatggaatttacttgttactgatttttttgttctattgtaccactattttttgaggattttgcacagtgtaaaatgacataatcatagattgctatggtttaggctgtatatacagtgaaaactatgggttttaaatgtttggggaaattcctatggaaaaaagagagacatgtagaagaacctctaacaaggttaatgtgcatgcccaaggtcttttgaaatttcagtgtgtaaatttccttttagcttatacaaaaataaaataatttaaaagaaa

SEQ ID NO: 106078 - DNA, 1874 bp, Homo sapiens
  Payload ID: 793
  Gene Symbol: AFTPH
  Gene Name: aftiphilin
  ENST ID: ENST00000409183
  CDS Start-End: 1-1777
cattaggagagaacaatgtaaaactgaagaaaaacttgacttacttacttctaaatgtgctcacctatgcatggattctgttaaaacttctgatgatgaagttggttctcccaaagaagaaagtagaaagtttactaatttccaaagcccaaacattgaccccacagaagaaaatgatttggatgattctttaagtgtaaaaaatggtgatagtagtaatgactttgtgacttgcaatgatatcaatgaagatgattttggtgattttggtgactttggctctgccagtggctcaactccaccttttgttactggtactcaagattcaatgagtgatgccacttttgaagagtcttcagagcactttccacattttagtgaaccaggtgatgactttggagaatttggggatataaatgctgtttcttgccaagaggagacaatattaacaaagtcagacctaaaacagacttctgataatttatcagaagaatgtcaattggcaagaaaatctagtggaacaggcactgaacctgttgcaaaacttaaaaatgggcaagaaggtgagattggacattttgattctgtgccaaatattcaggatgactgcaatggttttcaagactctgatgattttgcagacttcagttcagctggtcctagccaagttgtagattggaatgcttttgaggatgaacaaaaagatagttgttcttgggctgcttttggagaccagcaggctactgaatctcatcatcgaaaggaagcctggcagtcacataggacagatgaaaatattgatactccaggaacccccaaaacgcacagtgtaccttcagcaacttccaaaggagcagttgctagtggccatttacaggaatcagccacttcagttcagacagctttattaaaccgcctggagcgaattttcgaagcatgttttccttccatacttgtccctgatgctgaagaggaagttacttccctgaagcacttgctggaaacaagcactttgccaataaaaacgagagaggccttacctgaaagtggggaattgctagatgtgtggactgagctacaggatatccatgatgcacatggcttgagataccagtggggcggctcccatagcaacaagaagcttttgtcctccttgggaatagacacccgaaacattctcttcacgggcaataagaagcagcctgttatagtgcccatgtatgcagcaggattgggtatgttagagcccaccaaggaaccactgaaaccactttctgctgcagaaaaaatagcttccatcggtcagacagccaccatgtcaccagatatgaacacatgtacatctgatcagttccaggagtctctaccacccgtccagtttgactggagtagcagtggccttactaaccctttagatgctagtggaggttccactcttctgaaccttgatttctttgggcccgtggatgacagtagctctagcagcagcaccacaatcccaggtgtggatccggagttgtatgagttaacaacttctaagctggaaatctccacctcaagcctcaaagtgactgatgcatttgcaagactcatgtctacagtagagaagacaagcacatctaccagtaggaaaccgaaaagagaagagcacctaagtgaagaagctatcaaggtgatcgctggccttcctgacttaacattcatgcatgccaaggtgttgatgttcccagccacgttaacaccttccacaagctctcaagaaaaagcagacggataactgatgtgaattggacagtttctattgcttttccttttttccatcccttccctaccatcaaaagcatacctgctctaattaaaaaaaaaaaaaaaaa

SEQ ID NO: 106079 - DNA, 2811 bp, Homo sapiens
  Payload ID: 793
  Gene Symbol: AFTPH
  Gene Name: aftiphilin
  Uniprot ID: Q6ULP2
  ENST ID: ENST00000409933
  CDS Start-End: 1-2811
atggagccagacatcattcgaatgtactcttcatccccaccaccattagacaatggagcagaggatgatgatgatgatgaatttggggaatttggtgggttttcagaagttagcccttctggtgtagggtttgttgatttcgatacaccagattatactcgtcccaaggaagagtttgtaccttcaaaccattttatgccaattcatgaattctcagaaaatgtagatagccttacaagctttaagtccattaaaaatggtaatgataaggacatcactgctgaactttctgctcctgtgaaaggacagtctgatgttttactttctaccaccagcaaagaaataatttcatctgaaatgttagctacttccattgatggcatggaaagaccaggaaatttaaataaagtagtggagcagagacagaatgttggaacacttgaaagtttctctccaggagattttagaactaatatgaatgttgttcatcaaaacaagcagttagagagctgcaatggtgaaaagcctccttgtctggagattctaacaaatgggtttgcagtgttggaaactgtaaatcctcagggaacagatgatctggacaatgtagctgattcaaagggacggaagcctcttagcactcatagcactgagtataatttagactctgtacctagtcctgctgaggaatttgcagattttgccacattttccaaaaaggaaaggatacaattagaagaaatagaatgtgcagttttaaatgatagagaagcactaaccattcgggaaaacaataaaattaatagagtcaatgaactgaattctgtaaaagaagtggctttgggtagaagcttggataacaaaggagacactgatggagaggatcaggtttgtgtttcagaaataagcatagtgactaacagaggtttcagtgttgaaaaacaaggccttccaacactgcaacaggatgaatttttacagtcaggtgttcagtcaaaggcttggagtttggtagactcagctgataattcagaagccattaggagagaacaatgtaaaactgaagaaaaacttgacttacttacttctaaatgtgctcacctatgcatggattctgttaaaacttctgatgatgaagttggttctcccaaagaagaaagtagaaagtttactaatttccaaagcccaaacattgaccccacagaagaaaatgatttggatgattctttaagtgtaaaaaatggtgatagtagtaatgactttgtgacttgcaatgatatcaatgaagatgattttggtgattttggtgactttggctctgccagtggctcaactccaccttttgttactggtactcaagattcaatgagtgatgccacttttgaagagtcttcagagcactttccacattttagtgaaccaggtgatgactttggagaatttggggatataaatgctgtttcttgccaagaggagacaatattaacaaagtcagacctaaaacagacttctgataatttatcagaagaatgtcaattggcaagaaaatctagtggaacaggcactgaacctgttgcaaaacttaaaaatgggcaagaaggtgagattggacattttgattctgtgccaaatattcaggatgactgcaatggttttcaagactctgatgattttgcagacttcagttcagctggtcctagccaagttgtagattggaatgcttttgaggatgaacaaaaagatagttgttcttgggctgcttttggagaccagcaggctactgaatctcatcatcgaaaggaagcctggcagtcacataggacagatgaaaatattgatactccaggaacccccaaaacgcacagtgtaccttcagcaacttccaaaggagcagttgctagtggccatttacaggaatcagccacttcagttcagacagctttattaaaccgcctggagcgaattttcgaagcatgttttccttccatacttgtccctgatgctgaagaggaagttacttccctgaagcacttgctggaaacaagcactttgccaataaaaacgagagaggccttacctgaaagtggggaattgctagatgtgtggactgagctacaggatatccatgatgcacatggcttgagataccagtggggcggctcccatagcaacaagaagcttttgtcctccttgggaatagacacccgaaacattctcttcacgggcaataagaagcagcctgttatagtgcccatgtatgcagcaggattgggtatgttagagcccaccaaggaaccactgaaaccactttctgctgcagaaaaaatagcttccatcggtcagacagccaccatgtcaccagatatgaacacatgtacatctgatcagttccaggagtctctaccacccgtccagtttgactggagtagcagtggccttactaaccctttagatgctagtggaggttccactcttctgaaccttgatttctttgggcccgtggatgacagtagctctagcagcagcaccacaatcccaggtgtggatccggagttgtatgagttaacaacttctaagctggaaatctccacctcaagcctcaaagtgactgatgcatttgcaagactcatgtctacagtagagaagacaagcacatctaccaggaaaccgaaaagagaagagcacctaagtgaagaagctatcaaggtgatcgctggccttcctgacttaacattcatgcatgccaaggtgttgatgttcccagccacgttaacaccttccacaagctctcaagaaaaagcagacggataa

SEQ ID NO: 106080 - DNA, 1525 bp, Homo sapiens
  Payload ID: 793
  Gene Symbol: AFTPH
  Gene Name: aftiphilin
  ENST ID: ENST00000422803
  CDS Start-End: 86-502
caacaagaagcttttgtcctccttgggaatagacacccgaaacattctcttcacgggcaataagaagcagcctgttatagtgcccatgtatgcagcaggattgggtatgttagagcccaccaaggaaccactgaaaccactttctgctgcagaaaaaatagcttccatcggtcagacagccaccatgtcaccagatatgaacacatgtacatctgatcagttccaggagtctctaccacccgtccagtttgactggagtagcagtggccttactaaccctttagatggtgtggatccggagttgtatgagttaacaacttctaagctggaaatctccacctcaagcctcaaagtgactgatgcatttgcaagactcatgtctacagtagagaagacaagcacatctaccaggaaaccgaaaagagaagagcacctaagtgaagaagctatcaaggtgatcgctggccttcctgacttaacattcatgcatgccaaggtgtgatgttcccagccacgttaacaccttccacaagctctcaagaaaaagcagacggataactgatgtgaattggacagtttctattgcttttccttttttccatcccttccctaccatcaaaagcatacctgctctaattaaaaaaaaaaaaaaaaaaaattcaagttcagctgatttgttggtaagccgcactagaaaggtatacatagtaatgtatatttatttacatactgaagtcctaaatttatattagaaaaatgtaaataatcgggggtaaacatttttgaagatttattctttttgtgttgctggggtgtatacatttatgtctttgtgaaatacactggtggtgtccttcttacaaaacttttgaaataaaaaaaaaactcaaatcttcactgtctgtgaaatccccttcagtcttttcagattgcattgactgtcctcttgatttttcatattacatgtcaaattacttttgctatcataaataagctccaaagtcccccatttaatttttttttaattttgtgtatgatgggtttcagatctggcttttgttaacattttggggcttttttaatcttttcaatctggcgtattgctgtttgaccttttgcaaggtacttaattgctcttttgttatagggtatggatcattgtcagaacttgattggaggggtttaaagagattgtgtctgtttaaaatcagtatgattcagagaaggaccaaattatatgaatgtcttacaatggaatttacttgttactgatttttttgttctattgtaccactattttttgaggattttgcacagtgtaaaatgacataatcatagattgctatggtttaggctgtatatacagtgaaaactatgggttttaaatgtttggggaaattcctatggaaaaaagagagacatgtagaagaacctctaacaaggttaatgtgcatgcccaaggtcttttgaaatttcagtgtgtaaatttccttttagcttatacaaaaataaaataatttaaaag

SEQ ID NO: 106081 - DNA, 793 bp, Homo sapiens
  Payload ID: 793
  Gene Symbol: AFTPH
  Gene Name: aftiphilin
  ENST ID: ENST00000487769
  CDS Start-End: 1-684
tttccacattttagtgaaccaggtgatgactttggagaatttggggatataaatgctgtttcttgccaagaggagacaatattaacaaagtcagacctaaaacagacttctgataatttatcagaagaatgtcaattggcaagaaaatctagtggaacaggcactgaacctgttgcaaaacttaaaaatgggcaagaaggtgagattggacattttgattctgtgccaaatattcaggatgactgcaatggttttcaagactctgatgattttgcagacttcagttcagctggtcctagccaagttgtagattggaatgcttttgaggatgaacaaaaagatagttgttcttgggctgcttttggagaccagcaggctactgaatctcatcatcgaaaggaagcctggcagtcacataggacagatgaaaatattgatactccaggaacccccaaaacgcacagtgtaccttcagcaacttccaaaggagcagttgctagtggccatttacaggaatcagccacttcagttcagggtatgttagagcccaccaaggaaccactgaaaccactttctgctgcagaaaaaatagcttccatcggtcagacagccaccatgtcaccagatatgaacacatgtacatctgatcagttccaggtgtggatccggagttgtatgagttaacaacttctaagctggaaatctccacctcaagcctcaaagtgactgatgcatttgcaagactcatgtctacagtagagaagacaagcacatctaccagtaggaaaccgaa

SEQ ID NO: 106082 - DNA, 818 bp, Homo sapiens
  Payload ID: 794
  Gene Symbol: ARMS2
  Gene Name: age-related maculopathy susceptibility 2
  Uniprot ID: P0C7Q2
  ENST ID: ENST00000528446
  CDS Start-End: 76-399
ctggctgagtgagatggcagctggcttggcaaggggacagcacctttgtcaccacattatgtccctgtaccctacatgctgcgcctatacccaggaccgatggtaactgaggcggaggggaaaggagggcctgagatggcaagtctgtcctcctcggtggttcctgtgtccttcatttccactctgcgagagtctgtgctggaccctggagttggtggagaaggagccagtgacaagcagaggagcaaactgtctttatcacactccatgatcccagctgctaaaatccacactgagctctgcttaccagccttcttctctcctgctggaacccagaggaggttccagcagcctcagcaccacctgacactgtctatcatccacactgcagcaaggtgattctgccaaaacatatctccttaaaagccaactggagcttctcatcagcatcaatgtgaagccaaaaatccttaggaggacagagggagtccctcacaacctagactggtccccttccctccagctgcctcaactgtccacaggactctcttcccacctgcggccacactgtgcaacctggaatttccccacctgggcggactcatcacgtcatcaccaattggatgcatcttctgctctgtgcagctggtgaaatctttctcaacccttgagatgcagcccaatcttctcctaacatctggattcctctctgtcactgcattccctcctgtcatcctgcctttgttttcttgccctcctttctctcccgggtgataggcattaactaaaattaaataaaaattcagatcatccttgca

SEQ ID NO: 106083 - DNA, 7526 bp, Homo sapiens
  Payload ID: 795
  Gene Symbol: ACAN
  Gene Name: aggrecan
  ENST ID: ENST00000352105
  CDS Start-End: 59-7354
gccaggtgtgtgggactgaagttcttggagaagggagtccaactcttcaaggtgaactatgaccactttactctgggttttcgtgactctgagggtcatcactgcagctgtcactgtagaaacttcagaccatgacaactcgctgagtgtcagcatcccccaaccgtccccgctgagggtcctcctggggacctccctcaccatcccctgctatttcatcgaccccatgcaccctgtgaccaccgccccttctaccgccccactggccccaagaatcaagtggagccgtgtgtccaaggagaaggaggtagtgctgctggtggccactgaagggcgcgtgcgggtcaacagtgcctatcaggacaaggtctcactgcccaactacccggccatccccagtgacgccaccttggaagtccagagcctgcgctccaatgactctggggtctaccgctgcgaggtgatgcatggcatcgaggacagcgaggccaccctggaagtcgtggtgaaaggcatcgtgttccattacagagccatctctacacgctacaccctcgactttgacagggcgcagcgggcctgcctgcagaacagtgccatcattgccacgcctgagcagctgcaggccgcctacgaagacggcttccaccagtgtgacgccggctggctggctgaccagactgtcagataccccatccacactccccgggaaggctgctatggagacaaggatgagtttcctggtgtgaggacgtatggcatccgagacaccaacgagacctatgatgtgtactgcttcgccgaggagatggagggtgaggtcttttatgcaacatctccagagaagttcaccttccaggaagcagccaatgagtgccggcggctgggtgcccggctggccaccacgggccagctctacctggcctggcaggctggcatggacatgtgcagcgccggctggctggccgaccgcagcgtgcgctaccccatctccaaggcccggcccaactgcggtggcaacctcctgggcgtgaggaccgtctacgtgcatgccaaccagacgggctaccccgacccctcatcccgctacgacgccatctgctacacaggtgaagactttgtggacatcccagaaaacttctttggagtggggggtgaggaggacatcaccgtccagacagtgacctggcctgacatggagctgccactgcctcgaaacatcactgagggtgaagcccgaggcagcgtgatccttaccgtaaagcccatcttcgaggtctcccccagtcccctggaacccgaggagcccttcacgtttgcccctgaaataggggccactgccttcgctgaggttgagaatgagactggagaggccaccaggccctggggctttcccacacctggcctgggccctgccacggcattcaccagtgaggacctcgtcgtgcaggtgaccgctgtccctgggcagccgcatttgccagggggggtcgtcttccactaccgcccgggacccacccgctactcgctgacctttgaggaggcacagcaggcctgcctgcgcacgggggcggtcattgcctcgccggagcagctccaggccgcctacgaagcaggctatgagcagtgtgacgccggctggctgcgggaccagaccgtcagataccccattgtgagcccccggaccccatgcgtgggtgacaaggacagcagcccaggggtcaggacctatggcgtgcgcccatcaacagagacctacgatgtctactgctttgtagacagacttgagggggaggtgttcttcgccacacgccttgagcagttcaccttccaggaagcactggagttctgtgaatctcacaatgctacgctggccaccacgggccagctctacgccgcctggagccgcggcctggacaagtgctatgccggctggctggccgacggcagcctccgctaccccatcgtcaccccaaggcctgcctgcggtggggacaagccaggcgtgagaacggtctacctctaccctaaccagacgggcctcccagacccactgtcccggcaccatgccttctgcttccgaggcatttcagcggttccttctccaggagaagaagagggtggcacacccacatcaccctctggtgtggaggagtggatcgtgacccaagtggttcctggtgtggctgctgtccccgtagaagaggagacaactgctgtaccctcaggggagactactgccatcctagagttcaccaccgagccagaaaaccagacagaatgggaaccagcctataccccagtgggcacatccccgctgccagggatccttcctacttggcctcccactggcgcagcaacagaggaaagtacagaaggcccttctgcaactgaagtgccctctgcctcagaggaaccatccccctcagaggtgccattcccctcagaggagccatccccctcagaggaaccattcccctcagtgaggccattcccctcagtggagctgttcccctcagaggagccattcccctccaaggagccatccccctcagaggaaccatcagcctcggaagagccgtatacaccttcaccccccgtgcccagctggactgagctgcccagctctggggaggaatctggggcccctgatgtcagtggtgacttcacaggcagtggagatgtttcaggacaccttgacttcagtgggcagctgtcaggggacagggcaagtggactgccctctggagacctggactccagtggtcttacttccacagtgggctcaggcctgcctgtggaaagtggactaccctcaggggatgaagagagaattgagtggcccagcactcctacggttggtgaactgccctctggagctgagatcctagagggctctgcctctggagttggggatctcagtggacttccttctggagaagttctagagacctctgcctctggagtaggagacctcagtgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactactgcccctggagtagaggagatcagcgggcttccttctggagaagttctagagactactgcccctggagtagatgagatcagtgggcttccttctggagaagttctagagactactgcccctggagtagaggagatcagcgggcttccttctggagaagttctagagacttctacctctgcggtaggggacctcagtggacttccttctggaggagaagttctagagatttctgtctctggagtagaggacatcagtgggcttccttctggagaggttgtagagacttctgcctctggaatagaggatgtcagtgaacttccttcaggagaaggtctagagacctctgcttctggagtagaggacctcagcaggctcccttctggagaagaagttctagagatttctgcctctggatttggggacctcagtggacttccttctggaggagaaggtctagagacctctgcttctgaagtagggactgacctcagtgggcttccttctggaagggagggtctagagacttcagcttctggagctgaggacctcagtgggttgccttctggaaaagaagacttggtggggtcagcttctggagacttggacttgggcaaactgccttctggaactctaggaagtgggcaagctccagaaacaagtggtcttccctctggatttagtggtgagtattctggggtggaccttggaagtggcccaccctctggcctgcctgactttagtggacttccatctggattcccaactgtttccctagtggattctacattggtggaagtggtcacagcctccactgcaagtgaactggaagggaggggaaccattggcatcagtggtgcaggagaaatatctggactgccctccagtgagctggacattagtgggagagctagtggactcccttcaggaactgaactcagtggccaagcatctgggtctcctgatgtcagtggggaaatacctggactctttggtgtcagtggacagccatcagggtttcctgacactagtggggaaacatctggagtgactgagcttagcgggctgtcctctggacaaccaggtattagtggagaagcatctggagttctttatggcactagtcaaccctttggcataactgatctgagtggagaaacatctggggtccctgatctcagtgggcagccttcagggttaccagggttcagtggggcaacatcaggagtccctgacctggtttctggtaccacgagtggcagcggtgaatcttctgggattacatttgtggacaccagtttggttgaagtggcccctactacatttaaagaagaagaaggcttagggtctgtggaactcagtggcctcccttccggagaggcagatctgtcaggcaaatctgggatggtggatgtcagtggacagttttctggaacagtcgattccagtgggtttacatcccagactccggaattcagtggcctaccaagtggcatagctgaggtcagtggagaatcctccagagctgagattgggagcagcctgccctcgggagcatattatggcagtggaactccatctagtttccccactgtctctcttgtagacagaactttggtggaatctgtaacccaggctccaacagcccaagaggcaggagaagggccttctggcattttagaactcagtggtgctcattctggagcaccagacatgtctggggagcattctggatttctggacctaagtgggctgcagtccgggctgatagagcccagcggagagccaccaggtactccatattttagtggggattttgccagcaccaccaatgtaagtggagaatcctctgtagccatgggcaccagtggagaggcctcaggacttccagaagttactttaatcacttctgagttcgtggagggtgttactgaaccaactatttctcaggaactaggccaaaggccccctgtgacacacacaccccagctttttgagtccagtggaaaagtctccacagctggggacattagtggagctaccccagtgctccctgggtctggagtagaagtatcatcagtcccagaatctagcagtgagacgtccgcctatcctgaagctgggttcggggcatctgccgcccctgaggccagcagagaagattctgggtcccctgatctgagtgaaaccacctctgcattccacgaagctaaccttgagagatcctctggcctaggagtgagcggcagcactttgacatttcaagaaggcgaggcgtccgctgccccagaagtgagtggagaatccaccaccaccagtgatgtggggacagaggcaccaggcttgccttcagccactcccacggcttctggagacaggactgaaatcagcggagacctgtctggtcacacctcgcagctgggcgttgtcatcagcaccagcatcccagagtctgagtggacccagcagacccagcgccctgcagagacgcatctagaaattgagtcctcaagcctcctgtactcaggagaagagactcacacagtcgaaacagccacctccccaacagatgcttccatcccagcttctccggaatggaaacgtgaatcagaatcaactgctgcagaccaggaggtatgtgaggagggctggaacaagtaccagggccactgttaccgccacttcccggaccgcgagacctgggtggatgctgagcgccggtgtcgggagcagcagtcacacctgagcagcatcgtcacccccgaggagcaggagtttgtcaacaacaatgcccaagactaccagtggatcggcctgaacgacaggaccatcgaaggggacttccgctggtcagatggacaccccatgcaatttgagaactggcgccccaaccagcctgacaacttttttgccgctggagaggactgtgtggtgatgatctggcacgagaagggcgagtggaatgatgttccctgcaattaccacctccccttcacgtgtaaaaagggcacagccaccacctacaaacgcagactacagaagcggagctcacggcaccctcggaggagccgccccagcacagcccactgagaagagcttccaggacgcacccaggacgctgagcccaggagcctgccaggctgacgtgcatcccacccagacggtgtcctcttcttgtcgctttttgtcatataaggaatcccattaaagaaggaaaaaaataaatcccacatttgtgtatgcacccactcacccctccaaa

SEQ ID NO: 106084 - DNA, 8840 bp, Homo sapiens
  Payload ID: 795
  Gene Symbol: ACAN
  Gene Name: aggrecan
  ENST ID: ENST00000439576
  CDS Start-End: 375-7967
cacctacctccccgccgctccagagggggctcgcagagctgaggacgcgcgcagcgctgctcaaggtctctctctctcagcaccctcgccggccggcgtctgacgcgggtgccagggtctccgggcacctttcagtgtccattccctcagccagccaggactccgcaacccagcagttgccgctgcggccacagcccgaggggacctgcggacaggacgccggcaggaggaggggtgcgcagcgcccgcgcagagcgtctccctcgctacgcagcgagacccgggcctcccggccccaggagcccccagctgcctcgccaggtgtgtgggactgaagttcttggagaagggagtccaactcttcaaggtgaactatgaccactttactctgggttttcgtgactctgagggtcatcactgcagctgtcactgtagaaacttcagaccatgacaactcgctgagtgtcagcatcccccaaccgtccccgctgagggtcctcctggggacctccctcaccatcccctgctatttcatcgaccccatgcaccctgtgaccaccgccccttctaccgccccactggccccaagaatcaagtggagccgtgtgtccaaggagaaggaggtagtgctgctggtggccactgaagggcgcgtgcgggtcaacagtgcctatcaggacaaggtctcactgcccaactacccggccatccccagtgacgccaccttggaagtccagagcctgcgctccaatgactctggggtctaccgctgcgaggtgatgcatggcatcgaggacagcgaggccaccctggaagtcgtggtgaaaggcatcgtgttccattacagagccatctctacacgctacaccctcgactttgacagggcgcagcgggcctgcctgcagaacagtgccatcattgccacgcctgagcagctgcaggccgcctacgaagacggcttccaccagtgtgacgccggctggctggctgaccagactgtcagataccccatccacactccccgggaaggctgctatggagacaaggatgagtttcctggtgtgaggacgtatggcatccgagacaccaacgagacctatgatgtgtactgcttcgccgaggagatggagggtgaggtcttttatgcaacatctccagagaagttcaccttccaggaagcagccaatgagtgccggcggctgggtgcccggctggccaccacgggccagctctacctggcctggcaggctggcatggacatgtgcagcgccggctggctggccgaccgcagcgtgcgctaccccatctccaaggcccggcccaactgcggtggcaacctcctgggcgtgaggaccgtctacgtgcatgccaaccagacgggctaccccgacccctcatcccgctacgacgccatctgctacacaggtgaagactttgtggacatcccagaaaacttctttggagtggggggtgaggaggacatcaccgtccagacagtgacctggcctgacatggagctgccactgcctcgaaacatcactgagggtgaagcccgaggcagcgtgatccttaccgtaaagcccatcttcgaggtctcccccagtcccctggaacccgaggagcccttcacgtttgcccctgaaataggggccactgccttcgctgaggttgagaatgagactggagaggccaccaggccctggggctttcccacacctggcctgggccctgccacggcattcaccagtgaggacctcgtcgtgcaggtgaccgctgtccctgggcagccgcatttgccagggggggtcgtcttccactaccgcccgggacccacccgctactcgctgacctttgaggaggcacagcaggcctgcctgcgcacgggggcggtcattgcctcgccggagcagctccaggccgcctacgaagcaggctatgagcagtgtgacgccggctggctgcgggaccagaccgtcagataccccattgtgagcccccggaccccatgcgtgggtgacaaggacagcagcccaggggtcaggacctatggcgtgcgcccatcaacagagacctacgatgtctactgctttgtagacagacttgagggggaggtgttcttcgccacacgccttgagcagttcaccttccaggaagcactggagttctgtgaatctcacaatgctacgctggccaccacgggccagctctacgccgcctggagccgcggcctggacaagtgctatgccggctggctggccgacggcagcctccgctaccccatcgtcaccccaaggcctgcctgcggtggggacaagccaggcgtgagaacggtctacctctaccctaaccagacgggcctcccagacccactgtcccggcaccatgccttctgcttccgaggcatttcagcggttccttctccaggagaagaagagggtggcacacccacatcaccctctggtgtggaggagtggatcgtgacccaagtggttcctggtgtggctgctgtccccgtagaagaggagacaactgctgtaccctcaggggagactactgccatcctagagttcaccaccgagccagaaaaccagacagaatgggaaccagcctataccccagtgggcacatccccgctgccagggatccttcctacttggcctcccactggcgcagcaacagaggaaagtacagaaggcccttctgcaactgaagtgccctctgcctcagaggaaccatccccctcagaggtgccattcccctcagaggagccatccccctcagaggaaccattcccctcagtgaggccattcccctcagtggagctgttcccctcagaggagccattcccctccaaggagccatccccctcagaggaaccatcagcctcggaagagccgtatacaccttcaccccccgtgcccagctggactgagctgcccagctctggggaggaatctggggcccctgatgtcagtggtgacttcacaggcagtggagatgtttcaggacaccttgacttcagtgggcagctgtcaggggacagggcaagtggactgccctctggagacctggactccagtggtcttacttccacagtgggctcaggcctgcctgtggaaagtggactaccctcaggggatgaagagagaattgagtggcccagcactcctacggttggtgaactgccctctggagctgagatcctagagggctctgcctctggagttggggatctcagtggacttccttctggagaagttctagagacctctgcctctggagtaggagacctcagtgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactactgcccctggagtagaggagatcagcgggcttccttctggagaagttctagagactactgcccctggagtagatgagatcagtgggcttccttctggagaagttctagagactactgcccctggagtagaggagatcagcgggcttccttctggagaagttctagagacttctacctctgcggtaggggacctcagtggacttccttctggaggagaagttctagagatttctgtctctggagtagaggacatcagtgggcttccttctggagaggttgtagagacttctgcctctggaatagaggatgtcagtgaacttccttcaggagaaggtctagagacctctgcttctggagtagaggacctcagcaggctcccttctggagaagaagttctagagatttctgcctctggatttggggacctcagtggacttccttctggaggagaaggtctagagacctctgcttctgaagtagggactgacctcagtgggcttccttctggaagggagggtctagagacttcagcttctggagctgaggacctcagtgggttgccttctggaaaagaagacttggtggggtcagcttctggagacttggacttgggcaaactgccttctggaactctaggaagtgggcaagctccagaaacaagtggtcttccctctggatttagtggtgagtattctggggtggaccttggaagtggcccaccctctggcctgcctgactttagtggacttccatctggattcccaactgtttccctagtggattctacattggtggaagtggtcacagcctccactgcaagtgaactggaagggaggggaaccattggcatcagtggtgcaggagaaatatctggactgccctccagtgagctggacattagtgggagagctagtggactcccttcaggaactgaactcagtggccaagcatctgggtctcctgatgtcagtggggaaatacctggactctttggtgtcagtggacagccatcagggtttcctgacactagtggggaaacatctggagtgactgagcttagcgggctgtcctctggacaaccaggtattagtggagaagcatctggagttctttatggcactagtcaaccctttggcataactgatctgagtggagaaacatctggggtccctgatctcagtgggcagccttcagggttaccagggttcagtggggcaacatcaggagtccctgacctggtttctggtaccacgagtggcagcggtgaatcttctgggattacatttgtggacaccagtttggttgaagtggcccctactacatttaaagaagaagaaggcttagggtctgtggaactcagtggcctcccttccggagaggcagatctgtcaggcaaatctgggatggtggatgtcagtggacagttttctggaacagtcgattccagtgggtttacatcccagactccggaattcagtggcctaccaagtggcatagctgaggtcagtggagaatcctccagagctgagattgggagcagcctgccctcgggagcatattatggcagtggaactccatctagtttccccactgtctctcttgtagacagaactttggtggaatctgtaacccaggctccaacagcccaagaggcaggagaagggccttctggcattttagaactcagtggtgctcattctggagcaccagacatgtctggggagcattctggatttctggacctaagtgggctgcagtccgggctgatagagcccagcggagagccaccaggtactccatattttagtggggattttgccagcaccaccaatgtaagtggagaatcctctgtagccatgggcaccagtggagaggcctcaggacttccagaagttactttaatcacttctgagttcgtggagggtgttactgaaccaactatttctcaggaactaggccaaaggccccctgtgacacacacaccccagctttttgagtccagtggaaaagtctccacagctggggacattagtggagctaccccagtgctccctgggtctggagtagaagtatcatcagtcccagaatctagcagtgagacgtccgcctatcctgaagctgggttcggggcatctgccgcccctgaggccagcagagaagattctgggtcccctgatctgagtgaaaccacctctgcattccacgaagctaaccttgagagatcctctggcctaggagtgagcggcagcactttgacatttcaagaaggcgaggcgtccgctgccccagaagtgagtggagaatccaccaccaccagtgatgtggggacagaggcaccaggcttgccttcagccactcccacggcttctggagacaggactgaaatcagcggagacctgtctggtcacacctcgcagctgggcgttgtcatcagcaccagcatcccagagtctgagtggacccagcagacccagcgccctgcagagacgcatctagaaattgagtcctcaagcctcctgtactcaggagaagagactcacacagtcgaaacagccacctccccaacagatgcttccatcccagcttctccggaatggaaacgtgaatcagaatcaactgctgcagcccccgccaggtcctgtgcagaggagccctgtggagctgggacctgcaaggagacagagggacacgtcatatgcctgtgcccccctggctacactggcgagcactgtaacatagaccaggaggtatgtgaggagggctggaacaagtaccagggccactgttaccgccacttcccggaccgcgagacctgggtggatgctgagcgccggtgtcgggagcagcagtcacacctgagcagcatcgtcacccccgaggagcaggagtttgtcaacaacaatgcccaagactaccagtggatcggcctgaacgacaggaccatcgaaggggacttccgctggtcagatggacaccccatgcaatttgagaactggcgccccaaccagcctgacaacttttttgccgctggagaggactgtgtggtgatgatctggcacgagaagggcgagtggaatgatgttccctgcaattaccacctccccttcacgtgtaaaaagggcacagtggcctgcggagagccccctgtggtggagcatgccaggaccttcgggcagaagaaggaccggtatgagatcaattccctggtgcggtaccagtgcacagaggggtttgtccagcgccacatgcccaccatccggtgccagcccagcgggcactgggaggagcctcagatcacctgcacagaccccaccacctacaaacgcagactacagaagcggagctcacggcaccctcggaggagccgccccagcacagcccactgagaagagcttccaggacgcacccaggacgctgagcccaggagcctgccaggctgacgtgcatcccacccagacggtgtcctcttcttgtcgctttttgtcatataaggaatcccattaaagaaggaaaaaaataaatcccacatttgtgtatgcacccactcacccctccaaatcagcaaaaccgcatctaatttgtccgccgaatgccaaagcaaagcaaacttattataacccttggactgagtttagagacatttcttcaatttcccatcgtgcctttccagggaccagtgcagggacagggggagaaggggaggggttaagttaaataaagaagattatttttgtttcctgactttatccaagagcagtgcaatcgttggttatttcacctccagggagagctagggaggagggaggagggctccaaaggagctggaaggagcagaggcctgagagcaggaagaactcggaaccgcagctgaatgtattggatgagaaggagccaggagggctacaccatctgtatgagggaaaagccttgggggagaggggtgggttcctgcctcctgccgagggtaagccggcaggagagagccatcagagggacctccgctgcctgggagttgggttccctccaagggtccctctttcagtgtcctctctctcacctgggtctgccaccctaacaggtggcaactcggcagggctgctgggggcacttcctgcccagtggggggtgccgcccaaccttctcccctccccacccccgcccccgggaccgtgcaggcaccagggttccgtgcacctatttatatttttgaaaactgaagattataatattataataataataaagacattggaagagat

SEQ ID NO: 106085 - DNA, 712 bp, Homo sapiens
  Payload ID: 795
  Gene Symbol: ACAN
  Gene Name: aggrecan
  ENST ID: ENST00000558704
  CDS Start-End: 1-470
agtggaatgatgttccctgcaattaccacctccccttcacgtgtaaaaagggcacagtggcctgcggagagccccctgtggtggagcatgccaggaccttcgggcagaagaaggaccggtatgagatcaattccctggtgcggtaccagtgcacagaggggtttgtccagcgccacatgcccaccatccggtgccagcccagcgggcactgggaggagcctcagatcacctgcacagaccgtgagcatcaccccggccatctcgctgagcacaggccaccacctacaaacgcagactacagaagcggagctcacggcaccctcggaggagccgccccagcacagcccactgagaagagcttccaggacgcacccaggacgctgagcccaggagcctgccaggctgacgtgcatcccacccagacggtgtcctcttcttgtcgctttttgtcatataaggaatcccattaaagaaggaaaaaaataaatcccacatttgtgtatgcacccactcacccctccaaatcagcaaaaccgcatctaatttgtccgccgaatgccaaagcaaagcaaacttattataacccttggactgagtttagagacatttcttcaatttcccatcgtgcctttccagggaccagtgcagggacagggggagaaggggaggggttaagttaaataaagaagattatttttgtttcctgacttta

SEQ ID NO: 106086 - DNA, 4159 bp, Homo sapiens
  Payload ID: 795
  Gene Symbol: ACAN
  Gene Name: aggrecan
  ENST ID: ENST00000558207
  CDS Start-End: 344-2509
cgcagagctgaggacgcgcgcagcgctgctcaaggtctctctctctcagcaccctcgccggccggcgtctgacgcgggtgccagggtctccgggcacctttcagtgtccattccctcagccagccaggactccgcaacccagcagttgccgctgcggccacagcccgaggggacctgcggacaggacgccggcaggaggaggggtgcgcagcgcccgcgcagagcgtctccctcgctacgcagcgagacccgggcctcccggccccaggagcccccagctgcctcgccaggtgtgtgggactgaagttcttggagaagggagtccaactcttcaaggtgaactatgaccactttactctgggttttcgtgactctgagggtcatcactgcagctgtcactgtagaaacttcagaccatgacaactcgctgagtgtcagcatcccccaaccgtccccgctgagggtcctcctggggacctccctcaccatcccctgctatttcatcgaccccatgcaccctgtgaccaccgccccttctaccgccccactggccccaagaatcaagtggagccgtgtgtccaaggagaaggaggtagtgctgctggtggccactgaagggcgcgtgcgggtcaacagtgcctatcaggacaaggtctcactgcccaactacccggccatccccagtgacgccaccttggaagtccagagcctgcgctccaatgactctggggtctaccgctgcgaggtgatgcatggcatcgaggacagcgaggccaccctggaagtcgtggtgaaaggcatcgtgttccattacagagccatctctacacgctacaccctcgactttgacagggcgcagcgggcctgcctgcagaacagtgccatcattgccacgcctgagcagctgcaggccgcctacgaagacggcttccaccagtgtgacgccggctggctggctgaccagactgtcagataccccatccacactccccgggaaggctgctatggagacaaggatgagtttcctggtgtgaggacgtatggcatccgagacaccaacgagacctatgatgtgtactgcttcgccgaggagatggagggtgaggtcttttatgcaacatctccagagaagttcaccttccaggaagcagccaatgagtgccggcggctgggtgcccggctggccaccacgggccagctctacctggcctggcaggctggcatggacatgtgcagcgccggctggctggccgaccgcagcgtgcgctaccccatctccaaggcccggcccaactgcggtggcaacctcctgggcgtgaggaccgtctacgtgcatgccaaccagacgggctaccccgacccctcatcccgctacgacgccatctgctacacaggtgaagactttgtggacatcccagaaaacttctttggagtggggggtgaggaggacatcaccgtccagacagtgacctggcctgacatggagctgccactgcctcgaaacatcactgagggtgaagcccgaggcagcgtgatccttaccgtaaagcccatcttcgaggtctcccccagtcccctggaacccgaggagcccttcacgtttgcccctgaaataggggccactgccttcgctgaggttgagaatgagactggagaggccaccaggccctggggctttcccacacctggcctgggccctgccacggcattcaccagtgaggacctcgtcgtgcaggtgaccgctgtccctgggcagccgcatttgccagggggggtcgtcttccactaccgcccgggacccacccgctactcgctgacctttgaggaggcacagcaggcctgcctgcgcacgggggcggtcattgcctcgccggagcagctccaggccgcctacgaagcaggctatgagcagtgtgacgccggctggctgcgggaccagaccgtcagataccccattgtgagcccccggaccccatgcgtgggtgacaaggacagcagcccaggggtcaggacctatggcgtgcgcccatcaacagagacctacgatgtctactgctttgtagacagacttgagggggaggtgttcttcgccacacgccttgagcagttcaccttccaggaagcactggagttctgtgaatctcacaatgctacgctggccaccacgggccagctctacgccgcctggagccgcggcctggacaagtgctatgccggctggctggccgacggcagcctccgctaccccatcgtcaccccaaggcctgcctgcggtggggacaagccaggcgtgagaacggtctacctctaccctaaccagacgggcctcccagacccactgtcccggcaccatgccttctgcttccgaggtatgcagcctcacttcggctccaacagccccttttgtctggagaggaccccactgggttcaccggatcctgccaccacccagtatcccatccatcagagcaagaaaatgtcagtccctctggggcagagccagctctgaaaccagcacaacgcaggctttgaccccaaggcaaggtcatccttctaaagttccccagagacaagtagagataaataagaacttgagctggtatttatgtctactagaaatgaagcagacctgaatttgagttatggctctgctacttaatagctgtgtgaaaatggagatataatggttcctacttcagagagagctgcaagaattaattaagtgcacgtggtgcccttggcatagtgcctgggacacagtaaatgctcaataaatgttagctttatttcatatacatatctatatgtaaagctgtaatatatagctttattttgtacaacctgtaatttgtacactcttgtcaaattctctcctgcttgcaaatatttttgtgatgagtttagtcaaattattctattattcttcactaagcactggtggttcaagtttttcgttgacctatgctatggatatgctaccatttcaaccatcactccccactggacttctgagagtgatgtcatcaagcaatatagtaagcatggccagggcatagccacggaattgctgggctctggatgagttcctgcagagtccatggagggtctgggtgcatggaccagaatgtagattgtaataacagcctgtgccatgttttatagtttacatcaaaactgagtgtctttgcaacttcctgtgaatctagaattattctcaaataaacttaaggggaaaaaacttgagtgtccccaagtttcccagacatccagggtcaccttttaaaacccaattcaaggccaggagcagtggcttacgcctgtaatcccagcactttgggaggccaaggcaggcagatcacttgaggttaggagttcgagatcagcctggccaacatggtgaaaccctgtctctactaaaaaaaagtgcaaaaattagcctagtttggtggtgtgtacctgtaatcccagctactagggaggctgaggcaggagaatcacctcaacccaggaggcggaggttgcagtgagccgagattattctgctctactccagcctgggcagcagagcaagactctgtctcaaaaaaaaaaaaaaaaaattcaaagttcagccagcctcaataagtcaagtccaattctctcccagaggctttgatgaggctcttgtcccagtgccccttccctgctctgggaagcagaaaccaagccagttaacctcccagaaatttcccagccatgctgcccccagcctcccacccctgaccctccgtgaactcagccttgtgtattatcctgcacagttcagcttccttgctgaccaagcccactgctggtttcccccacaccagtacagttacccccagcccatgaatcctgccttcacgctttcaaatgccgagatggtttcatggaattgagtaccatcctcctatttttggtcgtgacacacttggaacataatccctgtcccccaaggttgttcagtagttgagagcgtggagtctggtaccagatgcttaaattcaaagactagatctgacatttgtaagccattgactctgggcaaatcatgtaactctgtgcctcagtttccccatctgtaaaatgagataatcatatctctctcataaagctgttgtgagataaagtgattttagat

SEQ ID NO: 106087 - DNA, 7593 bp, Homo sapiens
  Payload ID: 795
  Gene Symbol: ACAN
  Gene Name: aggrecan
  ENST ID: ENST00000561243
  CDS Start-End: 1-7593
atgaccactttactctgggttttcgtgactctgagggtcatcactgcagctgtcactgtagaaacttcagaccatgacaactcgctgagtgtcagcatcccccaaccgtccccgctgagggtcctcctggggacctccctcaccatcccctgctatttcatcgaccccatgcaccctgtgaccaccgccccttctaccgccccactggccccaagaatcaagtggagccgtgtgtccaaggagaaggaggtagtgctgctggtggccactgaagggcgcgtgcgggtcaacagtgcctatcaggacaaggtctcactgcccaactacccggccatccccagtgacgccaccttggaagtccagagcctgcgctccaatgactctggggtctaccgctgcgaggtgatgcatggcatcgaggacagcgaggccaccctggaagtcgtggtgaaaggcatcgtgttccattacagagccatctctacacgctacaccctcgactttgacagggcgcagcgggcctgcctgcagaacagtgccatcattgccacgcctgagcagctgcaggccgcctacgaagacggcttccaccagtgtgacgccggctggctggctgaccagactgtcagataccccatccacactccccgggaaggctgctatggagacaaggatgagtttcctggtgtgaggacgtatggcatccgagacaccaacgagacctatgatgtgtactgcttcgccgaggagatggagggtgaggtcttttatgcaacatctccagagaagttcaccttccaggaagcagccaatgagtgccggcggctgggtgcccggctggccaccacgggccagctctacctggcctggcaggctggcatggacatgtgcagcgccggctggctggccgaccgcagcgtgcgctaccccatctccaaggcccggcccaactgcggtggcaacctcctgggcgtgaggaccgtctacgtgcatgccaaccagacgggctaccccgacccctcatcccgctacgacgccatctgctacacaggtgaagactttgtggacatcccagaaaacttctttggagtggggggtgaggaggacatcaccgtccagacagtgacctggcctgacatggagctgccactgcctcgaaacatcactgagggtgaagcccgaggcagcgtgatccttaccgtaaagcccatcttcgaggtctcccccagtcccctggaacccgaggagcccttcacgtttgcccctgaaataggggccactgccttcgctgaggttgagaatgagactggagaggccaccaggccctggggctttcccacacctggcctgggccctgccacggcattcaccagtgaggacctcgtcgtgcaggtgaccgctgtccctgggcagccgcatttgccagggggggtcgtcttccactaccgcccgggacccacccgctactcgctgacctttgaggaggcacagcaggcctgcctgcgcacgggggcggtcattgcctcgccggagcagctccaggccgcctacgaagcaggctatgagcagtgtgacgccggctggctgcgggaccagaccgtcagataccccattgtgagcccccggaccccatgcgtgggtgacaaggacagcagcccaggggtcaggacctatggcgtgcgcccatcaacagagacctacgatgtctactgctttgtagacagacttgagggggaggtgttcttcgccacacgccttgagcagttcaccttccaggaagcactggagttctgtgaatctcacaatgctacgctggccaccacgggccagctctacgccgcctggagccgcggcctggacaagtgctatgccggctggctggccgacggcagcctccgctaccccatcgtcaccccaaggcctgcctgcggtggggacaagccaggcgtgagaacggtctacctctaccctaaccagacgggcctcccagacccactgtcccggcaccatgccttctgcttccgaggcatttcagcggttccttctccaggagaagaagagggtggcacacccacatcaccctctggtgtggaggagtggatcgtgacccaagtggttcctggtgtggctgctgtccccgtagaagaggagacaactgctgtaccctcaggggagactactgccatcctagagttcaccaccgagccagaaaaccagacagaatgggaaccagcctataccccagtgggcacatccccgctgccagggatccttcctacttggcctcccactggcgcagcaacagaggaaagtacagaaggcccttctgcaactgaagtgccctctgcctcagaggaaccatccccctcagaggtgccattcccctcagaggagccatccccctcagaggaaccattcccctcagtgaggccattcccctcagtggagctgttcccctcagaggagccattcccctccaaggagccatccccctcagaggaaccatcagcctcggaagagccgtatacaccttcaccccccgtgcccagctggactgagctgcccagctctggggaggaatctggggcccctgatgtcagtggtgacttcacaggcagtggagatgtttcaggacaccttgacttcagtgggcagctgtcaggggacagggcaagtggactgccctctggagacctggactccagtggtcttacttccacagtgggctcaggcctgcctgtggaaagtggactaccctcaggggatgaagagagaattgagtggcccagcactcctacggttggtgaactgccctctggagctgagatcctagagggctctgcctctggagttggggatctcagtggacttccttctggagaagttctagagacctctgcctctggagtaggagacctcagtgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactactgcccctggagtagaggagatcagcgggcttccttctggagaagttctagagactactgcccctggagtagatgagatcagtgggcttccttctggagaagttctagagactactgcccctggagtagaggagatcagcgggcttccttctggagaagttctagagacttctacctctgcggtaggggacctcagtggacttccttctggaggagaagttctagagatttctgtctctggagtagaggacatcagtgggcttccttctggagaggttgtagagacttctgcctctggaatagaggatgtcagtgaacttccttcaggagaaggtctagagacctctgcttctggagtagaggacctcagcaggctcccttctggagaagaagttctagagatttctgcctctggatttggggacctcagtggacttccttctggaggagaaggtctagagacctctgcttctgaagtagggactgacctcagtgggcttccttctggaagggagggtctagagacttcagcttctggagctgaggacctcagtgggttgccttctggaaaagaagacttggtggggtcagcttctggagacttggacttgggcaaactgccttctggaactctaggaagtgggcaagctccagaaacaagtggtcttccctctggatttagtggtgagtattctggggtggaccttggaagtggcccaccctctggcctgcctgactttagtggacttccatctggattcccaactgtttccctagtggattctacattggtggaagtggtcacagcctccactgcaagtgaactggaagggaggggaaccattggcatcagtggtgcaggagaaatatctggactgccctccagtgagctggacattagtgggagagctagtggactcccttcaggaactgaactcagtggccaagcatctgggtctcctgatgtcagtggggaaatacctggactctttggtgtcagtggacagccatcagggtttcctgacactagtggggaaacatctggagtgactgagcttagcgggctgtcctctggacaaccaggtattagtggagaagcatctggagttctttatggcactagtcaaccctttggcataactgatctgagtggagaaacatctggggtccctgatctcagtgggcagccttcagggttaccagggttcagtggggcaacatcaggagtccctgacctggtttctggtaccacgagtggcagcggtgaatcttctgggattacatttgtggacaccagtttggttgaagtggcccctactacatttaaagaagaagaaggcttagggtctgtggaactcagtggcctcccttccggagaggcagatctgtcaggcaaatctgggatggtggatgtcagtggacagttttctggaacagtcgattccagtgggtttacatcccagactccggaattcagtggcctaccaagtggcatagctgaggtcagtggagaatcctccagagctgagattgggagcagcctgccctcgggagcatattatggcagtggaactccatctagtttccccactgtctctcttgtagacagaactttggtggaatctgtaacccaggctccaacagcccaagaggcaggagaagggccttctggcattttagaactcagtggtgctcattctggagcaccagacatgtctggggagcattctggatttctggacctaagtgggctgcagtccgggctgatagagcccagcggagagccaccaggtactccatattttagtggggattttgccagcaccaccaatgtaagtggagaatcctctgtagccatgggcaccagtggagaggcctcaggacttccagaagttactttaatcacttctgagttcgtggagggtgttactgaaccaactatttctcaggaactaggccaaaggccccctgtgacacacacaccccagctttttgagtccagtggaaaagtctccacagctggggacattagtggagctaccccagtgctccctgggtctggagtagaagtatcatcagtcccagaatctagcagtgagacgtccgcctatcctgaagctgggttcggggcatctgccgcccctgaggccagcagagaagattctgggtcccctgatctgagtgaaaccacctctgcattccacgaagctaaccttgagagatcctctggcctaggagtgagcggcagcactttgacatttcaagaaggcgaggcgtccgctgccccagaagtgagtggagaatccaccaccaccagtgatgtggggacagaggcaccaggcttgccttcagccactcccacggcttctggagacaggactgaaatcagcggagacctgtctggtcacacctcgcagctgggcgttgtcatcagcaccagcatcccagagtctgagtggacccagcagacccagcgccctgcagagacgcatctagaaattgagtcctcaagcctcctgtactcaggagaagagactcacacagtcgaaacagccacctccccaacagatgcttccatcccagcttctccggaatggaaacgtgaatcagaatcaactgctgcagcccccgccaggtcctgtgcagaggagccctgtggagctgggacctgcaaggagacagagggacacgtcatatgcctgtgcccccctggctacactggcgagcactgtaacatagaccaggaggtatgtgaggagggctggaacaagtaccagggccactgttaccgccacttcccggaccgcgagacctgggtggatgctgagcgccggtgtcgggagcagcagtcacacctgagcagcatcgtcacccccgaggagcaggagtttgtcaacaacaatgcccaagactaccagtggatcggcctgaacgacaggaccatcgaaggggacttccgctggtcagatggacaccccatgcaatttgagaactggcgccccaaccagcctgacaacttttttgccgctggagaggactgtgtggtgatgatctggcacgagaagggcgagtggaatgatgttccctgcaattaccacctccccttcacgtgtaaaaagggcacagtggcctgcggagagccccctgtggtggagcatgccaggaccttcgggcagaagaaggaccggtatgagatcaattccctggtgcggtaccagtgcacagaggggtttgtccagcgccacatgcccaccatccggtgccagcccagcgggcactgggaggagcctcagatcacctgcacagaccccaccacctacaaacgcagactacagaagcggagctcacggcaccctcggaggagccgccccagcacagcccactga

SEQ ID NO: 106088 - DNA, 7628 bp, Homo sapiens
  Payload ID: 795
  Gene Symbol: ACAN
  Gene Name: aggrecan
  ENST ID: ENST00000559004
  CDS Start-End: 59-7537
gccaggtgtgtgggactgaagttcttggagaagggagtccaactcttcaaggtgaactatgaccactttactctgggttttcgtgactctgagggtcatcactgcagctgtcactgtagaaacttcagaccatgacaactcgctgagtgtcagcatcccccaaccgtccccgctgagggtcctcctggggacctccctcaccatcccctgctatttcatcgaccccatgcaccctgtgaccaccgccccttctaccgccccactggccccaagaatcaagtggagccgtgtgtccaaggagaaggaggtagtgctgctggtggccactgaagggcgcgtgcgggtcaacagtgcctatcaggacaaggtctcactgcccaactacccggccatccccagtgacgccaccttggaagtccagagcctgcgctccaatgactctggggtctaccgctgcgaggtgatgcatggcatcgaggacagcgaggccaccctggaagtcgtggtgaaaggcatcgtgttccattacagagccatctctacacgctacaccctcgactttgacagggcgcagcgggcctgcctgcagaacagtgccatcattgccacgcctgagcagctgcaggccgcctacgaagacggcttccaccagtgtgacgccggctggctggctgaccagactgtcagataccccatccacactccccgggaaggctgctatggagacaaggatgagtttcctggtgtgaggacgtatggcatccgagacaccaacgagacctatgatgtgtactgcttcgccgaggagatggagggtgaggtcttttatgcaacatctccagagaagttcaccttccaggaagcagccaatgagtgccggcggctgggtgcccggctggccaccacgggccagctctacctggcctggcaggctggcatggacatgtgcagcgccggctggctggccgaccgcagcgtgcgctaccccatctccaaggcccggcccaactgcggtggcaacctcctgggcgtgaggaccgtctacgtgcatgccaaccagacgggctaccccgacccctcatcccgctacgacgccatctgctacacaggtgaagactttgtggacatcccagaaaacttctttggagtggggggtgaggaggacatcaccgtccagacagtgacctggcctgacatggagctgccactgcctcgaaacatcactgagggtgaagcccgaggcagcgtgatccttaccgtaaagcccatcttcgaggtctcccccagtcccctggaacccgaggagcccttcacgtttgcccctgaaataggggccactgccttcgctgaggttgagaatgagactggagaggccaccaggccctggggctttcccacacctggcctgggccctgccacggcattcaccagtgaggacctcgtcgtgcaggtgaccgctgtccctgggcagccgcatttgccagggggggtcgtcttccactaccgcccgggacccacccgctactcgctgacctttgaggaggcacagcaggcctgcctgcgcacgggggcggtcattgcctcgccggagcagctccaggccgcctacgaagcaggctatgagcagtgtgacgccggctggctgcgggaccagaccgtcagataccccattgtgagcccccggaccccatgcgtgggtgacaaggacagcagcccaggggtcaggacctatggcgtgcgcccatcaacagagacctacgatgtctactgctttgtagacagacttgagggggaggtgttcttcgccacacgccttgagcagttcaccttccaggaagcactggagttctgtgaatctcacaatgctacgctggccaccacgggccagctctacgccgcctggagccgcggcctggacaagtgctatgccggctggctggccgacggcagcctccgctaccccatcgtcaccccaaggcctgcctgcggtggggacaagccaggcgtgagaacggtctacctctaccctaaccagacgggcctcccagacccactgtcccggcaccatgccttctgcttccgaggcatttcagcggttccttctccaggagaagaagagggtggcacacccacatcaccctctggtgtggaggagtggatcgtgacccaagtggttcctggtgtggctgctgtccccgtagaagaggagacaactgctgtaccctcaggggagactactgccatcctagagttcaccaccgagccagaaaaccagacagaatgggaaccagcctataccccagtgggcacatccccgctgccagggatccttcctacttggcctcccactggcgcagcaacagaggaaagtacagaaggcccttctgcaactgaagtgccctctgcctcagaggaaccatccccctcagaggtgccattcccctcagaggagccatccccctcagaggaaccattcccctcagtgaggccattcccctcagtggagctgttcccctcagaggagccattcccctccaaggagccatccccctcagaggaaccatcagcctcggaagagccgtatacaccttcaccccccgtgcccagctggactgagctgcccagctctggggaggaatctggggcccctgatgtcagtggtgacttcacaggcagtggagatgtttcaggacaccttgacttcagtgggcagctgtcaggggacagggcaagtggactgccctctggagacctggactccagtggtcttacttccacagtgggctcaggcctgcctgtggaaagtggactaccctcaggggatgaagagagaattgagtggcccagcactcctacggttggtgaactgccctctggagctgagatcctagagggctctgcctctggagttggggatctcagtggacttccttctggagaagttctagagacctctgcctctggagtaggagacctcagtgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactactgcccctggagtagaggagatcagcgggcttccttctggagaagttctagagactactgcccctggagtagatgagatcagtgggcttccttctggagaagttctagagactactgcccctggagtagaggagatcagcgggcttccttctggagaagttctagagacttctacctctgcggtaggggacctcagtggacttccttctggaggagaagttctagagatttctgtctctggagtagaggacatcagtgggcttccttctggagaggttgtagagacttctgcctctggaatagaggatgtcagtgaacttccttcaggagaaggtctagagacctctgcttctggagtagaggacctcagcaggctcccttctggagaagaagttctagagatttctgcctctggatttggggacctcagtggacttccttctggaggagaaggtctagagacctctgcttctgaagtagggactgacctcagtgggcttccttctggaagggagggtctagagacttcagcttctggagctgaggacctcagtgggttgccttctggaaaagaagacttggtggggtcagcttctggagacttggacttgggcaaactgccttctggaactctaggaagtgggcaagctccagaaacaagtggtcttccctctggatttagtggtgagtattctggggtggaccttggaagtggcccaccctctggcctgcctgactttagtggacttccatctggattcccaactgtttccctagtggattctacattggtggaagtggtcacagcctccactgcaagtgaactggaagggaggggaaccattggcatcagtggtgcaggagaaatatctggactgccctccagtgagctggacattagtgggagagctagtggactcccttcaggaactgaactcagtggccaagcatctgggtctcctgatgtcagtggggaaatacctggactctttggtgtcagtggacagccatcagggtttcctgacactagtggggaaacatctggagtgactgagcttagcgggctgtcctctggacaaccaggtattagtggagaagcatctggagttctttatggcactagtcaaccctttggcataactgatctgagtggagaaacatctggggtccctgatctcagtgggcagccttcagggttaccagggttcagtggggcaacatcaggagtccctgacctggtttctggtaccacgagtggcagcggtgaatcttctgggattacatttgtggacaccagtttggttgaagtggcccctactacatttaaagaagaagaaggcttagggtctgtggaactcagtggcctcccttccggagaggcagatctgtcaggcaaatctgggatggtggatgtcagtggacagttttctggaacagtcgattccagtgggtttacatcccagactccggaattcagtggcctaccaagtggcatagctgaggtcagtggagaatcctccagagctgagattgggagcagcctgccctcgggagcatattatggcagtggaactccatctagtttccccactgtctctcttgtagacagaactttggtggaatctgtaacccaggctccaacagcccaagaggcaggagaagggccttctggcattttagaactcagtggtgctcattctggagcaccagacatgtctggggagcattctggatttctggacctaagtgggctgcagtccgggctgatagagcccagcggagagccaccaggtactccatattttagtggggattttgccagcaccaccaatgtaagtggagaatcctctgtagccatgggcaccagtggagaggcctcaggacttccagaagttactttaatcacttctgagttcgtggagggtgttactgaaccaactatttctcaggaactaggccaaaggccccctgtgacacacacaccccagctttttgagtccagtggaaaagtctccacagctggggacattagtggagctaccccagtgctccctgggtctggagtagaagtatcatcagtcccagaatctagcagtgagacgtccgcctatcctgaagctgggttcggggcatctgccgcccctgaggccagcagagaagattctgggtcccctgatctgagtgaaaccacctctgcattccacgaagctaaccttgagagatcctctggcctaggagtgagcggcagcactttgacatttcaagaaggcgaggcgtccgctgccccagaagtgagtggagaatccaccaccaccagtgatgtggggacagaggcaccaggcttgccttcagccactcccacggcttctggagacaggactgaaatcagcggagacctgtctggtcacacctcgcagctgggcgttgtcatcagcaccagcatcccagagtctgagtggacccagcagacccagcgccctgcagagacgcatctagaaattgagtcctcaagcctcctgtactcaggagaagagactcacacagtcgaaacagccacctccccaacagatgcttccatcccagcttctccggaatggaaacgtgaatcagaatcaactgctgcagaccaggaggtatgtgaggagggctggaacaagtaccagggccactgttaccgccacttcccggaccgcgagacctgggtggatgctgagcgccggtgtcgggagcagcagtcacacctgagcagcatcgtcacccccgaggagcaggagtttgtcaacaacaatgcccaagactaccagtggatcggcctgaacgacaggaccatcgaaggggacttccgctggtcagatggacaccccatgcaatttgagaactggcgccccaaccagcctgacaacttttttgccgctggagaggactgtgtggtgatgatctggcacgagaagggcgagtggaatgatgttccctgcaattaccacctccccttcacgtgtaaaaagggcacagtggcctgcggagagccccctgtggtggagcatgccaggaccttcgggcagaagaaggaccggtatgagatcaattccctggtgcggtaccagtgcacagaggggtttgtccagcgccacatgcccaccatccggtgccagcccagcgggcactgggaggagcctcagatcacctgcacagaccccaccacctacaaacgcagactacagaagcggagctcacggcaccctcggaggagccgccccagcacagcccactgagaagagcttccaggacgcacccaggacgctgagcccaggagcctgccaggctgacgtgcatcccacccagacggtgtcctcttcttgtcgc

SEQ ID NO: 106089 - DNA, 679 bp, Homo sapiens
  Payload ID: 795
  Gene Symbol: ACAN
  Gene Name: aggrecan
  ENST ID: ENST00000560601
  CDS Start-End: 1-679
ccccagaagtgagtggagaatccaccaccaccagtgatgtggggacagaggcaccaggcttgccttcagccactcccacggcttctggagacaggactgaaatcagcggagacctgtctggtcacacctcgcagctgggcgttgtcatcagcaccagcatcccagagtctgagtggacccagcagacccagcgccctgcagagacgcatctagaaattgagtcctcaagcctcctgtactcaggagaagagactcacacagtcgaaacagccacctccccaacagatgcttccatcccagcttctccggaatggaaacgtgaatcagaatcaactgctgcagcccccgccaggtcctgtgcagaggagccctgtggagctgggacctgcaaggagacagagggacacgtcatatgcctgtgcccccctggctacactggcgagcactgtaacatagacattgatgagtgcctctcaagcccttgtctgaatggagccacctgcgtggatgccatcgactctttcacatgcttatgccttcccagctacgaaggggacctgtgtgagattgaccaggaggtatgtgaggagggctggaacaagtaccagggccactgttaccgccacttcccggaccgcgagacctgggtggatgctgagcgccggtgtcgggagcagca

SEQ ID NO: 106090 - DNA, 8669 bp, Homo sapiens
  Payload ID: 795
  Gene Symbol: ACAN
  Gene Name: aggrecan
  ENST ID: ENST00000617301
  CDS Start-End: 375-7796
cacctacctccccgccgctccagagggggctcgcagagctgaggacgcgcgcagcgctgctcaaggtctctctctctcagcaccctcgccggccggcgtctgacgcgggtgccagggtctccgggcacctttcagtgtccattccctcagccagccaggactccgcaacccagcagttgccgctgcggccacagcccgaggggacctgcggacaggacgccggcaggaggaggggtgcgcagcgcccgcgcagagcgtctccctcgctacgcagcgagacccgggcctcccggccccaggagcccccagctgcctcgccaggtgtgtgggactgaagttcttggagaagggagtccaactcttcaaggtgaactatgaccactttactctgggttttcgtgactctgagggtcatcactgcagctgtcactgtagaaacttcagaccatgacaactcgctgagtgtcagcatcccccaaccgtccccgctgagggtcctcctggggacctccctcaccatcccctgctatttcatcgaccccatgcaccctgtgaccaccgccccttctaccgccccactggccccaagaatcaagtggagccgtgtgtccaaggagaaggaggtagtgctgctggtggccactgaagggcgcgtgcgggtcaacagtgcctatcaggacaaggtctcactgcccaactacccggccatccccagtgacgccaccttggaagtccagagcctgcgctccaatgactctggggtctaccgctgcgaggtgatgcatggcatcgaggacagcgaggccaccctggaagtcgtggtgaaaggcatcgtgttccattacagagccatctctacacgctacaccctcgactttgacagggcgcagcgggcctgcctgcagaacagtgccatcattgccacgcctgagcagctgcaggccgcctacgaagacggcttccaccagtgtgacgccggctggctggctgaccagactgtcagataccccatccacactccccgggaaggctgctatggagacaaggatgagtttcctggtgtgaggacgtatggcatccgagacaccaacgagacctatgatgtgtactgcttcgccgaggagatggagggtgaggtcttttatgcaacatctccagagaagttcaccttccaggaagcagccaatgagtgccggcggctgggtgcccggctggccaccacgggccagctctacctggcctggcaggctggcatggacatgtgcagcgccggctggctggccgaccgcagcgtgcgctaccccatctccaaggcccggcccaactgcggtggcaacctcctgggcgtgaggaccgtctacgtgcatgccaaccagacgggctaccccgacccctcatcccgctacgacgccatctgctacacaggtgaagactttgtggacatcccagaaaacttctttggagtggggggtgaggaggacatcaccgtccagacagtgacctggcctgacatggagctgccactgcctcgaaacatcactgagggtgaagcccgaggcagcgtgatccttaccgtaaagcccatcttcgaggtctcccccagtcccctggaacccgaggagcccttcacgtttgcccctgaaataggggccactgccttcgctgaggttgagaatgagactggagaggccaccaggccctggggctttcccacacctggcctgggccctgccacggcattcaccagtgaggacctcgtcgtgcaggtgaccgctgtccctgggcagccgcatttgccagggggggtcgtcttccactaccgcccgggacccacccgctactcgctgacctttgaggaggcacagcaggcctgcctgcgcacgggggcggtcattgcctcgccggagcagctccaggccgcctacgaagcaggctatgagcagtgtgacgccggctggctgcgggaccagaccgtcagataccccattgtgagcccccggaccccatgcgtgggtgacaaggacagcagcccaggggtcaggacctatggcgtgcgcccatcaacagagacctacgatgtctactgctttgtagacagacttgagggggaggtgttcttcgccacacgccttgagcagttcaccttccaggaagcactggagttctgtgaatctcacaatgctacgctggccaccacgggccagctctacgccgcctggagccgcggcctggacaagtgctatgccggctggctggccgacggcagcctccgctaccccatcgtcaccccaaggcctgcctgcggtggggacaagccaggcgtgagaacggtctacctctaccctaaccagacgggcctcccagacccactgtcccggcaccatgccttctgcttccgaggcatttcagcggttccttctccaggagaagaagagggtggcacacccacatcaccctctggtgtggaggagtggatcgtgacccaagtggttcctggtgtggctgctgtccccgtagaagaggagacaactgctgtaccctcaggggagactactgccatcctagagttcaccaccgagccagaaaaccagacagaatgggaaccagcctataccccagtgggcacatccccgctgccagggatccttcctacttggcctcccactggcgcagcaacagaggaaagtacagaaggcccttctgcaactgaagtgccctctgcctcagaggaaccatccccctcagaggtgccattcccctcagaggagccatccccctcagaggaaccattcccctcagtgaggccattcccctcagtggagctgttcccctcagaggagccattcccctccaaggagccatccccctcagaggaaccatcagcctcggaagagccgtatacaccttcaccccccgtgcccagctggactgagctgcccagctctggggaggaatctggggcccctgatgtcagtggtgacttcacaggcagtggagatgtttcaggacaccttgacttcagtgggcagctgtcaggggacagggcaagtggactgccctctggagacctggactccagtggtcttacttccacagtgggctcaggcctgcctgtggaaagtggactaccctcaggggatgaagagagaattgagtggcccagcactcctacggttggtgaactgccctctggagctgagatcctagagggctctgcctctggagttggggatctcagtggacttccttctggagaagttctagagacctctgcctctggagtaggagacctcagtgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactactgcccctggagtagaggagatcagcgggcttccttctggagaagttctagagactactgcccctggagtagatgagatcagtgggcttccttctggagaagttctagagactactgcccctggagtagaggagatcagcgggcttccttctggagaagttctagagacttctacctctgcggtaggggacctcagtggacttccttctggaggagaagttctagagatttctgtctctggagtagaggacatcagtgggcttccttctggagaggttgtagagacttctgcctctggaatagaggatgtcagtgaacttccttcaggagaaggtctagagacctctgcttctggagtagaggacctcagcaggctcccttctggagaagaagttctagagatttctgcctctggatttggggacctcagtggacttccttctggaggagaaggtctagagacctctgcttctgaagtagggactgacctcagtgggcttccttctggaagggagggtctagagacttcagcttctggagctgaggacctcagtgggttgccttctggaaaagaagacttggtggggtcagcttctggagacttggacttgggcaaactgccttctggaactctaggaagtgggcaagctccagaaacaagtggtcttccctctggatttagtggtgagtattctggggtggaccttggaagtggcccaccctctggcctgcctgactttagtggacttccatctggattcccaactgtttccctagtggattctacattggtggaagtggtcacagcctccactgcaagtgaactggaagggaggggaaccattggcatcagtggtgcaggagaaatatctggactgccctccagtgagctggacattagtgggagagctagtggactcccttcaggaactgaactcagtggccaagcatctgggtctcctgatgtcagtggggaaatacctggactctttggtgtcagtggacagccatcagggtttcctgacactagtggggaaacatctggagtgactgagcttagcgggctgtcctctggacaaccaggtattagtggagaagcatctggagttctttatggcactagtcaaccctttggcataactgatctgagtggagaaacatctggggtccctgatctcagtgggcagccttcagggttaccagggttcagtggggcaacatcaggagtccctgacctggtttctggtaccacgagtggcagcggtgaatcttctgggattacatttgtggacaccagtttggttgaagtggcccctactacatttaaagaagaagaaggcttagggtctgtggaactcagtggcctcccttccggagaggcagatctgtcaggcaaatctgggatggtggatgtcagtggacagttttctggaacagtcgattccagtgggtttacatcccagactccggaattcagtggcctaccaagtggcatagctgaggtcagtggagaatcctccagagctgagattgggagcagcctgccctcgggagcatattatggcagtggaactccatctagtttccccactgtctctcttgtagacagaactttggtggaatctgtaacccaggctccaacagcccaagaggcaggagaagggccttctggcattttagaactcagtggtgctcattctggagcaccagacatgtctggggagcattctggatttctggacctaagtgggctgcagtccgggctgatagagcccagcggagagccaccaggtactccatattttagtggggattttgccagcaccaccaatgtaagtggagaatcctctgtagccatgggcaccagtggagaggcctcaggacttccagaagttactttaatcacttctgagttcgtggagggtgttactgaaccaactatttctcaggaactaggccaaaggccccctgtgacacacacaccccagctttttgagtccagtggaaaagtctccacagctggggacattagtggagctaccccagtgctccctgggtctggagtagaagtatcatcagtcccagaatctagcagtgagacgtccgcctatcctgaagctgggttcggggcatctgccgcccctgaggccagcagagaagattctgggtcccctgatctgagtgaaaccacctctgcattccacgaagctaaccttgagagatcctctggcctaggagtgagcggcagcactttgacatttcaagaaggcgaggcgtccgctgccccagaagtgagtggagaatccaccaccaccagtgatgtggggacagaggcaccaggcttgccttcagccactcccacggcttctggagacaggactgaaatcagcggagacctgtctggtcacacctcgcagctgggcgttgtcatcagcaccagcatcccagagtctgagtggacccagcagacccagcgccctgcagagacgcatctagaaattgagtcctcaagcctcctgtactcaggagaagagactcacacagtcgaaacagccacctccccaacagatgcttccatcccagcttctccggaatggaaacgtgaatcagaatcaactgctgcagaccaggaggtatgtgaggagggctggaacaagtaccagggccactgttaccgccacttcccggaccgcgagacctgggtggatgctgagcgccggtgtcgggagcagcagtcacacctgagcagcatcgtcacccccgaggagcaggagtttgtcaacaacaatgcccaagactaccagtggatcggcctgaacgacaggaccatcgaaggggacttccgctggtcagatggacaccccatgcaatttgagaactggcgccccaaccagcctgacaacttttttgccgctggagaggactgtgtggtgatgatctggcacgagaagggcgagtggaatgatgttccctgcaattaccacctccccttcacgtgtaaaaagggcacagtggcctgcggagagccccctgtggtggagcatgccaggaccttcgggcagaagaaggaccggtatgagatcaattccctggtgcggtaccagtgcacagaggggtttgtccagcgccacatgcccaccatccggtgccagcccagcgggcactgggaggagcctcagatcacctgcacagaccccaccacctacaaacgcagactacagaagcggagctcacggcaccctcggaggagccgccccagcacagcccactgagaagagcttccaggacgcacccaggacgctgagcccaggagcctgccaggctgacgtgcatcccacccagacggtgtcctcttcttgtcgctttttgtcatataaggaatcccattaaagaaggaaaaaaataaatcccacatttgtgtatgcacccactcacccctccaaatcagcaaaaccgcatctaatttgtccgccgaatgccaaagcaaagcaaacttattataacccttggactgagtttagagacatttcttcaatttcccatcgtgcctttccagggaccagtgcagggacagggggagaaggggaggggttaagttaaataaagaagattatttttgtttcctgactttatccaagagcagtgcaatcgttggttatttcacctccagggagagctagggaggagggaggagggctccaaaggagctggaaggagcagaggcctgagagcaggaagaactcggaaccgcagctgaatgtattggatgagaaggagccaggagggctacaccatctgtatgagggaaaagccttgggggagaggggtgggttcctgcctcctgccgagggtaagccggcaggagagagccatcagagggacctccgctgcctgggagttgggttccctccaagggtccctctttcagtgtcctctctctcacctgggtctgccaccctaacaggtggcaactcggcagggctgctgggggcacttcctgcccagtggggggtgccgcccaaccttctcccctccccacccccgcccccgggaccgtgcaggcaccagggttccgtgcacctatttatatttttgaaaactgaagattataatattataataataataaagacattggaagagat

SEQ ID NO: 106091 - DNA, 2500 bp, Homo sapiens
  Payload ID: 796
  Gene Symbol: AGMAT
  Gene Name: agmatine ureohydrolase (agmatinase)
  Uniprot ID: Q9BSE5
  ENST ID: ENST00000375826
  CDS Start-End: 144-1202
cttgatcctagggcgcccctgacctttgagccggctcgggttccggctctggcgcgtgcacactcgcctcgccgttcgggaccagccagatcgcggcggcctcgcgggcggtttggtcggtgaggtcttggccgcgcgcggcaatgctgaggctgctggcgtccgggtgcgcccggggcccggggcccggcgtgggcgcgcgtcctgccgcagggctctttcatccggggcgccgccagagccgccaggcttccgacgcgccccggaaccagccccccagccccgagttcgtggcccggccggtgggcgtctgctccatgatgcgcctgccggtgcagacctcccccgaggggctggacgctgccttcatcggggtgcccctggatactgggacctccaaccggcctggggcgagattcggacctcgccgcatccgggaagaatcagtgatgcttgggacagtcaatcctagcacgggggccctccccttccagtccctcatggttgcagacctaggcgatgtgaatgtcaatctttacaaccttcaggacagctgccggcgaattcaagaggcctatgagaaaattgtagcagctggctgtattcctctgaccttgggtggagatcacacaatcacatatcccatattgcaagcgatggcaaaaaagcatggcccagtggggctgctgcacgtggatgcgcacacggacacgaccgacaaggccctaggagagaagctctaccacggggcgcccttccgccggtgtgtggatgagggtctcctggactgtaagcgtgtggtgcagattggcatccggggctcttccacgaccttggatccctacagatacaaccggagccagggcttccgggtagtcctggctgaagactgctggatgaagtcgctggttcctctgatgggggaagtcaggcagcagatgggaggcaaacccatttatatcagctttgatattgacgctctggatcctgcctatgcgccagggacagggacacctgaaattgctggtctcactcctagtcaggctctggagatcatcaggggttgtcaaggcctgaacgtgatgggctgtgatcttgtcgaagtttcaccaccgtatgatctttctgggaacacagccctgctggcggctaacctgctgtttgagatgctatgtgctctccccaaagtgacaaccgtctgagtcttgtgctcttcaagacaaaacagattgcgtcgctgacaagttctcaagaagaacttatgagtaagcagtctgagaactaaagagtttatgccaagaaaactttctgctgaaagtgtcattgctggctgtgaagtcgggataatcagtagaattctcacccaaacagcaacatttctaaggaacttggattaattgggggaaaaaaaaaggagtacttgtactgctttgattttttttcctttgatgaaagatggaggataaaggggaagtgaggagaatttctttcaagattatctaaacattagaaacatgacatttaaaaaaactatgaaataatactgtataagcattccatatttctatatcttccttttaaacatttttttttttgagatagagttttgcttgtcacccaggctggagtgcaatggcatgatctcggttcattgcaacctccgcctcccgagttcaatcgattctcctgcctcagcctcctgagtacctgggattacaggtgcctgccaccacgcctggctaatttttgtatttttagtagagacagggtttcaccacattggccaggctggtcttgaactcctgacctaaggtgatccgcccgcctcagcctccttaaagtgctgggattacaggcatgagccaccgcacccagccgctttttaaaattttgatgatctgcttcctagagtattgagtatcttcctttaaactacagctcctcctcggacgctgcagtgagctgagatcgcaccactgcactccagcctgggtgccagagcaagactccatctcaaaaaaaaaaaaaaaaaatacagcttctcctatgaggtgcttagggctgcatcttggttttaggaccactgtgaacgtaagtaaaaagtataaagtaacacggagagcctaatgaagaaacttcttgctcagaggcctagaagggtacacaaaatgtcttctaaactagaaaacctaaggctggacacggtggctcatgcctgtaatcccagcactttggggggcggaggtgggcagatcacttgaggtcaggagttcgagaccagcctggccaacatggtgaaaacccatctctactgaaaatacagaagttagctgggcgtggtggcgcgtgcctatagtcccagctactcaggaagctgaggcaggggcattgcttgaacccgggaggtggaggttgcagtgagctgaggtcatgccactacactccagcctgggtgacagagtgagactccgtctccaaaaaaaaaaaaaaaaaaaaaaaa

SEQ ID NO: 106092 - DNA, 764 bp, Homo sapiens
  Payload ID: 797
  Gene Symbol: AGRP
  Gene Name: agouti related neuropeptide
  Uniprot ID: O00253
  ENST ID: ENST00000290953
  CDS Start-End: 301-699
agctcctaggtccctgtcctgtggaaatttgtggaccctgggcaccctctcttgctcccaaattttaatcggctcctggaaacctcaccccaaattggagataggcactcctcttgtagaacaaaaggctcaggttcagggagtgagggcctgaactgtgcccccaccctccaggaagggtccttcacggcctggctgcagggatcagtcacgtgtggcccttcattaggccctgccatataagccaagggcacggggtggccgggaactctctaggcaagaatcccggaggcagaggccatgctgaccgcagcggtgctgagctgtgccctgctgctggcactgcctgccacgcgaggagcccagatgggcttggcccccatggagggcatcagaaggcctgaccaggccctgctcccagagctcccaggcctgggcctgcgggccccactgaagaagacaactgcagaacaggcagaagaggatctgttgcaggaggctcaggccttggcagaggtactagacctgcaggaccgcgagccccgctcctcacgtcgctgcgtaaggctgcatgagtcctgcctgggacagcaggtgccttgctgtgacccatgtgccacgtgctactgccgcttcttcaatgccttctgctactgccgcaagctgggtactgccatgaatccctgcagccgcacctagctggccaacgtcagggtcggggctagggtaggggcaaggaaactcgaataaaggatgggaccaac

SEQ ID NO: 106093 - DNA, 586 bp, Homo sapiens
  Payload ID: 798
  Gene Symbol: ASIP
  Gene Name: agouti signaling protein
  Uniprot ID: P42127
  ENST ID: ENST00000374954
  CDS Start-End: 11-409
gcctcctgggatggatgtcacccgcttactcctggccaccctgctggtcttcctctgcttcttcactgccaacagccacctgccacctgaggagaagctccgagatgacaggagcctgagaagcaactcctctgtgaacctactggatgtcccttctgtctctattgtggcgctgaacaagaaatccaaacagatcggcagaaaagcagcagaaaagaaaagatcttctaagaaggaggcttcgatgaagaaagtggtgcggccccggacccccctatctgcgccctgcgtggccacccgcaacagctgcaagccgccggcacccgcctgctgcgacccgtgcgcctcctgccagtgccgcttcttccgcagcgcctgctcctgccgcgtgctcagcctcaactgctgagcgcccccactcccggccgcgagcaggcagggcttcggggacgcggggcgcttctcgggcgggtgatccctaacagggcggcttcccagggctgcaggcgggcggaggttccaggagatgggacttcagggagacctggcttgggctaaaatcgaaatacaatatatataggctgct

SEQ ID NO: 106094 - DNA, 610 bp, Homo sapiens
  Payload ID: 798
  Gene Symbol: ASIP
  Gene Name: agouti signaling protein
  Uniprot ID: P42127
  ENST ID: ENST00000568305
  CDS Start-End: 203-601
gactcagcccgctgaacgcctggaagaaattttgcagacccaccagagatccccagattccacttgtaaaaccattgatctaaaaactacgtcttgacttcagaacacttcttttgatctggaattatctattattgaccacagagagcagccactgacgatttcctggaacagggccctgtatagagagaggcctcctgggatggatgtcacccgcttactcctggccaccctgctggtcttcctctgcttcttcactgccaacagccacctgccacctgaggagaagctccgagatgacaggagcctgagaagcaactcctctgtgaacctactggatgtcccttctgtctctattgtggcgctgaacaagaaatccaaacagatcggcagaaaagcagcagaaaagaaaagatcttctaagaaggaggcttcgatgaagaaagtggtgcggccccggacccccctatctgcgccctgcgtggccacccgcaacagctgcaagccgccggcacccgcctgctgcgacccgtgcgcctcctgccagtgccgcttcttccgcagcgcctgctcctgccgcgtgctcagcctcaactgctgagcgccccca

SEQ ID NO: 106095 - DNA, 7323 bp, Homo sapiens
  Payload ID: 799
  Gene Symbol: AGRN
  Gene Name: agrin
  Uniprot ID: O00468
  ENST ID: ENST00000379370
  CDS Start-End: 51-6188
cccgtccccggcgcggcccgcgcgctcctccgccgcctctcgcctgcgccatggccggccggtcccacccgggcccgctgcggccgctgctgccgctccttgtggtggccgcgtgcgtcctgcccggagccggcgggacatgcccggagcgcgcgctggagcggcgcgaggaggaggcgaacgtggtgctcaccgggacggtggaggagatcctcaacgtggacccggtgcagcacacgtactcctgcaaggttcgggtctggcggtacttgaagggcaaagacctggtggcccgggagagcctgctggacggcggcaacaaggtggtgatcagcggctttggagaccccctcatctgtgacaaccaggtgtccactggggacaccaggatcttctttgtgaaccctgcacccccatacctgtggccagcccacaagaacgagctgatgctcaactccagcctcatgcggatcaccctgcggaacctggaggaggtggagttctgtgtggaagataaacccgggacccacttcactccagtgcctccgacgcctcctgatgcgtgccggggaatgctgtgcggcttcggcgccgtgtgcgagcccaacgcggaggggccgggccgggcgtcctgcgtctgcaagaagagcccgtgccccagcgtggtggcgcctgtgtgtgggtcggacgcctccacctacagcaacgaatgcgagctgcagcgggcgcagtgcagccagcagcgccgcatccgcctgctcagccgcgggccgtgcggctcgcgggacccctgctccaacgtgacctgcagcttcggcagcacctgtgcgcgctcggccgacgggctgacggcctcgtgcctgtgccccgcgacctgccgtggcgcccccgaggggaccgtctgcggcagcgacggcgccgactaccccggcgagtgccagctcctgcgccgcgcctgcgcccgccaggagaatgtcttcaagaagttcgacggcccttgtgacccctgtcagggcgccctccctgacccgagccgcagctgccgtgtgaacccgcgcacgcggcgccctgagatgctcctacggcccgagagctgccctgcccggcaggcgccagtgtgtggggacgacggagtcacctacgaaaacgactgtgtcatgggccgatcgggggccgcccggggtctcctcctgcagaaagtgcgctccggccagtgccagggtcgagaccagtgcccggagccctgccggttcaatgccgtgtgcctgtcccgccgtggccgtccccgctgctcctgcgaccgcgtcacctgtgacggggcctacaggcccgtgtgtgcccaggacgggcgcacgtatgacagtgattgctggcggcagcaggctgagtgccggcagcagcgtgccatccccagcaagcaccagggcccgtgtgaccaggccccgtccccatgcctcggggtgcagtgtgcatttggggcgacgtgtgctgtgaagaacgggcaggcagcgtgtgaatgcctgcaggcgtgctcgagcctctacgatcctgtgtgcggcagcgacggcgtcacatacggcagcgcgtgcgagctggaggccacggcctgtaccctcgggcgggagatccaggtggcgcgcaaaggaccctgtgaccgctgcgggcagtgccgctttggagccctgtgcgaggccgagaccgggcgctgcgtgtgcccctctgaatgcgtggctttggcccagcccgtgtgtggctccgacgggcacacgtaccccagcgagtgcatgctgcacgtgcacgcctgcacacaccagatcagcctgcacgtggcctcagctggaccctgtgagacctgtggagatgccgtgtgtgcttttggggctgtgtgctccgcagggcagtgtgtgtgtccccggtgtgagcaccccccgcccggccccgtgtgtggcagcgacggtgtcacctacggcagtgcctgcgagctacgggaagccgcctgcctccagcagacacagatcgaggaggcccgggcagggccgtgcgagcaggccgagtgcggttccggaggctctggctctggggaggacggtgactgtgagcaggagctgtgccggcagcgcggtggcatctgggacgaggactcggaggacgggccgtgtgtctgtgacttcagctgccagagtgtcccaggcagcccggtgtgcggctcagatggggtcacctacagcaccgagtgtgagctgaagaaggccaggtgtgagtcacagcgagggctctacgtagcggcccagggagcctgccgaggccccaccttcgccccgctgccgcctgtggcccccttacactgtgcccagacgccctacggctgctgccaggacaatatcaccgcagcccggggcgtgggcctggctggctgccccagtgcctgccagtgcaacccccatggctcttacggcggcacctgtgacccagccacaggccagtgctcctgccgcccaggtgtggggggcctcaggtgtgaccgctgtgagcctggcttctggaactttcgaggcatcgtcaccgatggccggagtggctgtacaccctgcagctgtgatccccaaggcgccgtgcgggatgactgtgagcagatgacggggctgtgctcgtgtaagcccggggtggctggacccaagtgtgggcagtgtccagacggccgtgccctgggccccgcgggctgtgaagctgacgcttctgcgcctgcgacctgtgcggagatgcgctgtgagttcggtgcgcggtgcgtggaggagtctggctcagcccactgtgtctgcccgatgctcacctgtccagaggccaacgctaccaaggtctgtgggtcagatggagtcacatacggcaacgagtgtcagctgaagaccatcgcctgccgccagggcctgcaaatctctatccagagcctgggcccgtgccaggaggctgttgctcccagcactcacccgacatctgcctccgtgactgtgaccaccccagggctcctcctgagccaggcactgccggccccccccggcgccctccccctggctcccagcagtaccgcacacagccagaccacccctccgccctcatcacgacctcggaccactgccagcgtccccaggaccaccgtgtggcccgtgctgacggtgccccccacggcaccctcccctgcacccagcctggtggcgtccgcctttggtgaatctggcagcactgatggaagcagcgatgaggaactgagcggggaccaggaggccagtgggggtggctctggggggctcgagcccttggagggcagcagcgtggccacccctgggccacctgtcgagagggcttcctgctacaactccgcgttgggctgctgctctgatgggaagacgccctcgctggacgcagagggctccaactgccccgccaccaaggtgttccagggcgtcctggagctggagggcgtcgagggccaggagctgttctacacgcccgagatggctgaccccaagtcagaactgttcggggagacagccaggagcattgagagcaccctggacgacctcttccggaattcagacgtcaagaaggattttcggagtgtccgcttgcgggacctggggcccggcaaatccgtccgcgccattgtggatgtgcactttgaccccaccacagccttcagggcacccgacgtggcccgggccctgctccggcagatccaggtgtccaggcgccggtccttgggggtgaggcggccgctgcaggagcacgtgcgatttatggactttgactggtttcctgcgtttatcacgggggccacgtcaggagccattgctgcgggagccacggccagagccaccactgcatcgcgcctgccgtcctctgctgtgacccctcgggccccgcaccccagtcacacaagccagcccgttgccaagaccacggcagcccccaccacacgtcggccccccaccactgcccccagccgtgtgcccggacgtcggcccccggccccccagcagcctccaaagccctgtgactcacagccctgcttccacggggggacctgccaggactgggcattgggcgggggcttcacctgcagctgcccggcaggcaggggaggcgccgtctgtgagaaggtgcttggcgcccctgtgccggccttcgagggccgctccttcctggccttccccactctccgcgcctaccacacgctgcgcctggcactggaattccgggcgctggagcctcaggggctgctgctgtacaatggcaacgcccggggcaaggacttcctggcattggcgctgctagatggccgcgtgcagctcaggtttgacacaggttcggggccggcggtgctgaccagtgccgtgccggtagagccgggccagtggcaccgcctggagctgtcccggcactggcgccggggcaccctctcggtggatggtgagacccctgttctgggcgagagtcccagtggcaccgacggcctcaacctggacacagacctctttgtgggcggcgtacccgaggaccaggctgccgtggcgctggagcggaccttcgtgggcgccggcctgagggggtgcatccgtttgctggacgtcaacaaccagcgcctggagcttggcattgggccgggggctgccacccgaggctctggcgtgggcgagtgcggggaccacccctgcctgcccaacccctgccatggcggggccccatgccagaacctggaggctggaaggttccattgccagtgcccgcccggccgcgtcggaccaacctgtgccgatgagaagagcccctgccagcccaacccctgccatggggcggcgccctgccgtgtgctgcccgagggtggtgctcagtgcgagtgccccctggggcgtgagggcaccttctgccagacagcctcggggcaggacggctctgggcccttcctggctgacttcaacggcttctcccacctggagctgagaggcctgcacacctttgcacgggacctgggggagaagatggcgctggaggtcgtgttcctggcacgaggccccagcggcctcctgctctacaacgggcagaagacggacggcaagggggacttcgtgtcgctggcactgcgggaccgccgcctggagttccgctacgacctgggcaagggggcagcggtcatcaggagcagggagccagtcaccctgggagcctggaccagggtctcactggagcgaaacggccgcaagggtgccctgcgtgtgggcgacggcccccgtgtgttgggggagtccccggttccgcacaccgtcctcaacctgaaggagccgctctacgtagggggcgctcccgacttcagcaagctggcccgtgctgctgccgtgtcctctggcttcgacggtgccatccagctggtctccctcggaggccgccagctgctgaccccggagcacgtgctgcggcaggtggacgtcacgtcctttgcaggtcacccctgcacccgggcctcaggccacccctgcctcaatggggcctcctgcgtcccgagggaggctgcctatgtgtgcctgtgtcccgggggattctcaggaccgcactgcgagaaggggctggtggagaagtcagcgggggacgtggataccttggcctttgacgggcggacctttgtcgagtacctcaacgctgtgaccgagagcgagaaggcactgcagagcaaccactttgaactgagcctgcgcactgaggccacgcaggggctggtgctctggagtggcaaggccacggagcgggcagactatgtggcactggccattgtggacgggcacctgcaactgagctacaacctgggctcccagcccgtggtgctgcgttccaccgtgcccgtcaacaccaaccgctggttgcgggtcgtggcacatagggagcagagggaaggttccctgcaggtgggcaatgaggcccctgtgaccggctcctccccgctgggcgccacgcagctggacactgatggagccctgtggcttgggggcctgccggagctgcccgtgggcccagcactgcccaaggcctacggcacaggctttgtgggctgcttgcgggacgtggtggtgggccggcacccgctgcacctgctggaggacgccgtcaccaagccagagctgcggccctgccccaccccatgagctggcaccagagccccgcgcccgctgtaattattttctatttttgtaaacttgttgctttttgatatgattttcttgcctgagtgttggccggagggactgctggcccggcctcccttccgtccaggcagccgtgctgcagacagacctagtgccgagggatggacaggcgaggtggcagcgtggagggctcggcgtggatggcagcctcaggacacacacccctgcctcaaggtgctgagcccccgccttgcactgcgcctgccccacggtgtccccgccgggaagcagccccggctcctgaatcaccctcgctccgtcaggcgggactcgtgtcccagagaggaaggggctgctgaggtctgatggggcccttcctccgggtgaccccacagggcctttccaagcccccatttgagctgctccttcctgtgtgtgctctgggccctgcctcggcctcctgcgccaatactgtgacttccaaacaatgttactgctgggcacagctctgcgttgctcccgtgctgcctgcgccagccccaggctgctgaggagcagaggccagaccagggccgatctgggtgtcctgaccctcagctggccctgcccagccaccctggacgtgaccgtatccctctgccacaccccaggccctgcgaggggctatcgagaggagctcactgtgggatggggttgacctctgccgcctgcctgggtatctgggcctggccatggctgtgttcttcatgtgttgattttatttgacccctggagtggtgggtctcatctttcccatctcgcctgagagcggctgagggctgcctcactgcaaatcctccccacagcgtcagtgaaagtcgtccttgtctcagaatgaccaggggccagccagtgtctgaccaaggtcaaggggcaggtgcagaggtggcagggatggctccgaagccagaaatgccttaaactgcaacgtcccgtcccttccccacccccatcccatccccacccccagccccagcccagtcctcctaggagcaggacccgatgaagcgggcggcggtggggctgggtgccgtgttactaactctagtatgtttctgtgtcaatcgctgtgaaataaagtctgaaaactttaaaa

SEQ ID NO: 106096 - DNA, 813 bp, Homo sapiens
  Payload ID: 799
  Gene Symbol: AGRN
  Gene Name: agrin
  ENST ID: ENST00000419249
  CDS Start-End: 1-813
ccgctacgacctgggcaagggggcagcggtcatcaggagcagggagccagtcaccctgggagcctggaccagggtctcactggagcgaaacggccgcaagggtgccctgcgtgtgggcgacggcccccgtgtgttgggggagtccccgaaatcccgcaaggttccgcacaccgtcctcaacctgaaggagccgctctacgtagggggcgctcccgacttcagcaagctggcccgtgctgctgccgtgtcctctggcttcgacggtgccatccagctggtctccctcggaggccgccagctgctgaccccggagcacgtgctgcggcaggtggacgtcacgtcctttgcaggtcacccctgcacccgggcctcaggccacccctgcctcaatggggcctcctgcgtcccgagggaggctgcctatgtgtgcctgtgtcccgggggattctcaggaccgcactgcgagaaggggctggtggagaagtcagcgggggacgtggataccttggcctttgacgggcggacctttgtcgagtacctcaacgctgtgaccgagagcgaactggccaatgagatccccgtccccgaaactctggattccggggcccttcacagcgagaaggcactgcagagcaaccactttgaactgagcctgcgcactgaggccacgcaggggctggtgctctggagtggcaaggccacggagcgggcagactatgtggcactggccattgtggacgggcacctgcaactgagctacaacctgggctcccagcccgtggtgctgcgttccaccgtgcccgtcaacaccaa

SEQ ID NO: 106097 - DNA, 7394 bp, Homo sapiens
  Payload ID: 799
  Gene Symbol: AGRN
  Gene Name: agrin
  ENST ID: ENST00000620552
  CDS Start-End: 465-6257
cccgtccccggcgcggcccgcgcgctcctccgccgcctctcgcctgcgccatggccggccggtcccacccgggcccgctgcggccgctgctgccgctccttgtggtggccgcgtgcgtcctgcccggagccggcgggacatgcccggagcgcgcgctggagcggcgcgaggaggaggcgaacgtggtgctcaccgggacggtggaggagatcctcaacgtggacccggtgcagcacacgtactcctgcaaggttcgggtctggcggtacttgaagggcaaagacctggtggcccgggagagcctgctggacggcggcaacaaggtggtgatcagcggctttggagaccccctcatctgtgacaaccaggtgtccactggggacaccaggatcttctttgtgaaccctgcacccccatacctgtggccagcccacaagaacgagctgatgctcaactccagcctcatgcggatcaccctgcggaacctggaggaggtggagttctgtgtggaagataaacccgggacccacttcactccagtgcctccgacgcctcctgatgcgtgccggggaatgctgtgcggcttcggcgccgtgtgcgagcccaacgcggaggggccgggccgggcgtcctgcgtctgcaagaagagcccgtgccccagcgtggtggcgcctgtgtgtgggtcggacgcctccacctacagcaacgaatgcgagctgcagcgggcgcagtgcagccagcagcgccgcatccgcctgctcagccgcgggccgtgcggctcgcgggacccctgctccaacgtgacctgcagcttcggcagcacctgtgcgcgctcggccgacgggctgacggcctcgtgcctgtgccccgcgacctgccgtggcgcccccgaggggaccgtctgcggcagcgacggcgccgactaccccggcgagtgccagctcctgcgccgcgcctgcgcccgccaggagaatgtcttcaagaagttcgacggcccttgtgacccctgtcagggcgccctccctgacccgagccgcagctgccgtgtgaacccgcgcacgcggcgccctgagatgctcctacggcccgagagctgccctgcccggcaggcgccagtgtgtggggacgacggagtcacctacgaaaacgactgtgtcatgggccgatcgggggccgcccggggtctcctcctgcagaaagtgcgctccggccagtgccagggtcgagaccagtgcccggagccctgccggttcaatgccgtgtgcctgtcccgccgtggccgtccccgctgctcctgcgaccgcgtcacctgtgacggggcctacaggcccgtgtgtgcccaggacgggcgcacgtatgacagtgattgctggcggcagcaggctgagtgccggcagcagcgtgccatccccagcaagcaccagggcccgtgtgaccaggccccgtccccatgcctcggggtgcagtgtgcatttggggcgacgtgtgctgtgaagaacgggcaggcagcgtgtgaatgcctgcaggcgtgctcgagcctctacgatcctgtgtgcggcagcgacggcgtcacatacggcagcgcgtgcgagctggaggccacggcctgtaccctcgggcgggagatccaggtggcgcgcaaaggaccctgtgaccgctgcgggcagtgccgctttggagccctgtgcgaggccgagaccgggcgctgcgtgtgcccctctgaatgcgtggctttggcccagcccgtgtgtggctccgacgggcacacgtaccccagcgagtgcatgctgcacgtgcacgcctgcacacaccagatcagcctgcacgtggcctcagctggaccctgtgagacctgtggagatgccgtgtgtgcttttggggctgtgtgctccgcagggcagtgtgtgtgtccccggtgtgagcaccccccgcccggccccgtgtgtggcagcgacggtgtcacctacggcagtgcctgcgagctacgggaagccgcctgcctccagcagacacagatcgaggaggcccgggcagggccgtgcgagcaggccgagtgcggttccggaggctctggctctggggaggacggtgactgtgagcaggagctgtgccggcagcgcggtggcatctgggacgaggactcggaggacgggccgtgtgtctgtgacttcagctgccagagtgtcccaggcagcccggtgtgcggctcagatggggtcacctacagcaccgagtgtgagctgaagaaggccaggtgtgagtcacagcgagggctctacgtagcggcccagggagcctgccgaggccccaccttcgccccgctgccgcctgtggcccccttacactgtgcccagacgccctacggctgctgccaggacaatatcaccgcagcccggggcgtgggcctggctggctgccccagtgcctgccagtgcaacccccatggctcttacggcggcacctgtgacccagccacaggccagtgctcctgccgcccaggtgtggggggcctcaggtgtgaccgctgtgagcctggcttctggaactttcgaggcatcgtcaccgatggccggagtggctgtacaccctgcagctgtgatccccaaggcgccgtgcgggatgactgtgagcagatgacggggctgtgctcgtgtaagcccggggtggctggacccaagtgtgggcagtgtccagacggccgtgccctgggccccgcgggctgtgaagctgacgcttctgcgcctgcgacctgtgcggagatgcgctgtgagttcggtgcgcggtgcgtggaggagtctggctcagcccactgtgtctgcccgatgctcacctgtccagaggccaacgctaccaaggtctgtgggtcagatggagtcacatacggcaacgagtgtcagctgaagaccatcgcctgccgccagggcctgcaaatctctatccagagcctgggcccgtgccaggaggctgttgctcccagcactcacccgacatctgcctccgtgactgtgaccaccccagggctcctcctgagccaggcactgccggccccccccggcgccctccccctggctcccagcagtaccgcacacagccagaccacccctccgccctcatcacgacctcggaccactgccagcgtccccaggaccaccgtgtggcccgtgctgacggtgccccccacggcaccctcccctgcacccagcctggtggcgtccgcctttggtgaatctggcagcactgatggaagcagcgatgaggaactgagcggggaccaggaggccagtgggggtggctctggggggctcgagcccttggagggcagcagcgtggccacccctgggccacctgtcgagagggcttcctgctacaactccgcgttgggctgctgctctgatgggaagacgccctcgctggacgcagagggctccaactgccccgccaccaaggtgttccagggcgtcctggagctggagggcgtcgagggccaggagctgttctacacgcccgagatggctgaccccaagtcagaactgttcggggagacagccaggagcattgagagcaccctggacgacctcttccggaattcagacgtcaagaaggattttcggagtgtccgcttgcgggacctggggcccggcaaatccgtccgcgccattgtggatgtgcactttgaccccaccacagccttcagggcacccgacgtggcccgggccctgctccggcagatccaggtgtccaggcgccggtccttgggggtgaggcggccgctgcaggagcacgtgcgatttatggactttgactggtttcctgcgtttatcacgggggccacgtcaggagccattgctgcgggagccacggccagagccaccactgcatcgcgcctgccgtcctctgctgtgacccctcgggccccgcaccccagtcacacaagccagcccgttgccaagaccacggcagcccccaccacacgtcggccccccaccactgcccccagccgtgtgcccggacgtcggcccccggccccccagcagcctccaaagccctgtgactcacagccctgcttccacggggggacctgccaggactgggcattgggcgggggcttcacctgcagctgcccggcaggcaggggaggcgccgtctgtgagaaggtgcttggcgcccctgtgccggccttcgagggccgctccttcctggccttccccactctccgcgcctaccacacgctgcgcctggcactggaattccgggcgctggagcctcaggggctgctgctgtacaatggcaacgcccggggcaaggacttcctggcattggcgctgctagatggccgcgtgcagctcaggtttgacacaggttcggggccggcggtgctgaccagtgccgtgccggtagagccgggccagtggcaccgcctggagctgtcccggcactggcgccggggcaccctctcggtggatggtgagacccctgttctgggcgagagtcccagtggcaccgacggcctcaacctggacacagacctctttgtgggcggcgtacccgaggaccaggctgccgtggcgctggagcggaccttcgtgggcgccggcctgagggggtgcatccgtttgctggacgtcaacaaccagcgcctggagcttggcattgggccgggggctgccacccgaggctctggcgtgggcgagtgcggggaccacccctgcctgcccaacccctgccatggcggggccccatgccagaacctggaggctggaaggttccattgccagtgcccgcccggccgcgtcggaccaacctgtgccgatgagaagagcccctgccagcccaacccctgccatggggcggcgccctgccgtgtgctgcccgagggtggtgctcagtgcgagtgccccctggggcgtgagggcaccttctgccagacagcctcggggcaggacggctctgggcccttcctggctgacttcaacggcttctcccacctggagctgagaggcctgcacacctttgcacgggacctgggggagaagatggcgctggaggtcgtgttcctggcacgaggccccagcggcctcctgctctacaacgggcagaagacggacggcaagggggacttcgtgtcgctggcactgcgggaccgccgcctggagttccgctacgacctgggcaagggggcagcggtcatcaggagcagggagccagtcaccctgggagcctggaccagggtctcactggagcgaaacggccgcaagggtgccctgcgtgtgggcgacggcccccgtgtgttgggggagtccccgaaatcccgcaaggttccgcacaccgtcctcaacctgaaggagccgctctacgtagggggcgctcccgacttcagcaagctggcccgtgctgctgccgtgtcctctggcttcgacggtgccatccagctggtctccctcggaggccgccagctgctgaccccggagcacgtgctgcggcaggtggacgtcacgtcctttgcaggtcacccctgcacccgggcctcaggccacccctgcctcaatggggcctcctgcgtcccgagggaggctgcctatgtgtgcctgtgtcccgggggattctcaggaccgcactgcgagaaggggctggtggagaagtcagcgggggacgtggataccttggcctttgacgggcggacctttgtcgagtacctcaacgctgtgaccgagagcgaactggccaatgagatccccgtccccgaaactctggattccggggcccttcacagcgagaaggcactgcagagcaaccactttgaactgagcctgcgcactgaggccacgcaggggctggtgctctggagtggcaaggccacggagcgggcagactatgtggcactggccattgtggacgggcacctgcaactgagctacaacctgggctcccagcccgtggtgctgcgttccaccgtgcccgtcaacaccaaccgctggttgcgggtcgtggcacatagggagcagagggaaggttccctgcaggtgggcaatgaggcccctgtgaccggctcctccccgctgggcgccacgcagctggacactgatggagccctgtggcttgggggcctgccggagctgcccgtgggcccagcactgcccaaggcctacggcacaggctttgtgggctgcttgcgggacgtggtggtgggccggcacccgctgcacctgctggaggacgccgtcaccaagccagagctgcggccctgccccaccccatgagctggcaccagagccccgcgcccgctgtaattattttctatttttgtaaacttgttgctttttgatatgattttcttgcctgagtgttggccggagggactgctggcccggcctcccttccgtccaggcagccgtgctgcagacagacctagtgccgagggatggacaggcgaggtggcagcgtggagggctcggcgtggatggcagcctcaggacacacacccctgcctcaaggtgctgagcccccgccttgcactgcgcctgccccacggtgtccccgccgggaagcagccccggctcctgaatcaccctcgctccgtcaggcgggactcgtgtcccagagaggaaggggctgctgaggtctgatggggcccttcctccgggtgaccccacagggcctttccaagcccccatttgagctgctccttcctgtgtgtgctctgggccctgcctcggcctcctgcgccaatactgtgacttccaaacaatgttactgctgggcacagctctgcgttgctcccgtgctgcctgcgccagccccaggctgctgaggagcagaggccagaccagggccgatctgggtgtcctgaccctcagctggccctgcccagccaccctggacgtgaccgtatccctctgccacaccccaggccctgcgaggggctatcgagaggagctcactgtgggatggggttgacctctgccgcctgcctgggtatctgggcctggccatggctgtgttcttcatgtgttgattttatttgacccctggagtggtgggtctcatctttcccatctcgcctgagagcggctgagggctgcctcactgcaaatcctccccacagcgtcagtgaaagtcgtccttgtctcagaatgaccaggggccagccagtgtctgaccaaggtcaaggggcaggtgcagaggtggcagggatggctccgaagccagaaatgccttaaactgcaacgtcccgtcccttccccacccccatcccatccccacccccagccccagcccagtcctcctaggagcaggacccgatgaagcgggcggcggtggggctgggtgccgtgttactaactctagtatgtttctgtgtcaatcgctgtgaaataaagtctgaaaactttaaaagc

SEQ ID NO: 106098 - DNA, 1402 bp, Homo sapiens
  Payload ID: 800
  Gene Symbol: AHSA1
  Gene Name: AHA1, activator of heat shock 90kDa protein ATPase homolog 1 (yeast)
  Uniprot ID: O95433
  ENST ID: ENST00000216479
  CDS Start-End: 161-1177
ggaagttaaggaggggagggggtggagggaaaagcaagccaggaggtgcttgcggccgcttctagtagtttccaggcgctgccgggcggctggcactaagcggtcctgaggctgtggctacggctgctccggagctggtggcgccgcgataggagagccgatggccaagtggggtgagggagacccacgctggatcgtggaggagcgggcggacgccaccaacgtcaacaactggcactggacggagagagatgcttcaaattggtccacggataagctgaaaacactgttcctggcagtgcaggttcaaaatgaagaaggcaagtgtgaggtgacggaagtgagtaagcttgatggagaggcatccattaacaatcgcaaagggaaacttatcttcttttatgaatggagcgtcaaactaaactggacaggtacttctaagtcaggagtacaatacaaaggacatgtggagatccccaatttgtctgatgaaaacagcgtggatgaagtggagattagtgtgagccttgccaaagatgagcctgacacaaatctcgtggccttaatgaaggaagaaggggtgaaacttctaagagaagcaatgggaatttacatcagcaccctcaaaacagagttcacccagggcatgatcttacctacaatgaatggagagtcagtagacccagtggggcagccagcactgaaaactgaggagcgcaaggctaagcctgctccttcaaaaacccaggccagacctgttggagtcaaaatccccacttgtaagatcactcttaaggaaaccttcctgacgtcaccagaggagctctatagagtgtttaccacccaagagctggtgcaggcctttacccatgctcctgcaacattagaagcagacagaggtggaaagttccacatggtagatggcaacgtctctggggaatttactgatctggtccctgagaaacatattgtgatgaagtggaggtttaaatcttggccagagggacactttgccaccatcaccttgaccttcatcgacaagaacggagagactgagctgtgcatggaaggtcgaggcatccctgctcctgaggaagagcggacgcgacagggctggcagcggtactactttgagggcattaaacagacctttggctatggcgcacgcttattttagggccagcggcaggggactccagcctgctggacacttcagtccagctctctcctgactggggcttgcgactcacaggattgcatcgtcccagctgctaacttggggccggggcccctcccttccacatataccttgggtttgtgcatgttttctgctgggtgggttcagagggcaatttctcttttatgtgtacatatgctaaataaacataatttaaaaaacatg

SEQ ID NO: 106099 - DNA, 1173 bp, Homo sapiens
  Payload ID: 800
  Gene Symbol: AHSA1
  Gene Name: AHA1, activator of heat shock 90kDa protein ATPase homolog 1 (yeast)
  Uniprot ID: O95433
  ENST ID: ENST00000535854
  CDS Start-End: 159-1025
aagttaaggaggggagggggtggagggaaaagcaagccaggaggtgcttgcggccgcttctagtagtttccaggcgctgccgggcggctggcactaagcggtcctgaggctgtggctacggctgctccggagctggtggcgccgcgataggagagccgatggccaagtggggtgagggagacccacgctggatcgtggaggagcgggcggacgccaccaacgtcaacaactggcactggacggagagagatgcttcaaattggtccacggataagctgaaaacactgttcctggcagtgcaggttcaaaatgaagaaggcaagtgtgaggtgacggaagtgagtaagcttgatggagaggcatccattaacaatcgcaaagggaaacttatcttcttttatgaatggagcgtcaaactaaactggacaggtacttctaagtcaggagtacaatacaaaggacatgtggagatccccaatttgtctgatgaaaacagcgtggatgaagtggagattagtgtgagccttgccaaagatgagcctgacacaaatctcgtggccttaatgaaggaagaaggggtgaaacttctaagagaagcaatgggaatttacatcagcaccctcaaaacagagttcacccagggcatgatcttacctacaatgaatggagagtcagtagacccagtggggcagccagcactgaaaactgaggagcgcaaggctaagcctgctccttcaaaaacccaggccagacctgttggagtcaaaatccccacttgtaagatcactcttaaggaaaccttcctgacgtcaccagaggagctctatagagtgtttaccacccaagagctggtgcaggcctttacccatgctcctgcaacattagaagcagacagaggtggaaagttccacatggtagatggcaacgtctctggggaatttactgatctggtccctgagaaacatattgtgatgaagtggaggtttaaatcttggccagaggggtctcactgtcactcaggctagagtgcagtggcataatcacagcaaactgcagccttaacctcccagacccaaacgatcctcctgcttcagcttcccaagtagctgagactacgtgtgccaccatgccagcttttttttttttttttttttttttacttttttacttttt

SEQ ID NO: 106100 - DNA, 849 bp, Homo sapiens
  Payload ID: 800
  Gene Symbol: AHSA1
  Gene Name: AHA1, activator of heat shock 90kDa protein ATPase homolog 1 (yeast)
  ENST ID: ENST00000556369
  CDS Start-End: 1-271
tgttggagtcaaaatccccacttgtaagatcactcttaaggaaaccttcctgacgtcaccagaggagctctatagagtgtttaccacccaagagctggtgcaggcctttacccatgctcctgcaacattagaagcagacagaggtggaaagttccacatggtagatggcaacgtctctggggaatttactgatctggtccctgagaaacatattgtgatgaagtggaggtttaaatcttggccagaggggtctcactgtcactcaggctagagtgcagtggcataatcacagcaaactgcagccttaacctcccagacccaaacgatcctcctgcttcagcttcccaatgctgggattacaggtgtgagccaccacgcccagccaggttgccccagtcttaaactcagatggaaacctagatatgaaacctccgtcccctctgcctttcccaggacactttgccaccatcaccttgaccttcatcgacaagaacggagagactgagctgtgcatggaaggtcgaggcatccctgctcctgaggaagagcggacgcgacagggctggcagcggtactactttgagggcattaaacagacctttggctatggcgcacgcttattttagggccagcggcaggggactccagcctgctggacacttcagtccagctctctcctgactggggcttgcgactcacaggattgcatcgtcccagctgctaacttggggccggggcccctcccttccacatataccttgggtttgtgcatgttttctgctgggtgggttcagagggcaatttctcttttatgtgtacatatgctaaataaacataatttaaaaaaca

SEQ ID NO: 106101 - DNA, 832 bp, Homo sapiens
  Payload ID: 800
  Gene Symbol: AHSA1
  Gene Name: AHA1, activator of heat shock 90kDa protein ATPase homolog 1 (yeast)
  ENST ID: ENST00000555517
  CDS Start-End: 154-456
aaggaggggagggggtggagggaaaagcaagccaggaggtgcttgcggccgcttctagtagtttccaggcgctgccgggcggctggcactaagcggtcctgaggctgtggctacggctgctccggagctggtggcgccgcgataggagagccgatggccaagtggggtgagggagacccacgctggatcgtggaggagcgggcggacgccaccaacgtcaacaactggcactggacggagagagatgcttcaaattggtccacggataagctgaaaacactgttcctggcagtgcaggttcaaaatgaagaaggcaagtgtgaggtgacggaagtgagtaagcttgatggagaggcatccattaacaatcgcaaagggaaacttatcttcttttatgaatggagcgtcaaactaaactggacaggtaagtctaagctgggctgtcagagagattaactgtgttttgtttaacctgttaagtagctggagagaacagttttgaggagttacagaccttgaagggagaaggcagatgttgctgctttggagtcctatgtaaagcagtatcgagtcctggaatttctttgccattgtgggatgctaaatggatttcctgtgtctgggtctcataagtcccatccatgaagtggccgggccactgcatctttgggccttggtctttgttgggacacctacgatgatatttcttcagactagctacatgtatcttgtgagtgatttaaaaggaggaaggagaggatttttttggtcttgatctttgtgcactgtcttcagtgtgaatcttaacagattaaaccactgcgctaatgaa

SEQ ID NO: 106102 - DNA, 763 bp, Homo sapiens
  Payload ID: 800
  Gene Symbol: AHSA1
  Gene Name: AHA1, activator of heat shock 90kDa protein ATPase homolog 1 (yeast)
  ENST ID: ENST00000553374
  CDS Start-End: 1-649
gtgtgaggtgacggaagtgagtaagcttgatggagaggcatccattaacaatcgcaaagggaaacttatcttcttttatgaatggagcgtcaaactaaactggacaggtacttctaagtcaggagtacaatacaaaggacatgtggagatccccaatttgtctgatgaaaacagcgtggatgaagtggagattagtgtgagccttgccaaagatgagcctgacacaaatctcgtggccttaatgaaggaagaaggggtgaaacttctaagagaagcaatgggaatttacatcagcaccctcaaaacagagttcacccagggcatgatcttacctacaatgaatggagagtcagtagacccagtggggcagccagcactgaaaactgaggagcgcaaggctaagcctgctccttcaaaaacccaggccagacctgttggagtcaaaatccccacttgtaagatcactcttaaggaaaccttcctgacgtcaccagaggagctctatagagtgtttaccacccaagagctggtgcaggcctttacccatgctcctgcaacattagaagcagacagaggtggaaagttccacatggtagatggcaacgtctctggggaatttactgatctggtgagtacctgccggccctagactcaggttattgcctctggtcagatgagtgacatttctctttttctgaactctataggtaaaatgtaaggctttaatctctttgttaataaaacattttgtttttcaaaaaaa

SEQ ID NO: 106103 - DNA, 1048 bp, Homo sapiens
  Payload ID: 800
  Gene Symbol: AHSA1
  Gene Name: AHA1, activator of heat shock 90kDa protein ATPase homolog 1 (yeast)
  ENST ID: ENST00000555133
  CDS Start-End: 439-1048
ttctttgttttcctatgggtgaggaatggttgtatgagcagttgggtttcgggacgctttttggggagaacccgatggagtctgaaggatctctaaatcaggcggaacccacggacggagagagatgcttcaaattggtccacggataagctgaaaacactgttcctggcagtgcaggttcaaaatgaagaaggcaagtgtgaggtgacggaagtgagtaagcttgatggagaggcatccattaacaatcgcaaagggaaacttatcttcttttatgaatggagcgtcaaactaaactggacaggtacttctaagtcaggagtacaatacaaaggacatgtggagatccccaatttgtctgatgaaaacagcgtggatgaagtggagattagtgtgagccttgccaaagatgagcctgacacaaatctcgtggccttaatgaaggaagaaggggtgaaacttctaagagaagcaatgggaatttacatcagcaccctcaaaacagagttcacccagggcatgatcttacctacaatgaatggagagtcagtagacccagtggggcagccagcactgaaaactgaggagcgcaaggctaagcctgctccttcaaaaacccaggccagacctgttggagtcaaaatccccacttgtaagatcactcttaaggaaaccttcctgacgtcaccagaggagctctatagagtgtttaccacccaagagctggtgcaggcctttacccatgctcctgcaacattagaagcagacagaggtggaaagttccacatggtagatggcaacgtctctggggaatttactgatctggtccctgagaaacatattgtgatgaagtggaggtttaaatcttggccagagggacactttgccaccatcaccttgaccttcatcgacaagaacggagagactgagctgtgcatggaaggtcgaggcatccctgctcctgaggaagagcggacgcgacagggctggcagcggtactactttgagggcattaaacagacctttggctatggcgcacgcttatttt

SEQ ID NO: 106104 - DNA, 621 bp, Homo sapiens
  Payload ID: 800
  Gene Symbol: AHSA1
  Gene Name: AHA1, activator of heat shock 90kDa protein ATPase homolog 1 (yeast)
  ENST ID: ENST00000555729
  CDS Start-End: 1-400
atggagcgtcaaactaaactggacaggtacttctaagtcaggagtacaatacaaaggacatgtggagatccccaatttgtctgatgaaaacagcgtggatgaagtggagattagtgtgagccttgccaaagatgagcctgacacaaatctcgtggccttaatgaaggaagaaggggtgaaacttctaagagaagcaatgggaatttacatcagcaccctcaaaacaggacactttgccaccatcaccttgaccttcatcgacaagaacggagagactgagctgtgcatggaaggtcgaggcatccctgctcctgaggaagagcggacgcgacagggctggcagcggtactactttgagggcattaaacagacctttggctatggcgcacgcttattttagggccagcggcaggggactccagcctgctggacacttcagtccagctctctcctgactggggcttgcgactcacaggattgcatcgtcccagctgctaacttggggccggggcccctcccttccacatataccttgggtttgtgcatgttttctgctgggtgggttcagagggcaatttctcttttatgtgtacatatgctaaataaacataatttaaaaaa

SEQ ID NO: 106105 - DNA, 2437 bp, Homo sapiens
  Payload ID: 801
  Gene Symbol: AHSA2
  Gene Name: AHA1, activator of heat shock 90kDa protein ATPase homolog 2 (yeast)
  Uniprot ID: Q719I0
  ENST ID: ENST00000357022
  CDS Start-End: 1259-1672
gccttctggcagtttctgggagctgcgaacgcgccgccccggggctcggcggccggaaacgctggcttcggagccttaggcgccgcggcctttccttgttttccgcccagtccacgccgccatggccaagtggggccaggggaacccccactggatcgtggaggagcgggaggacgggaccaacgtgaacaactggcgctggcgcggctggcggcggcctccttccgggatctggggagggccgggccgcgggagccggggctgccctggggtctgtgcggggccgcggggccagggggtcagggggccgccccccctcagctgctggacgcagggctcggccttcgcctctcggctcgggagagtccttgagtacggagaccggctaggagggttgcagctgcctctttttgaaagttgggttgggccccaagagtgacttccgacagacctttccactcccaccgtctgtggcctgagggccttcccttctcctcccgcccacccctctggatgtttcggggagttagaagggagctggattgagagactgtgttaggggcgggggtatggaacgtagtggaaagggcagaaatttggatctcagttcgcgcccaccccgcaggcgcctcccgcgagccgggccctctgtgagtgagacaagctccccttcctttacgcgcctcacctggcgcgtggggagaggtcggcagccctccgccgcagaacctccggaagggatgtcctctgccctgcgcctctggccggggctgtggtccctccaggccgtcgaggggatgctgaggccggtccccagaggagcatgacttggctggtccggaggagctctgagggcatgggcaatcttggctcgctgcaacctcagcttccagagttcaagcgagtctcctgcttcagcctcatgagtagctgggactacagatgcgtgccactacgtccgtctgatgacagagcgggatgccaccagcttgtccaaagggaagttccaggagctcctggtgggcatcgttgtggagaatgacgctggccgcggcgagatcaacgagttgaagcaggtggaaggggaggcttcgtgcagcagccgcaaaggaaagctgattttcttctatgagtggaacatcaaactgggctggaaaggcatcgttaaagaatctggagtgaagcacaagggattgattgaaatacccaatctttctgaggaaaatgaagtagatgacactgagaatttacaacgggaatgattttaccaacgaaagctatggcaacccaggaattgactgtcaaaagaaaactgagtgggaataccctgcaggttcaggcctcatctccagtggcactgggtgtaaggattcccactgtggctcttcacatgatggaactgtttgacacaactgtagagcagctgtatagcatcttcactgtaaaggagttaacaaataagaagatcatcatgaaatggagatgtgggaactggccagaagaacactatgccatggttgcactgaattttgtgcctactctagggcaaacagaattacaattgaaggagttcctatctatctgtaaagaagagaacatgaaattctgttggcagaagcagcattttgaagaaataaaaggttcactgcagctgacccccctaaatggttgaattaaaatttattataaggcattactttttgtaagcggaaaaagtgtcacatttacctcttccctatcttttgtttaaaaggactgtctttattttatattggatgaaatctatgaacatatatacaatgtaaagcattgtttgactctttattataactagacactgcattgatttaaaagtagcaaacaacctgaaattaagtattaacctgaccttccatcgatattcctctggaaataggtaagtcctgagtgcagatagttgatgtttcccaagctgaagcttgtcctatagcaagcttgcttgcagctgtacttttagttcaagatgacaaaaaataaatggcatgttgacactattcctttattttactttagggtttttaaggtgtgtagatcttaggtcgtaaaacagtggtatattgcattcaaaagcatgttgaggtgagggcaaattggctgtgttttgctccacatctccctgcacatctccctgctgtggttttgcacttcggtgtggagaggattgagaagtctgtggggacacattagttctgtggactgctggtaacacttccagtgaaacagcatataatggataaatgtttcccccctctttcacggttttctcactactttcacctgagaagactgaagcaacgtatgtaaacaaatgaaaagtcatcacaatcagtttaattaagtgcacagaatagcaatcaatcaatcagtcatgtcaataaaaataaaacaattattttta

SEQ ID NO: 106106 - DNA, 6574 bp, Homo sapiens
  Payload ID: 801
  Gene Symbol: AHSA2
  Gene Name: AHA1, activator of heat shock 90kDa protein ATPase homolog 2 (yeast)
  Uniprot ID: Q719I0
  ENST ID: ENST00000394457
  CDS Start-End: 1744-2157
ccacgccgccatggccaagtggggccaggggaacccccactggatcgtggaggagcgggaggacgggaccaacgtgaacaactggcgctggcgcggctggcggcggcctccttccgggatctggggagggccgggccgcgggagccggggctgccctggggtctgtgcggggccgcggggccagggggtcagggggccgccccccctcagctgctggacgcagggctcggccttcgcctctcggctcgggagagtccttgagtacggagaccggctaggagggttgcagctgcctctttttgaaagttgggttgggccccaagagtgacttccgacagacctttccactcccaccgtctgtggcctgagggccttcccttctcctcccgcccacccctctggatgtttcggggagttagaagggagctggattgagagactgtgttaggggcgggggtatggaacgtagtggaaagggcagaaatttggatctcagttcgcgcccaccccgcaggcgcctcccgcgagccgggccctctgtgagtgagacaagctccccttcctttacgcgcctcacctggcgcgtggggagaggtcggcagccctccgccgcagaacctccggaagggatgtcctctgccctgcgcctctggccggggctgtggtccctccaggccgtcgaggggatgctgaggccggtccccagaggagcatgacttggctggtccggaggagctctgagggcatgggcaatcttggctcgctgcaacctcagcttccagagttcaagcgagtctcctgcttcagcctcatgagtagctgggactacagatgcgtgccactacgtccgtctgatgtttgtatttttagtagagacagggtttcaccatgttggtcaggctgctctcgaactccagatctcgtgatccgcccgcctgggcctactaaagtgctgggattacaggcgtgagctagatctgactttctagtgtcctagccttggcccgatggacatgtcatttctctcagctcgtttctgtcccctaaagtgagaatattgcctgggaagattacattagacgatgtatatgcgaagacacttgatagctggtattgtcatgattctgattagttcactactgctactttccctgtggcctaggctttgcctatttccagtgggcgagctagctagatcctcctcccttaaataagccagtgtttttaagacagaatactacttgcatagtggacaataatatcttaaagaactgagcaggatgaaaagaatttgatagaaagcaggtttgaggagcacattggaggttggcaggtttcgaggctgcttgagaggacttgggccgatctgggctgggcttggacgtgaccctggcacccaggcaggtggatcccagctggggcttccattcacgactttctggtccctggcaggacagagcgggatgccaccagcttgtccaaagggaagttccaggagctcctggtgggcatcgttgtggagaatgacgctggccgcggcgagatcaacgagttgaagcaggtggaaggggaggcttcgtgcagcagccgcaaaggaaagctgattttcttctatgagtggaacatcaaactgggctggaaaggcatcgttaaagaatctggagtgaagcacaagggattgattgaaatacccaatctttctgaggaaaatgaagtagatgacactgagaatttacaacgggaatgattttaccaacgaaagctatggcaacccaggaattgactgtcaaaagaaaactgagtgggaataccctgcaggttcaggcctcatctccagtggcactgggtgtaaggattcccactgtggctcttcacatgatggaactgtttgacacaactgtagagcagctgtatagcatcttcactgtaaaggagttaacaaataagaagatcatcatgaaatggagatgtgggaactggccagaagaacactatgccatggttgcactgaattttgtgcctactctagggcaaacagaattacaattgaaggagttcctatctatctgtaaagaagagaacatgaaattctgttggcagaagcagcattttgaagaaataaaaggttcactgcagctgacccccctaaatggttgaattaaaatttattataaggcattactttttgtaagcggaaaaagtgtcacatttacctcttccctatcttttgtttaaaaggactgtctttattttatattggatgaaatctatgaacatatatacaatgtaaagcattgtttgactctttattataactagacactgcattgatttaaaagtagcaaacaacctgaaattaagtattaacctgaccttccatcgatattcctctggaaataggtaagtcctgagtgcagatagttgatgtttcccaagctgaagcttgtcctatagcaagcttgcttgcagctgtacttttagttcaagatgacaaaaaataaatggcatgttgacactattcctttattttactttagggtttttaaggtgtgtagatcttaggtcgtaaaacagtggtatattgcattcaaaagcatgttgaggtgagggcaaattggctgtgttttgctccacatctccctgcacatctccctgctgtggttttgcacttcggtgtggagaggattgagaagtctgtggggacacattagttctgtggactgctggtaacacttccagtgaaacagcatataatggataaatgtttcccccctctttcacggttttctcactactttcacctgagaagactgaagcaacgtatgtaaacaaatgaaaagtcatcacaatcagtttaattaagtgcacagaatagcaatcaatcaatcagtcatgtcaataaaaataaaacaattatttttacatcaagtgtgctttatttcctccacaggtattctgttaaataaagcaccatttatatactgccaggccacagctaaagaggattctttacagaatcaaatttcttgtggttgttccgtatacaagtaaacttaattttgataataagaaccacagcgatcggaggcaatctgcctctataaggtacaaaactggcacagaggacaccatatcatacacagtaaaaatgctgtaagtttaaattacattgtacagggctaggcaaccctgttcttcccagacagccatattaaatgaaagccactaaagtgaactcttaattacataaaacatatccattatctgattgccctttaggaagtatactgaagatgcaagtttttttcatctggagttctgcctgaccaagaattaagcctataaatctatcttgccattcaagcagagagcactggacaaactgaagcacaaaaacaaataagcaaaacttatacaaacagcatgggggttgggggtgagggacttaaaagtagacatgctacacctaatgtcaagaagcagcttggtttcctttgccagatatccttgtgacgacatggattgtagattcaatggtcctacacagggtatctaaaatgtcatgttgctgcatatgactaaagagtcctctggaatggccacaactgagagataaagcaacctcagggtcctgggagggcaaagcttggccatcacagcttctcaagtcagctaagtcagacagaactgcagagatagaagtagaagggaactcagattcttcctcagctagggtagaatccttggaacagtggaggtctttaaattctttacaatcgtcatatctaccattgttggactgttcttctgcatgctgtgacctgatatttgacatgtcttctgaaaacgaagatggaacttccattcggtattctttaacagaactattttcaggggaaggaagatcttgctcagttcctggatcaataattgaggagtctctggtctcattgtcagaagtgctcgttggggtcaggacctccctggtttctgttttcatgtcactgatgcagctgtctacagtgtgctcctcatcactgctaacacgccgccttttaatgggagttgctccttcatcatctgtgaaaacacatgccaaaagggaaacttctctgaaagtcattaagatcacgttagggggggatgtgggaagttaattttgtttctagcatttatatttaggaggttcagctgaacacacaactcttaaaccagttacaccaagtgtattactccctcctcccaccctaaaggtaatgatagtagtccataaagctaacctttagtttttctttctttggcttcttgctcttggagtgagtttctctgttgcagacaagtcctgcatttgcttaaaagctcttgcagagttggaattagagctgggtttaactgtttgggagtgtgtactgacaggagcaaagcgagtgccctcaggtcctacaaaaacccagataggaacatttcaaattctaaagccaacactttgatgcagttgtttacagttaattgcagatgtttattttcccaggaatccattctttcctaagaataccctggtttctctgggattcttagaatgataaaaccagaaagccagtgttaagatactacagcatttcattagttgttttttttttttgttttgtttttgttttttttgagatggagtcttgttctttggcaaggctggagtgcagtggtgtaatctcggctcgctgcaacctccaccacccgggttcaagcgattcccctccctcagcctcccaagtagctgggactacaggcgcccgccaccacgcctggcttaattttttctattttagtagagacagggtttcaccatgttggccattgagatggtctcaatctcctgacctcgttatccaccggcctcgacctcccaaaatgcttggattgcaggcatgagccaccgtgcccagcctcattagttcttaaagtcactaatagcattattttatgcccacgaaccagtaagtcagaccaaagcctgaaatagtgttttctgaaaaatggaaaaggaaatataagaattttaaaaacaaaccttgaaatcagtttctcaagttaaaattctgatggatgtcacaaatagtaaggtcttccttactgagctctgtcatctgttttggcttttatgcatactgtgatttgggaggctgctgctcaacattctagcccatttccagagtgttccattattctaggacatggctgtcatgggagtctgcacaaggcaactaatgctctagatttaactgccttttttaaatcagtagatcattaattgtttcagttacataggagccataggcagtaatagaaacatcacaagtattgtttccaaaaatatacccaactagagataagaccactaagatgttccctttattacctttcagcatttaatgataccagcttgtagcttccaaggtgatagagtgtgctgtgtacatacaaggcatagtaaacgtgtatttaaaacttgtttttttgtcgcacatggcttaagagtttgaatcagtaagttaaagttacgagagtaaaatcatatgaaggccacacagttaactgaaggacagtttaaaagtgtgtgccgccgcctctgcatagttcttaccccatttaaagaagcacttgctttggaaatttcaactcggttggagaaatcagactgtaggttctgatactggcttatcaagtttgtaataagagtgctgatcaaattggcacagtttgcttcagaaaacacttgactttgaacctgaaaaagaagatttaaaaaaatctccaaaagaccagcataatgaaaccacaagcattaactaattagaaatgacacactgagtttccaaagtactacgtacctttagaaggaaatgtgtcatgaacgtgtagacaatgttgttgtttaaaaaagttctttcatccattaggatacatttaatatattctgcgaaaacaggatcttcacacaaaagcttgatgcagttttttgacatagcagactaaagtggggagaagatggttgagcacttacggttgagcacggaaaaaacttacacggaaaaaacttacacagaaaaaacatacacttgtgtatgatggaatctgaagccactgaaaatcctacttgaaaagccatgtctaactcacctattgaatttttagttaacagcaactatttttcatacagtaaaatgttactaatttagattaagggagtgctgggggaagacactgatgccgaaactgaacaaatgttttaaaagaaatgcaggtttattatccagcactgagagagttaacaaggactggaaaaataaggctaacaaagaataggatgtgaatgttttcaagggccaaattaatgtatttataggtaaccagagcatatgttgcaaaaagacacattttaagaatcaaaatcaattctccaaaatgttttaaactttactgtatattctcgctagcaacagtaattctgtaaataccttttccccccataaacactgcaagggtaaacaataaatcttctttcctaattatctca

SEQ ID NO: 106107 - DNA, 479 bp, Homo sapiens
  Payload ID: 801
  Gene Symbol: AHSA2
  Gene Name: AHA1, activator of heat shock 90kDa protein ATPase homolog 2 (yeast)
  ENST ID: ENST00000410073
  CDS Start-End: 15-455
aatttacaacgggaatgattttaccaacgaaagctatggcaacccaggaattgactgtcaaaagaaaactgagtgggaataccctgcaggttcaggcctcatctccagtggcactgggtgtaaggattcccactgtggctcttcacatgatggaactgtttgacacaactgtagagcagctgtatagcatcttcactgtaaaggaggaagagagagtttgtgttttattttctttaacaaataagaagatcatcatgaaatggagatgtgggaactggccagaagaacactatgccatggttgcactgaattttgtgcctactctagggcaaacagaattacaattgaaggagttcctatctatctgtaaagaagagaacatgaaattctgttggcagaagcagcattttgaagaaataaaaggttcactgcagctgacccccctaaatggttgaattaaaatttattataaggcatta

SEQ ID NO: 106108 - DNA, 1024 bp, Homo sapiens
  Payload ID: 802
  Gene Symbol: AHNAK
  Gene Name: AHNAK nucleoprotein
  Uniprot ID: Q09666
  ENST ID: ENST00000257247
  CDS Start-End: 237-686
agctgctctgccgcggggactgcaccgcccgccctgccagacccgcccggaacggggctcgtcgccgccagtagccgcagcaccgcagccttgggcctcgcgccggctatggccgtgccctggggctgagccctcaggttgtgaccgagattcccgacgagagagactgaggggaagagaggaaggaggggcgggctcctggcaaggcattcgctcctgagcggaatcctgcaaagatggagaaggaggagacaacccgggagctgctgctgcccaactggcagggtagtggctcccacgggctgaccatcgcccagagggacgacggcgtctttgtgcaggaggtgacgcagaactcccctgcggcccgcactggggtggtcaaggagggggaccagattgtgggtgccaccatctactttgacaacctgcagtcgggtgaggtgacccagctgctgaacaccatggggcaccacacggtgggcctgaagctgcaccgcaagggggaccgctctcccgagcctggccagacctggacccgtgaagtcttcagctcctgcagctctgaagtggttctgaacacaccacagccatcagcactggaatgcaaagaccagaacaaacagaaggaagccagcagccaagccggggcagtttcagtctccaccccaaatgcaggactgtagaagcggccaggaagaaaaccaccccctcttaaggttgtttttgtgaccgttctttggagcattgttctaaaaatgggaaattacatattgctgtgccaagggcaacaaacacctgcagttaaaggaataccttccgcgaggcggcttttcggagcatgcatgtttatagctccagccaggccagaccgagggctgctgcataagccctgcttggtgcatttctttacttgcaaggggacagagtgtgggcttaggtttgggactagagggggctttggcaactatggtgctcaggtgattatccttcgctcgtttatccaataaacatttatcaagca

SEQ ID NO: 106109 - DNA, 18787 bp, Homo sapiens
  Payload ID: 802
  Gene Symbol: AHNAK
  Gene Name: AHNAK nucleoprotein
  Uniprot ID: Q09666
  ENST ID: ENST00000378024
  CDS Start-End: 276-17948
acaagagccgcctccgcgcacgggggcccggccactcggagctgctctgccgcggggactgcaccgcccgccctgccagacccgcccggaacggggctcgtcgccgccagtagccgcagcaccgcagccttgggcctcgcgccggctatggccgtgccctggggctgagccctcaggttgtgaccgagattcccgacgagagagactgaggggaagagaggaaggaggggcgggctcctggcaaggcattcgctcctgagcggaatcctgcaaagatggagaaggaggagacaacccgggagctgctgctgcccaactggcagggtagtggctcccacgggctgaccatcgcccagagggacgacggcgtctttgtgcaggaggtgacgcagaactcccctgcggcccgcactggggtggtcaaggagggggaccagattgtgggtgccaccatctactttgacaacctgcagtcgggtgaggtgacccagctgctgaacaccatggggcaccacacggtgggcctgaagctgcaccgcaagggggaccgctctcccgagcctggccagacctggacccgtgaagtcttcagctcctgcagctctgaagtggttctgagcggggatgatgaggagtaccagcgcatctacaccacgaagatcaagccacggctgaagtcggaagatggagtggaaggagacctcggggagacccagagccgtaccatcacagtgaccagaagggtcacggcctacactgtggatgtgactggccgggaaggagccaaggacatagacatcagtagccctgaattcaagatcaagattccaagacatgaactgactgaaatctccaatgtggatgtggagacccagtctgggaagaccgtgatcagactgccctcgggctcgggggcagcctctccgacaggctctgctgtggatatccgagcaggggccatttctgcttcaggaccagagctccaaggtgctggccactcgaagctccaggtcaccatgcctgggataaaggtgggaggctcaggtgtcaatgtcaatgcaaagggcttggacttgggtggcagaggaggggtccaagttccagcagtggacatttcatcttctcttgggggtagggcagtagaggtacagggcccatctctggagagtggtgatcatggcaaaattaaatttcccaccatgaaagtgccgaaatttggtgtctcaacagggcgtgagggccagacaccaaaggcagggctgagggtttctgcacctgaagtctctgtggggcacaagggcggcaagccaggcttgactatccaagcccctcagctggaagtcagtgtgccctctgccaatattgagggccttgaggggaagctgaagggcccccaaatcactgggccatcacttgagggtgacctaggcctgaaaggtgccaagccacaggggcacattggggtggatgcctctgctccccaaattgggggtagcatcactggccccagtgtggaagttcaggcccctgacattgatgttcaggggcctgggagcaaactgaatgtgcccaagatgaaagtccccaagttctctgtatcaggtgcaaagggagaggaaactgggattgatgtgacactgcctacaggtgaagtgactgttcctggggtctctggggatgtcagcctgcctgagattgctactggtgggctggaaggaaagatgaaaggtactaaagtgaagactcctgaaatgattattcagaaacctaaaatctccatgcaggatgtggatctgagccttgggtctcctaaactgaaaggagatattaaggtttctgctcctggggtgcaaggtgatgttaaaggccctcaagtggcacttaaaggctccagagtggacatagagacaccaaacctagagggaaccttgacaggccctaggcttggcagtccttccgggaaaaccggaacctgtaggatctctatgtcagaagtagacttaaatgtggccgcacctaaagtgaaagggggtgtagatgtcacactccccagagtagaagggaaagtcaaagtccctgaagttgatgtcagaggccccaaagtggatgtcagtgccccagatgtcgaagcgcatggcccagaatggaacctgaaaatgcccaagatgaaaatgcccacgttcagcactccaggagccaaaggggaaggtccagatgttcatatgactctacccaaaggagatatcagtatttcagggcccaaggtcaatgtggaagccccagatgtcaacttggagggtctggggggaaaacttaaaggccccgatgttaagctgcctgatatgagtgtcaagacaccaaagatctccatgcctgatgtagatttgcacgtgaaaggtacaaaggtgaagggagagtatgatgtaactgtaccaaagctggaaggagaactcaaaggcccaaaagtggacattgatgccccagatgtggatgttcatggcccagactggcacttgaagatgcccaagatgaaaatgcccaaattcagtgtgccagggttcaaagcagagggcccagaagtggatgtgaacctgcccaaggctgatgtggacatttccgggcccaagatagatgttactgctcctgatgtgagcattgaggaaccagaagggaaattgaaagggcccaagtttaagatgcctgagatgaacatcaaagtccccaagatctccatgcctgatgtggacttacatctgaaaggccctaacgtaaagggagaatatgatgtcacaatgccaaaggttgaaagtgagattaaagttcctgatgttgaacttaaaagtgccaaaatggacattgatgtcccagatgtggaggttcaaggcccagactggcacctgaagatgcccaagatgaaaatgcccaagttcagcatgcctggcttcaaagcagagggcccagaagtggatgtgaacctgcccaaggctgatgtggacatctcaggacccaaggtgggtgttgaagttccagatgtgaatattgaaggacctgaaggaaagctgaagggccccaagttcaagatgccagagatgaatatcaaggcccccaagatctccatgcctgatgtggacttgcatatgaaaggtcctaaagtaaagggagaatatgatatgacagtgccaaagctggaaggggacctgaaaggcccaaaagtagatgtcagtgccccagatgttgaaatgcagggtcctgactggaacttgaagatgccaaagattaaaatgcccaaatttagcatgcccagcctcaaaggagaggggccagaatttgatgtgaacctgtccaaagcgaatgtggacatttctgcaccaaaagtagatactaatgctccagatctgagccttgaaggacctgaagggaagttgaaaggcccgaagtttaagatgcctgagatgcacttcagagctcctaagatgtctttgccagatgttgacctggatcttaaaggacccaaaatgaaaggaaatgtagatatctctgcaccaaagatagagggtgaaatgcaggttccagatgtggacatcagaggtcccaaggtagatattaaagcaccagatgtggaaggccaaggcctggactggagcctgaaaatacccaagatgaaaatgcccaagttcagcatgcccagcctcaaaggcgagggcccagaagtggatgtgaacttgcctaaggctgacgttgttgtctcaggacccaaggtggacatcgaagccccagatgtgagcctcgaaggtccagaagggaagctgaagggtcccaagtttaagatgcctgagatgcatttcaagacccccaagatctccatgcctgatgtggacttacacttgaaaggccccaaagtcaaaggggatgtggatgtgtctgtgcccaaggtagaaggtgaaatgaaagtgccagatgttgaaatcaaaggacccaaaatggacattgatgccccagatgtggaggttcaaggcccagactggcacctgaagatgcccaagatgaaaatgcccaagtttagcatgcctggcttcaaaggagagggccgagaagtggatgtgaacctgcccaaggctgacattgatgtctcaggacccaaggtggatgttgaagtcccagatgtgagccttgagggcccggaaggaaagctgaagggccccaagtttaagatgcctgagatgcacttcaaggcccccaagatctccatgcctgatgtggacctgaatcttaaggggccaaaattgaagggagatgtggatgtgtccttgcctgaggtagaaggtgaaatgaaagtgccagatgttgacattaaagggcccaaagttgacattagtgctccagatgtggatgttcatggcccagattggcacctgaagatgcccaaggtgaaaatgcccaagttcagcatgcccggcttcaaaggagagggccctgaagtggatgtgaagctgcccaaagctgacgttgatgtctcaggacccaaaatggatgctgaagttccagatgtgaatattgaaggtccagacgcaaaactaaaaggtcccaaattcaagatgccagaaatgagtataaagcctcagaagatatccataccagatgttggtttgcatttgaaaggtcctaaaatgaaaggagattatgatgtaacagttccaaaagtagaaggagagataaaagctcctgatgttgacatcaaaggccccaaagttgatattaatgcaccagatgtggaggttcatggcccagactggcacctgaagatgcccaaggtaaaaatgcccaagttcagcatgcctggctttaaaggagagggcccagaggtggatatgaacctgcccaaggctgaccttggtgtttcaggacccaaggtggacattgatgttccagatgtgaatcttgaagctccagaggggaaactaaaaggccctaagttcaagatgccaagcatgaatatacagacgcacaaaatctctatgcctgatgttggacttaatttgaaagcccctaaactgaaaactgatgtagatgtttcccttcccaaagtggaaggagacttgaagggtcctgaaattgatgtgaaagcccctaagatggatgtgaatgttggtgatattgatattgaaggtccagaagggaagttgaagggccccaagtttaagatgcctgagatgcatttcaaggcccccaagatctccatgcccgatgtggacttacacttgaaaggccccaaagtcaaaggggatatggatgtgtctgtgcccaaggtagaaggtgaaatgaaagtgccagatgttgacattaaagggcccaaagtggacattgatgccccagatgtggaggttcacgacccagattggcacctgaaaatgcccaagatgaaaatgcccaagttcagtatgcctggcttcaaagcagagggccctgaagtggatgtgaatctgccaaaggctgacattgatgtgtctggacccagtgtggacactgatgctcctgatttggatattgagggaccagaaggaaagttgaaaggctccaaatttaagatgcccaagttgaatataaaagctcccaaggtctccatgccagatgtggacttgaatttgaagggacccaaactgaagggagagatagatgcttctgtgccagaactggaaggtgatctcagagggccgcaagttgatgtcaaaggtccttttgtggaagcggaggtgcccgatgttgatctggagtgtcctgatgcaaagttgaaagggcccaagtttaagatgcctgagatgcacttcaaggcccccaagatctccatgcctgatgtggacttacacctgaaaggccccaaagtcaaaggggatgcggatgtgtcggtgccaaaattggagggagatttaacaggccccagtgtgggtgtggaggtgcctgatgttgagctggagtgtcctgatgcaaagttgaaaggccctaaatttaagatgccagacatgcacttcaaggcccccaagatctccatgcctgatgtggacttacacttgaaaggccccaaagtcaaaggggatgtggatgtgtcggtgccaaaattggagggagatttaacaggtcccagtgtgggtgtggaggtgcctgatgttgagctggagtgtcctgatgcaaagttgaaagggcccaagtttaagatgcctgagatgcacttcaagacccccaagatctccatgcctgatgtggacttacacctgaaaggccccaaagtcaaaggggatatggatgtgtctgtgcccaaggtagaaggtgaaatgaaagtgccagatgttgacatcaaaggacccaaaatggacattgatgccccagatgtggatgttcatggcccagactggcacctgaagatgcccaagatgaaaatgcccaagttcagcatgcctggcttcaaagcagagggcccagaagtggatgtgaacttgcccaaggctgatgttgttgtctcaggacccaaggtggatgttgaagtcccagatgtgagccttgaaggtccagaagggaagctgaagggccccaagcttaagatgcctgagatgcacttcaaggcccccaagatctccatgcctgatgtggacttacacttgaaaggccccaaagtcaaaggggatgtggatgtgtctttgccaaaattggagggagatttaacaggccccagtgtggatgtggaggtgcctgatgttgagctggagtgtcctgatgcaaagttgaaagggcccaagtttaagatgcctgagatgcacttcaagacccccaagatctccatgcctgatgtgaacttaaacttgaaaggccccaaagtcaaaggggatatggatgtgtctgttcccaaggtagaaggtgaaatgaaagtgccagatgttgacatcagagggcccaaagtggacattgatgccccagatgtggatgttcatggcccagactggcacctgaagatgcctaagatgaaaatgcccaagttcagcatgcctggcttcaaaggagagggcccagaagtggatgtgaacttgcccaaggctgacgttgatgtctcaggacccaaggtggatgttgaagtcccagatgtgagccttgaaggtccagaagggaagctgaagggccccaagtttaagatgcctgagatgcacttcaagacccccaagatctccatgcctgatgttgatttcaatttaaagggacccaaaatcaaaggagatgttgatgtttctgccccaaagctggagggagagttaaaaggtccagaattggatgtcaaaggtcccaaattagatgctgacatgccagaagtagctgtggaaggcccaaatggcaagtggaaaactcctaagttcaagatgccagatatgcactttaaagctcccaaaatctctatgccagacctcgatctacacttgaagagccccaaggcaaaaggagaggtggatgtagatgttcccaaattggaaggggaccttaaagggccacatgtggatgtcagtgggccagacattgacattgagggaccagagggcaaattgaaaggccctaagttcaagatgcctgatatgcatttcaaagcccccaatatttctatgcctgatgttgatctaaatctcaaaggacccaaaatcaagggggatgtggatgtgtctgtgcctgaggtagaaggtaaacttgaagtaccagatatgaacatcaggggccccaaagttgatgtaaatgcccccgatgtccaagctccagactggcacctgaagatgcccaagatgaaaatgcccaagttcagcatgcctggcttcaaagcagagggccctgaagtagacgtcaacttgcctaaggctgacgttgacatctcaggacccaaggtggacattgaaggccctgatgttaatattgaaggaccagagggaaagttgaaagggcctaagttaaagatgccagagatgaacatcaaagcccccaagatctccatgcctgactttgatttgcatctgaaaggtcccaaggtgaagggcgatgtggatgtttctctgcccaaagtggaaggtgacctcaagggccccgaagttgacatcaaggggcccaaagtggatattaatgccccagatgtgggtgttcaaggcccagactggcacctgaagatgcccaaggtgaaaatgccaaagttcagcatgcctggcttcaaaggagagggcccagatggggatgtgaagctgcccaaggctgacattgatgtctcaggacccaaagtggacattgaaggccctgatgttaacattgaaggaccagagggaaagttgaaagggcctaagttcaagatgccagagatgaatatcaaagcccccaagatctccatgcctgatattgacttaaacctgaaaggacccaaagtgaagggtgatgtggatgtttcccttcctaaagtggaaggtgacctcaagggcccagaagttgacatcaagggcccaaaagtggacattgacgcacctgatgttgatgttcatggcccagactggcacctaaagatgcccaagataaaaatgcccaagatcagcatgcctggcttcaaaggagaaggtccagatgtggacgtgaacctgcccaaggctgacattgatgtctcaggaccgaaagtggatgttgaatgtcccgatgtgaatatcgaaggacctgaaggaaagtggaaaagtccaaagtttaagatgccagagatgcattttaagactccaaagatatccatgccagatattgacctgaatctcacaggtccaaaaataaaaggagatgtggatgttacaggccctaaggtagagggagatctgaaaggtcctgaagttgacctcaaaggccccaaagtggacattgatgtcccagatgttaatgttcagggtccagactggcacctgaagatgcccaagatgaaaatgcccaagttcagcatgcctggcttcaaagcagagggccctgaagtggatgtgaacctgcccaaggctgacgttgatgtctcaggccccaaagtggacgttgaaggccctgatgttaacattgaaggaccagagggaaagttgaaagggcccaagttcaagatgccagagatgaatatcaaagcccccaagatccccatgcctgactttgatttgcatctgaaaggtcccaaggtgaagggcgatgtggatatttctctgcccaaagtggaaggtgacctcaagggccctgaagttgacatcaggggtccccaagtggacattgatgtcccggatgtgggcgttcaaggcccagactggcacctaaaaatgcccaaagtgaaaatgcccaaattcagcatgcctggcttcaaaggagagggcccagatgtggatgtgaacctgcccaaggctgaccttgatgtctcaggacccaaggtggacattgatgttccagatgtgaatatcgaaggcccagagggaaagttgaaaggtcccaaattcaaaatgcctgagatgaacatcaaagcccccaagatctccatgcctgacattgatcttaacctgaaaggtcccaaagtgaagggtgacatggatgtgtctctgccaaaagtggaaggtgacatgaaagttcctgacgtggatattaaaggccccaaagtggatattaatgccccagatgtggatgttcaaggcccagactggcacctgaagatgcctaaaataaaaatgcccaagatcagcatgcctggcttcaaaggagaaggtccagaagtggacgtgaacctgcccaaggctgaccttgacgtctcaggacccaaggtggacgttgatgttccagatgtgaatattgaaggtccagatgcgaaactgaagggccctaaattcaagatgccagagatgaacatcaaagctcctaaaatatcaatgcctgatttggacctcaatcttaaaggccctaaaatgaaaggagaggtggatgtttcacttgcaaatgtagaaggtgatttgaaaggacctgctcttgacataaaaggcccaaagatagatgtagatgctccagatattgacattcatggcccagatgccaaattaaaaggtccaaaactgaagatgcctgacatgcatgtaaacatgcccaagatctccatgccagaaattgacttgaatttgaaaggctcaaagcttaagggagatgttgatgtctctgggcccaagttggaaggtgacattaaagctcccagtttggatataaagggcccagaagtggacgtttccggtcctaagcttaatatcgaaggcaagtcaaagaaatctcgttttaagcttcccaaatttaatttttcgggctctaaagttcagacacctgaagtggatgtcaaaggtaaaaagccagatattgacataacaggtccaaaagttgatattaatgctcctgatgtcgaggtccaaggaaaagtgaaaggatccaagtttaaaatgcctttcctgagtatttcatctcccaaagtttctatgcctgacgtggagctaaatttgaaaagtcccaaagtcaaaggagacttagatattgcaggtcccaatttagaaggtgactttaaaggccccaaagtggatattaaggcaccagaagtcaatcttaatgcacctgatgtggatgttcatggtccagactggaatctgaaaatgcccaagatgaaaatgcccaaattcagtgtgtctggcttaaaagcagaagggccagatgtagctgtggatctaccaaaaggagacatcaacatagagggcccaagtatgaacattgagggcccagatctcaatgtggaaggtccggagggaggcttgaaaggtcccaaattcaagatgcctgacatgaatatcaaagctcccaagatctccatgcctgacattgacttaaacttgaaaggccccaaggtgaaaggtgatgtggatatttctcttcccaaacttgaaggggatctgaaagggccagaggttgatatcaaaggccctaaagtggacatcaatgccccagatgtggatgttcatggtccagactggcatctgaagatgcccaaagtgaaaatgcccaagttcagcatgcctggcttcaaaggagaaggccctgaagtcgatgttaccctccctaaagctgacattgacatttctggtcccaatgtagacgttgatgttccagacgtgaatattgaaggtccagatgcaaagctgaagggccccaagttcaagatgcctgagatgaacatcaaagcccccaagatctccatgcctgactttgacctgaacttgaagggacccaaaatgaagggtgatgtggttgtgtctttgcccaaagtggaaggtgatctaaaaggccctgaggtggacatcaagggccccaaagtggacattgacactcctgacattaacatcgaaggctcagagggtaaattcaagggacccaaatttaagataccagagatgcacctgaaggctcccaaaatatcgatgcctgacattgatttaaacctgaagggccccaaagtcaagggcgatgtggatgtttctctgcccaaaatggaaggtgacctcaagggtcctgaagttgacatcaagggccccaaagtggacattaatgctccagatgttgatgttcaaggcccagactggcacctgaagatgcccaaggtgaaaatgcccaagttcagcatgcctggcttcaaaggagagggcccagatgtggatgtgaacctgcccaaggctgaccttgatgtctcaggacccaaggtggacattgatgttccagatgtgaatatcgaaggcccagagggaaagttgaaaggtcccaaattcaagatgcctgagatgaacatcaaagcccccaagatctccatgcctgacattgatcttaacctgaaaggacccaaagtgaagggtgatatggatgtgtctctgccaaaagtggaaggtgacatgcaagttcctgacttggatattaaaggccccaaagtggatattaatgccccagatgtggatgttcgaggcccagactggcacctgaagatgcctaagataaaaatgcccaagatcagcatgcctggcttcaaaggagaaggtccagaagtggatgtgaacctgcccaaggctgaccttgacgtctcaggacccaaggtggacgttgatgttccagatgtgaatattgaaggtccagatgcgaaactgaagggccctaaattcaagatgccagagatgaacatcaaagcccccaagatctccatgcctgactttgatttgcatctgaaaggccctaaggtgaaaggagatgtggatgtttctctgcctaagatggaaggtgatctaaaggcccctgaagttgacatcaagggccccaaagtggacattgatgccccagatgtggatgttcatggcccagactggcacctgaagatgcccaaggtgaaaatgcccaaattcagcatgccaggatttaaaggagagggcccagaagtggatgttaatttgcccaaagctgacattgatgtctcaggacccaaagtggacattgacactcctgatattgatattcatggtccagaagggaaactgaagggccccaaatttaaaatgcctgacctgcacctcaaggcaccgaagatctctatgcctgaagttgacctgaatctgaaaggtccaaagatgaagggcgacgtggacgtttctctgcccaaagtggaaggcgacctcaagggccctgaagttgacatcaagggccccaaagtggacattgatgtcccagatgtggacgttcaaggcccagactggcacttaaaaatgcccaaagtgaaaatgcccaagttcagcatgcctggcttcaaaggagagggcccagatgtggatgtgaacctgcccaaggctgaccttgacgtctcaggacccaaggtggacattgatgttcctgatgtgaatatcgaaggtccagatgcgaaactaaagggccctaaattcaagatgcctgagatgaacatcaaagcccccaagatctccatgcctgactttgatttgcatctgaaaggtcccaaggtgaagggtgatgtggatgtttcccttcctaaagtggaaggtgacctcaagggcccagaagttgacatcaagggccccaaagtggacatcgatgcccctgatgtagatgttcatggcccagactggcacctgaagatgcccaaggtgaaaatgcccaaattcagcatgccaggattcaaaggagagggcccagatgtggatgttacccttcctaaggctgacattgagatttctggccccaaagtggacattgatgcccctgatgtcagtatcgaaggtccagatgcaaaactcaagggtccaaagttcaagatgccagagatgaacatcaaggcccccaaaatctccatgcctgacattgactttaacttgaagggtcccaaagtgaaaggtgatgtggatgtctctctgcccaaagtggaaggtgatctcaagggccctgaaattgacataaaaggccccagtttggacattgacacacctgatgtcaatattgaaggtccggaaggaaaattgaaggggcccaaatttaagatgcctgagatgaacatcaaagctcccaaaatctctatgcctgactttgatttgcacctgaaaggtcccaaggtgaagggtgatgtggatgtttcactacctaaggtggaaagtgatctgaaagggccagaggtagacattgaaggtcctgaagggaagctcaaaggtcccaagtttaagatgcctgatgtacatttcaaaagcccacaaatctccatgagtgacattgatttgaatttgaaaggacctaagataaaaggagatatggacatttccgttcctaaactggagggagatctgaaaggtcccaaagtggatgtcaaaggccctaaagtgggcattgacactcctgatattgacattcatggtccagaagggaaactgaagggccccaaatttaaaatgcctgacttacacctcaaggcaccgaagatctctatgcctgaagttgacctgaatctgaaaggtccaaaggtgaagggcgacatggacatttctctgcccaaagtggaaggcgacctcaagggccccgaagttgacatcagggaccccaaagtggacattgatgtcccagatgtggacgttcaaggcccagactggcacctaaaaatgcccaaagtgaaaatgcccaagttcagcatgcctggcttcaaaggagagggcccagatgtggatgtgaacctgcccaaggctgacattgatgtctcaggacccaaagtggacgttgatgttcctgatgtgaatatcgaaggtccagatgcgaaactaaagggccccaagttcaagatgcctgagatgagcatcaaagcccccaagatctccatgcctgatattgacttaaacctgaaaggacccaaagtgaagggcgatgtggatgttacccttcctaaagtggaaggtgacctcaagggcccagaagctgacatcaagggcccaaaagtggacatcaacacccctgatgtggatgttcatggcccagactggcacctgaagatgcccaaggtgaaaatgcccaaattcagcatgcctggcttcaaaggagaaggtccagatgtggatgtgagcctgcccaaggccgacatcgatgtctcgggacccaaggtggacgttgatattccagatgtgaatatcgaaggtccagacgcaaaactgaagggccccaagttcaagatgcctgaaataaatatcaaagctcccaagatctccatacctgatgttgacctggatttgaaaggacccaaagtaaaaggagattttgatgtgtctgtccctaaggttgaagggactttgaaaggcccagaagtagatcttaaaggtccacgtctggatttcgaaggccctgatgccaaactcagtggcccatctttgaagatgccatcgctggagatatctgctcctaaagtaactgctcctgatgttgatttgcatctcaaggcaccaaaaattggattttcaggtccgaagttagaaggtggtgaagtggacctcaagggacccaaagttgaagctccaagcttagatgtacacatggacagcccagatattaacatcgaagggccagatgttaaaatccccaaatttaagaaacccaagtttggatttggggcaaaaagccccaaagctgacatcaagtcaccttcactggatgtcactgttcctgaggcagagctgaaccttgagactcctgaaattagtgttggtggcaagggcaagaaaagtaagtttaaaatgcctaaaattcatatgagtggtcctaagattaaggccaaaaaacagggatttgacctgaatgttcctgggggtgaaattgatgccagcctcaaggctccggatgtagatgtcaacatcgcagggccggatgctgcactcaaagtcgacgtgaaatcgcccaaaaccaagaaaacgatgtttggaaaaatgtacttcccagatgtagagtttgacattaaatcacctaaatttaaagctgaggcccctctccctagccccaaactggagggtgaactccaggcacctgatctggaactttctttgccagcgattcacgtcgaaggtcttgacatcaaggcgaaggctcccaaggtcaagatgccagatgtggacatctcagtgccaaaaatagagggtgacctgaaaggccccaaagtgcaggcaaacttgggtgcacctgacatcaacatcgaaggcctagatgctaaagtcaaaacaccgtccttcggcatttctgcccctcaagtctccatccctgatgtgaatgtaaacttgaaaggaccaaagataaagggtgatgtccccagcgtgggactggaaggaccagatgtagatctgcaaggtccagaagcaaaaattaagttccccaagttttccatgcccaagatcggcatcccaggtgtgaaaatggagggtgggggagccgaggtccatgcccagctaccctctcttgaaggagacttgagaggaccagatgttaagctcgaagggcccgatgtttctctaaaggggccaggagtagacttgccttcagtgaacctctctatgccaaaagtctctgggcctgaccttgatctgaacttgaaaggaccaagtttgaagggagacctggatgcatctgttcccagcatgaaggtgcatgctccagggctcaacctcagtggtgtcggtggcaaaatgcaggtgggaggagacggtgtgaaagtgccagggatcgatgccacaacaaagcttaacgttggggcaccagatgtgacactgaggggaccaagcctgcagggagatctggctgtctctggtgacatcaaatgccctaaagtatccgtaggagctcctgatctaagcttggaggcatccgaaggcagcattaaacttcccaaaatgaagctgccccaatttggcatctctactccggggtccgacttgcacgtcaatgccaaggggccacaggtttctggcgaactgaaggggccaggtgtggatgtgaacctgaaagggcctcggatttcagcaccgaatgtggactttaacttggaaggaccaaaagtgaaagggagccttggggccactggtgagatcaaaggccccactgtcggaggaggtcttccaggcattggtgttcaaggcctagaaggaaacctccagatgcctggaattaagtcctctggatgtgatgtgaacctgccaggcgtgaatgtgaaactcccaactgggcagatttctgggcctgaaatcaaaggtggtctgaaaggttcagaagtaggtttccatggggctgctcctgatatcagtgtgaaggggcctgcctttaatatggcatctcctgagtcagattttggcatcaacttgaagggcccaaaaatcaaaggaggtgcggatgtttcagggggtgtcagtgccccagacatcagccttggtgaagggcatttgagtgttaaaggttccgggggtgagtggaagggaccccaagtctcctctgctctcaacttggacacatctaagtttgctgggggccttcatttctcaggaccaaaggtggaaggaggtgtgaaaggaggtcagattggactccaggctcctgggctgagtgtgtctgggcctcaaggtcacttggaaagtggatctggaaaagtaacattccctaaaatgaagatccccaaatttaccttctctggccgtgagctggttggcagagaaatgggggtggatgttcacttccctaaagcagaggccagcatccaagctggtgctggagacggcgagtgggaagagtctgaagtcaaactgaaaaagtccaagatcaaaatgcccaagtttaatttttccaaacctaaagggaaaggtggtgtcactggctcaccagaagcatcaatttctgggtccaaaggtgacctgaaaagttcaaaggccagcctgggctctctggaaggagaggcagaggccgaagcctcttcaccgaaaggcaaattctccttatttaaaagtaagaagccacggcaccgctcaaattcattcagtgatgaaagagagttctctggaccttccaccccgacggggacgctggagtttgaaggtggggaagtgtctctggaaggtgggaaagttaaagggaaacacgggaagctgaaattcggtacctttggtggattggggtcaaagagcaaaggtcattatgaggtgactgggagcgatgatgagacaggcaagttacaggggagtggggtgtccctggcctctaagaagtcccgactgtcctcctcttctagcaatgacagtgggaataaggttggcatccagcttcccgaggtggagctgtcagtttccacaaagaaagagtagcaggcctttgtatgtgtgtacatatatatatatataacaaaacatcagccttgggtggtgtgttcctatataaactccaaagggaaacacaccgactgcctcagcaatcatgcaaagaccttgcctggcccggtggcaagcgctgaaaaaccgaccgcctgtaggctcctggaactatacagataggtaaagagttccaagttcgtccagcccatgtgcaaagtcaacagtatttgccttaagatttcatatatatatatttttttgcattgactgctgagagctcctgtttactaagcaagcttttgtgtttattatcctcatttttactgaacattgttagttttggggtaatggaaacccactttttcattgtaatgactttgggggcttttgttagtaagggtgggtggggtgatgggttgcagacggaggtcaggtcttcctctttcctgagactggatctgttcaaacagcaaacgcccacagatggcccagaggtggtggtagtcagggtgtgtgggtgtttttagggttctttagtgttgtttctttcacccaggggtggtggtcccagccagtttggtgctgacggtgagaggaaattagaatctgtttgcaaattgtccaacccaccccctcaacatgaggggcttccattttctgtgttttgtaagggaactgtttccttcatgccgccatgttcctgatattagttctgatttctttttaacaaatgttatcatgattaagaaaatttccagcactttaatggccaattaactgagaatgtaagaaaattgatgctgtacaaggcaaataaagctgtttattaacct

SEQ ID NO: 106110 - DNA, 580 bp, Homo sapiens
  Payload ID: 802
  Gene Symbol: AHNAK
  Gene Name: AHNAK nucleoprotein
  ENST ID: ENST00000530285
  CDS Start-End: 148-580
gagctggcgacccgactccatggtccagcacatggcacagagactggggttgtgaccgagattcccgacgagagagactgaggggaagagaggaaggaggggcgggctcctggcaaggcattcgctcctgagcggaatcctgcaaagatggagaaggaggagacaacccgggagctgctgctgcccaactggcagggtagtggctcccacgggctgaccatcgcccagagggacgacggcgtctttgtgcaggaggtgacgcagaactcccctgcggcccgcactggggtggtcaaggagggggaccagattgtgggtgccaccatctactttgacaacctgcagtcgggtgaggtgacccagctgctgaacaccatggggcaccacacggtgggcctgaagctgcaccgcaagggggaccgctctcccgagcctggccagacctggacccgtgaagtcttcagctcctgcagctctgaagtggttctgagcggggatgatgaggagtaccagcgcatctacaccacgaagatcaagccacggctgaagtcggaagatggagtggaaggagacctcgggg

SEQ ID NO: 106111 - DNA, 584 bp, Homo sapiens
  Payload ID: 802
  Gene Symbol: AHNAK
  Gene Name: AHNAK nucleoprotein
  ENST ID: ENST00000533365
  CDS Start-End: 222-584
gggcttggcgtgggaggagggctaagctgcgctcgctggaaccctgcgctccagcggtgcgcgccaggagagggggcccgaagcgaggtctcgcctagagttggaaaggcagcgtgcttagggttgtgaccgagattcccgacgagagagactgaggggaagagaggaaggaggggcgggctcctggcaaggcattcgctcctgagcggaatcctgcaaagatggagaaggaggagacaacccgggagctgctgctgcccaactggcagggtagtggctcccacgggctgaccatcgcccagagggacgacggcgtctttgtgcaggaggtgacgcagaactcccctgcggcccgcactggggtggtcaaggagggggaccagattgtgggtgccaccatctactttgacaacctgcagtcgggtgaggtgacccagctgctgaacaccatggggcaccacacggtgggcctgaagctgcaccgcaagggggaccgctctcccgagcctggccagacctggacccgtgaagtcttcagctcctgcagctctgaagtggttctgaacacaccacagccatcagca

SEQ ID NO: 106112 - DNA, 701 bp, Homo sapiens
  Payload ID: 802
  Gene Symbol: AHNAK
  Gene Name: AHNAK nucleoprotein
  ENST ID: ENST00000530124
  CDS Start-End: 10-405
tcattccagatggagaaggaggagacaacccgggagctgctgctgcccaactggcagggtagtggctcccacgggctgaccatcgcccagagggacgacggcgtctttgtgcaggaggtgacgcagaactcccctgcggcccgcactggggtggtcaaggagggggaccagattgtgggtgccaccatctactttgacaacctgcagtcgggtgaggtgacccagctgctgaacaccatggggcaccacacggtgggcctgaagctgcaccgcaagggggaccgctctcccgagcctggccagacctggacccgtgaagtcttcagctcctgcagctctgaagtggttctggactgtagaagcggccaggaagaaaaccaccccctcttaaggttgtttttgtgaccgttctttggagcattgttctaaaaatgggaaattacatattgctgtgccaagggcaacaaacacctgcagttaaaggaataccttccgcgaggcggcttttcggagcatgcatgtttatagctccagccaggccagaccgagggctgctgcataagccctgcttggtgcatttctttacttgcaaggggacagagtgtgggcttaggtttgggactagagggggctttggcaactatggtgctcaggtgattatccttcgctcgtttatccaataaacatttatcaagcatctg

SEQ ID NO: 106113 - DNA, 568 bp, Homo sapiens
  Payload ID: 802
  Gene Symbol: AHNAK
  Gene Name: AHNAK nucleoprotein
  ENST ID: ENST00000528508
  CDS Start-End: 198-568
agctgcgctcgctggaaccctgcgctccagcggtgcgcgccaggagagggggcccgaagcgaggtctcgcctagagttggaaaggcagcgtgcttagggttgtgaccgagattcccgacgagagagactgaggggaagagaggaaggaggggcgggctcctggcaaggcattcgctcctgagcggaatcctgcaaagatggagaaggaggagacaacccgggagctgctgctgcccaactggcagggtagtggctcccacgggctgaccatcgcccagagggacgacggcgtctttgtgcaggaggtgacgcagaactcccctgcggcccgcactggggtggtcaaggagggggaccagattgtgggtgccaccatctactttgacaacctgcagtcgggtgaggtgacccagctgctgaacaccatggggcaccacacggtgggcctgaagctgcaccgcaagggggaccgctctcccgagcctggccagacctggacccgtgaagtcttcagctcctgcagctctgaagtggttctgagcggggatgatgaggagtaccagcgcat

SEQ ID NO: 106114 - DNA, 579 bp, Homo sapiens
  Payload ID: 802
  Gene Symbol: AHNAK
  Gene Name: AHNAK nucleoprotein
  ENST ID: ENST00000531324
  CDS Start-End: 323-579
aagagccgcctccgcgcacgggggcccggccactcggagctgctctgccgcggggactgcaccgcccgccctgccagacccgcccggaacggggctcgtcgccgccagtagccgcagcaccgcagccttgggcctcgcgccggctatggccgtgccctggggctgagccctcaggttgtgaccgagattcccgacgagagagactgaggggaagagaggaaggaggggcgggctcctggcaaggcattcgctcctgagcggaatcctgcaaagtggaaggacgtgagacgaattaccccacccccaacacctcacctggcagatggagaaggaggagacaacccgggagctgctgctgcccaactggcagggtagtggctcccacgggctgaccatcgcccagagggacgacggcgtctttgtgcaggaggtgacgcagaactcccctgcggcccgcactggggtggtcaaggagggggaccagattgtgggtgccaccatctactttgacaacctgcagtcgggtgaggtgacccagctgctgaacaccatggggcaccacacggtgggcctgaagct

SEQ ID NO: 106115 - DNA, 18254 bp, Homo sapiens
  Payload ID: 803
  Gene Symbol: AHNAK2
  Gene Name: AHNAK nucleoprotein 2
  Uniprot ID: Q8IVF2
  ENST ID: ENST00000333244
  CDS Start-End: 121-17508
ccgcggcagcgcagggcagcggggcagagcgcggctcccgcccgcccgccccgtgcgccggagccgggaccagcgactggacgcgacgggccgccaggcccgcaccgcctggccgccgcgatgtgcgactgcttccacatggtgctgcccacctggcccggaacccccggcagcgtgtccggccgtcagctgcagcccggggagccaggtgcagaaacggaagatgaccactctgtgactgaagggcctgcggatgagggcattcgaccacggccgcaggggtcttcacctgtctacgaatacacgactgaggctgccgactttggactccaggaagacgcccccggcaggcaaggttctgctgggagacggagatcctggtggaagcgagattcaggggactcacggacatttttcaggatgagtcgtccagaggctgtccaggaggcaacagaggtgacgctgaagacagaggtggaggcaggagccagtggctacagtgtcacaggtggtggggaccaggggatcttcgtcaagcaagtgctgaaggactcctcagccgccaagctttttaacttgagagaaggggatcagctgctcagtacaaccgtgttctttgaaaacataaaatatgaagatgctctcaaaatccttcaatattcagagccgtacaaggttcagttcaaaatcagacggcagctccctgccccacaggatgaagagtgggcttccagcgatgcccagcacggcccacagggcaaggagaaggaggacacggatgttgctgatgggtgcagagagacccccacgaaaactctggaaggagatggggaccaagagagactcatctccaaaccaagggtggggagaggcaggcagagccagagggagaggctctcttggccaaaatttcaatccataaagagcaagcgggggccgggaccccagaggtcacacagctcgtcagaggcctacgaacctagggacgcacatgacgtgtcccctacaagcacagacacagaggcccagctcacggtggagcgccaagagcagaaggcagggccgggcagccagaggaggcggaagttcctcaacctcagattcaggacaggctcgggacagggcccttcatcgacaggacagccaggcagggggttccagagtggggtgggccgtgctggggtcctggaagagttggggccctggggtgatagcctcgaggagactggggctgccacaggcagcaggagagaggagagggcagaacaggatcgagaagtgatgcctgctcagagcatgccattgcccacagagctcggtgaccctagactttgcgagggaacccctcaggaagggggactcagggcagccaggctccatggaaagaccctggaggggcaggcacaggagacagcagtggcccagaggaagcccagggcccagccaactcctggaatgagccgggagggtgaaggcgagggactgcagagcctggaaatcgggatcgccagactgtccttgagagacacaaccgaaggaggcacacagattggcccaccagaaattagggtgcgagtacacgatttaaagacaccaaaatttgcattttccacagaaaaagagccagaaagagaaaggcgccttagtaccccacagcgagggaagagacaggatgcgtcctcaaaagcgggtactggcctgaagggtgaggaggtggaaggagccgggtggatgccgggcagggaaccaaccacacatgcagaagcacagggggatgaaggagatggagaggaaggactacagaggacaaggatcactgaggaacaggacaagggcagggaagacacagaaggacagataagaatgcccaagttcaagataccctccttaggatggtcgccaagcaagcacacaaagacaggcagagaaaaagccacagaagacacagagcagggaagggaaggagaggccacagcaacagctgatagaagagaacagagacgcacagaggaaggattaaaagacaaagaagacagtgactcaatgacaaacacaacaaaaatacaactaatacacgatgaaaaacgcttaaaaaaggaacaaattctgacagaaaaggaagtggccaccaaagacagcaagttcaaaatgcccaagttcaagatgccattgttcggggcgtcagccccaggcaagtccatggaggcctcggtggatgtgtctgcgccgaaggtggaggccgacgtgagcctcctctccatgcagggggacctcaagaccactgacctcagcgtccagaccccttccgctgacctggaggtccaggatggccaagtggatgtgaaacttccggagggccccctgcccgagggagccagcctcaaagggcacctgcccaaggtgcagaggcccagtttgaagatgcccaaagtggacctcaagggccccaagctggacctgaaaggccccaaggcggaagtgacagcccccgatgtgaagatgtctctgtccagcatggaggtggacgtccaggccccgagagcaaagctggatggtgcgcggctggagggggacctgtccctggccgacaaggaggtgactgccaaagacagcaagttcaaaatgcccaagttcaagatgccatcattcggggtgtcggccccaggcaagtccatggaggactcggtggatgtgtctgcgccgaaggtggaggccgacgtgagcctctcctccatgcagggggacctcaaggccactgacctcagcattcagcccccttccgctgacctggaggtccaggctggccaagtggatgtgaaacttccggagggccctgtgcccgagggagccggccccaaagtgcacctgcccaaagtggagatgcccagtttcaagatgcccaaagtggacctcaagggcccccagatagatgttaagggccccaagctggacctgaaaggccccaaggcggaagtgacagcccccgatggcgaggtgtctctgcccagcatggaggtggatgtccaggcccagaaggccaagctggatggtgcgtggctggagggggacctgtccctggccgacaaggacgtgactgccaaagacagcaagttcaaaatgcccaagttcaagatgccgtcgttcggggtatcggccccagggaagtccatcaaggccttggtggatgtgtctgcacccaaggtggaggccgacctgagtctcccctccatgcagggggacctgaagaccactgacctcagcattcagcctgcttctactgacctgaaggtccaggctgaccaggtggatgtgaagctcccggagggccacctgcccgagggagctggccttaaagggcacttgcccaaggtggagatgcccagtttcaagatgcccaaagtggccctcaagggcccccaggtggacgtcaagggccccaagctggacctgaaaagccccaaggcggaagtcacagcccctgatgtggaggtgtctctgcccagcgtggaggtggacgtcgaggccccgggagccaagctggacagtgcgcggctggagggggaactgtccctggccgacaaggatgtgactgccaaagacagcaggttcaaaatgcccaagttcaagatgccatcgttcggggcgtcagccccaggcaagtccatcgaggcctcggtggatgtgtctgcacccaaagtggaggccgacgtgagtctcccctccatgcagggggacctcaagaccactgacctcagcattcagcccccttccgctgacctggaggtccacgctggccaggtggacgtgaagctcctggagggccacgtgcctgagggagccggcttcaaagggcacctgcccaaggtgcagatgcctagtttgaagatgcccaaagtggacctcaagggcccccaggtggaagtcaggggccccaagctggacctgaaaggtcataaggcagaggtgacggcccacgaagtggctgtgtctctgcccagtgtggaggtggacatgcaggccccgggagccaagttggatggcgcacagctggacggggacctgtccctggctgacaaggacgtgactgccaaagacagcaagttcaaaatgcccaagttcaagatgccgtcgttcggggtgtctgccccaggcaagtccattgaggcctccgtggacctgtctgcacccaaggtggaggccgacatgagcctcccctccatgcagggggacctcaagaccactgacctcagcattcagcccccttccactgacctggagctccaggctggccaattggacgtgaaactcccagagggccccgtgcccgagggagccggcctcaaagggcacctgcccaagctgcagatgcccagtttcaaggtgcccaaagtggacctcaagggccctgaaatagacatcaagggccccaagctggacctaaaagaccccaaggtggaagtgacagcccctgatgtggaggtttctctgcccagcgtggaggtggatgtcgaggccccaggagccaagctggatggtggacggctggaggaggacatgtccctggccgacaaggacttgactaccaaagacagcaagttcaaaatgcccaagttcaagatgccgtcgttcggggtgtctgccccaggcaagtccatcgaggcctcagtggatgtgtctgcgccgaaggtggaggccgacgtgagcctcccctccatgcagggggacctcaaggccactgacctgagcatacagcccccttctgctgacctggaggtccaggctggccaagtggacgtgaaactcccagagggccctgtgtccgagggagccggcctcaaagggcacctgcccaaagtgcagatgcccagtttcaagatgcccaaagtggacctcaaggggccccagatagatgttaagggccccaagctggacctgaaaggccccaaggtggaagtgacagcccccgatgtgaagatgtctctgtccagcatggaggtggacgtccaggccccgagagcaaagctggatggtgcgcagctggagggggacctgtccctggccgacaaggcggtgactgccaaagacagcaagttcaaaatgcccaagttcaagatgccatcatttggggtgtcggccccaggcaagtccatcgaggcctcggtggatgtgtctgagccgaaggtggaagctgatgtgagcctcccctccatgcagggggacctgaagaccactgacctcagcattcagtccccttccgccgacctggaggtccaggctggccaagtgaacgtgaaactcccggagggcccccttcccgagggagccggcttcaaagggcacctccccaaggtgcagatgcccagtttgaagatgcccaaagtggccctcaagggcccccagatggacgtcaagggccccaagctggacctgaaaggccccaaggcggaggtgatggcccccgacgtggaggtgtctctgcccagcgtggaggtggacgtcgaggctccaggagccaagctggacagtgtgcggctggagggtgacctgtccctggccgacaaggatgtgactgccaaagacagcaagttcaaaatgcccaagttcaagatgccgtcgttcggggtgtctgccccaggcaagtccatcgaggcctcggtggatgtgtctgcgccgaaggtggaggccgaagtgagcctcccctccatgcagggggacctcaagaccacggacctctgcattccgctcccttctgcagacctggtggtccaggctggccaagtggacatgaagctcccggagggccaggtgcccgagggagccggcctcaaagggcacttgcccaaggtggatatgcccagtttcaagatgcccaaagtggacctcaagggcccccagacagatgttaagggcgccaagctggacctgaaaggccccaaggcggaagtgacagcccccgatgtcgaggtgtctctgcccagcatggaggtggatgtccaggcccagaaggctaagctggatggtgcgcggctggagggagacctgtccctggccgacaaggacatgactgccaaagacagcaagttcaaaatgcccaaattcaagatgccgtcgttcggggtatcggccccagggaggtccatcgaggcctcggtggatgtgcctgcacccaaggtggaggccgacgtgagtctcccctccatgcagggggacctgaagaccactgacctcagcattcagcccccttctgccgacctgaaggtccagactggccaggtggatgtgaagctcccggagggccacgtgcccgagggagctggcctcaaagggcacctgcccaaggtggagatgcccagtttgaagatgcccaaagtggacctcaagggcccccaggtggacatcaagggccccaaactggacctaaaagaccccaaggtggaaatgagagtccccgatgtcgaggtgtctctgcccagcatggaggtggacgtccaggccccaagagccaagctggatagtgcgcatctgcagggggacctgaccctggccaacaaggacctgactaccaaagacagcaagttcaaaatgcccaagttcaagatgccgtcgtttggggtgtctgccccaggcaagtccatcgaggcctcggtggatgtgtctccacccaaggtggaggccgacatgagtctcccctccatgcagggggacctcaagaccactgacctcagcattcagcccctttccgccgacgtgaaggtccaggctggccaggtggacgtgaaactcctggagggccctgtgcccgaggaagtcggcctcaaagggcacctgcccaagctgcagatgcccagtttcaaggtgcccaaagtggacctcaagggccccgaaatagacatcaagggccccaagctggacctaaaagaccccaaggtggaagtgacagcccctgatgtggaggtgtctctgcccagcgtggaggtggacgtcaaggccccaggagccaagctggatggtgcgcggctggagggggacatgtccctggccgacaaggacgtgactgccaaagacagcaagttcaaaatgcccaagttcaagatgctgtcgtttggggtgtctgcccttggcaagtccatcgaggcctcagcggatgtgtctgcgttgaaggtggaggccgacgtgagcctcccctccatgcagggggacctcaagaccactgacctcagcgttcagcccccttccgctgacctggaggtccaggctggccaagtggatgtgaaactcccagagggccccgtgccggagggagccggcctcaaagggcacctgcccaagctgcagatgcccagtttcaagatgcccaaagtagatctcaagggcccccagatagatgtcaagggccccaagctggacctgaaaggccccaagacggacgtgatggcccccgacgtggaggtgtctcagcccagcgtggaggtggatgtcgaggccccgggagccaagctggatggtgcgtggctggagggggacctgtctgtggcggacaaggatgtgactaccaaagacagcaggttcaaaattcccaagttcaagatgccgtcattcggggtgtctgccccaggcaagtccatcgaggcctcggtggatgtgtctgcgccgaaggtggaggccgacgggagcctctcctccatgcagggggacctcaaggccactgacctcagcattcagcccccttccgctgacctggaggtccaggctggccaagtggacgtgaaactcccagagggccctgtgccggagggagccggcctcaaagggcacctgcccaaggtgcagatgcccagtttcaagatgcctgaaatggacctcaagggcccccagctagatgtcaagggccccaagctggacctgaaaggccccaaggcggaagtgacagcccccgatgtggagatgtctctgtccagcatggaggtggacgtccaggccccgagagcaaagctggatggtgcgcggctggagggggacctgtccctggccgacaagggtgtgacagccaaagatagcaagttcaaaatgcccaagttcaagatgccatcattcagggtgtcggccccaggcgagtccatcgaggcgttggtggatgtgtctgagctgaaggtggaagccgacatgagcctcccctccatgcaaggggaccttaagaccactgacatcagcattcagcccccctctgcccaactggaggtccaggctggccaggtggatgtgaaactcccagagggccacgttcccgagggagccggcctcaaagggcacctgcccaagctgcagatgcccagtttcaagatgcctgaagtggacctcaagggcccccagatagatgttaagggccccaacgtggacctgaaaggccccaaggcggaagtgacagcccccgatgtgaagatgtctctgtccagcatggaggtggacgtccaggccccgagagcaaagctggatggtgcgcggctggagggggacctgtccctggccgacaagggcatgacagccaaagacagcaagttcaaaatgcccaagttcaagatgccgtcattcggggtgtcggccccaggcaagtccatcgaggcctcggtggatgtgtctgagctgaaggtggaagctgacgggagcttcccctccatgcaaggggatcttaagaccactgacatccgcattcagcccccctccgcccaactggaggtccaggctggccaggtggacgtgaaactcccagagggccacgttcccgagggagccggcctcaaagggcacctgcccaaggtgcagatgcccagtttcaagatgcccaaagtggatctcaagggcccccagatagacgtcaagggccccaagctggacctgaaaggccccaaggcggaggtgacggcccccgacgtggaggtgtctctgcccagcgtggaggtggacgtcgaggccccgagagcaaagctggatggtgcacggctggagggtgacctgtccctggccgacaaggatgtgactgccaaagacagcaagttcaaaatgcccaagttcaagatgccgtcgttcggggtgtctgccccaggcaagtccattgaggtctcggtggatgtgtctgcgccgaaggtggaggccgaagtgagcctcccctccatgcagggggacctgaagaccactgacatcagcattgagcccccctctgcccaactggaggtccaggctggccaggtggacctgaagctcccagagggccacgttcccgagggagctggcctcaaagggcacctgcccaagttgcagatgcccagtttcaagatgcccaaagtagatcgcaagggaccccagatagatgtcaagggccccaagctggacctgaaaggcccgaagacggacgtgacggcccccgacgtggaggtgtctcagcccggcatggaggtggatgtcgaggccccaggagccaagttggatggtgcacggctggagggggacctgtccctggccgacaaggatgtgactgccaaagacagcaagttcaaaatgcccaagttcaagatgccgtcgttcggggtgtctgccccaggcaagtccattgaggtcttggtggatgtgtctgcgccaaaggtggaggccgacctgagcctcccctccatgcagggggacctgaagaacactgacatcagcattgagcccccctctgcccaactggaggtccaggctggccaggtggacgtgaagctcccagagggccacgttctcgagggagctggcctcaaagggcacctgcccaagttgcagatgcccagtttcaagatgcccaaagtagatcgcaagggcccccagatagacatcaagggccccaagctggacctgaaaggcccgaagatggatgtgacggcccccgacgtggaggtgtctcagcccagcatggaggtggacgtcgaggccccaggagccaagttggatggtgcacggctggagggggacctgtccctggccgacaaggatgtgactgccaaagacagcaagttcaaaatgcccaaattcaagatgccgtcgtacagggcgtctgccccaggcaagtccatccaggcctcggtggatgtgtctgcgccgaaggcggaggccgacgtgagcctcccctccatgcagggggacctcaagaccactgacctcagcattcagctcccttctgtggacctggaggtccaggctggccaggtggacgtgaagctcccggagggccacgtgcccgagggagctggcctcaaagggcacctgcccaaggtggagatgcccagtttcaagatgcccaaagtggacctcaagagcccccaggtggacatcaagggccccaagctggacctaaaagtccccaaggcggaagtgacagtccctgatgtggaggtgtctctgcccagcgtggaggtggacgtccaggccccgagagccaagctggatggtgcgcggctggagggggacctgtccctggctgaaaaggatgtgactgccaaagacagcaagttcaaaatgcccaagttcaagatgccctccttcggggtgtcggccccaggcaggtccatcgaggcctcgctggatgtgtctgcgccgaaggtggaggccgacgtgagcctctcctccatgcagggggacctcaaggccactgacctcagcattcagcccccttccgctgacctggaggtccaggctgtccaagtggatgtggaactcctggagggccccgtgcccgagggagccggcctcaaagggcacctgcccaaagtggagatgcccagtttaaagacgcccaaagtggacctcaagggcccccagatagatgttaagggccccaagctggacctgaaaggccccaaggcagaagtgagagtccccgatgtcgaggtgtctctgcccagcgtggaggtggatgtccaggccccgaaggccaagctggatgctgggcggctggagggagacctgtccctggctgacaaggacgtgactgccaaagacagcaagttcaaaatgcccaaattcaagatgccgtcattcagggtatcggccccagggaagtccatggaggcctcggtggatgtgtctgcacccaaggtggaagccgatgtgagtctcccctccatgcagggggacctgaagaccactgacctcagcattcagcccccttctgccgacctgaaggtccaggctggccagatggatgtgaagctcccggagggccaggtgcccgagggagccggcctcaaagagcacctgcccaaggtggagatgcccagtttgaagatgcccaaagtggacctcaagggcccccaggtggacatcaagggccccaagctggacctaaaagtctccaaggcggaagtcacagcccctgatgtggaggtgtctctgcccagcgtggaggtggacgtccaggccccaagagccaaactggatagtgcacagctggagggggacctgtccctggccgacaaggatgtgactgccaaagacagcaaattcaaaatgcccaagttcaagatgccgtcatttggggtgtctgccccaggcaagtccattgaggcctcggtgcacgtgtctgcacccaaggtggaggccgatgtgagtctcccctccatgcagggggacctcaagaccactgacctcagcattcagccccattctgccgacctgacggtccaagctcgccaggtggacatgaaactcctggagggccacgtgcccgaggaagccggcctcaaaggacacctgcccaaggtgcagatgcccagtttcaagatgcccaaagtcgacctcaagggccctgaaatagacatcaagggccccaagctggacctaaaagaccccaaggtggaagtgacagcccctgatgtggaggtttctctgcccagcgtggaggtggacgtcgaggccccaggagccaagctggatggtgcgcggctggagggggacctgtccctggccgacaaggacatgacggccaaagacagcaagttcaaaatgcccaagttcaagatgccgtcgttcggggtgtctgccccaggcaagtccatggaggcatcagtggatgtgaccgcgccaaaggtggaggccgacgtgagcctcccttccatgcagggggacctcaaggccactgacctcagcgttcagcccccttccgctgacctggaggtccaggctggccaagtggacgtgaaactcccagagggccccgtgcccgagggagccagcctcaaagggcacctgcccaaggtgcagatgcccagtttcaagatgcccaaagtggacctcaagggcccccagatagatgttaagggccccaagctggacctgaaaggccccaaggcggaagtgacagcccctgatgtgaagatgtctctgtccagcatggaggtggacgtccaggccccgagagcaaagctggatggtgtgcagctggagggggacctgtccctggccgacaaggatgtgactgccaaagacagcaagttcaaaatgcccaagttcaagatgccatcattcggggtgtcggccccaggcaagtccatggaggcgtccgtggatgtgtctgagctgaaggcgaaagccgacgtgagcctcccctccatgcagggggacctcaagaccactgacctcagcattcagtccccttccgccgacctggaggtccaggctggccaagtggacgtgaaactcccggagggccccctgcccaagggagccggcctcaaagggcacctccccaaggtgcagatgccctgtttgaagatgcccaaagtggccctcaagggcccccaggtggatgtcaagggccccaagctggacctgaaaggccccaaggcggatgtgatgacccccgtcgtggaggtgtctctgcccagcatggaggtggacgtcgaggccccgggagccaagctggacagtgtgcggctggagggtgacctgtccctagccgacaaggacatgactgccaaagacagcaagttcaaaatgcccaagttcaagatgccgtcgttcggggtgtctgccccaggcaagtccatcgaggcctcgttggatgtgtctgcgctgaaggtggaggctgacgtgagcctcccctccatgcagggggacctgaagaccactcacctcagcattcagcccccttccgctgatctggaggtccaggctggccaagaggatgtgaaactcccagagggccctgtgcatgagggagccggcctcaaagggcacctgccgaagctgcagatgcccagtttcaaggtacccaaagtggacctcaagggtccccagatagacgttaatgtccccaagctggacctgaaaggccccaaggtggaggtgacgtcccccaacctggacgtgtctctgcccagcatggaggtggacatccaagccccaggagccaagctggacagtacgcggctggagggggacctgtccctggctgacaaggacgtgactgccaaagacagcaagttcaaaatgcccaagttcaagatgccatcctttgggatgttgtccccaggcaagtccatcgaggtctcggtggatgtgtctgcgccaaagatggaggccgacatgagcattccctccatgcagggggacctcaagaccactgacctccgcattcaggccccttccgccgacctggaggtccaggctggccaggtggacttgaaacttccagaaggccacatgcccgaggtagccggcctcaaagggcacctgcccaaggtggagatgcccagtttcaagatgcccaaagtggacctcaagggcccccaggtggacgtcaagggccccaagctggacctgaaaggcccaaaggcagaggtgatggcccccgatgtggaggtgtctctgcccagcgtggagacggatgtccaggccccaggatccatgctggatggtgcgcggcttgagggggacctgtccctggcccacgaggatgtagctgggaaagacagtaagtttcaaggaccaaaactgagcacgtctggttttgaatggtcgtcaaagaaagtttccatgtcttcctctgaaatcgaaggaaatgttacattccatgagaagacttccacatttcccattgtggaatctgttgttcatgaaggtgatcttcatgatccatctcgcgatggtaacttggggcttgctgttggagaagttggaatggattcgaagtttaagaaactgcattttaaagtgcccaaagtttcattttcttctaccaaaactcctaaagatagtttagtcccaggtgcaaagtctagcataggtctttccacgattcctttatcatcttcagaatgctcaagttttgaattacaacaggtttcggcttgttcagagccatccatgcagatgcctaaggtgggttttgctgggtttccatcatcccggcttgatctcactggtcctcactttgaatcttctattctctctccctgtgaggatgttacacttacaaaataccaggtgactgttcccagagctgccttggcccctgagcttgctctggaaattccttctgggtctcaggctgatattcctcttcccaagacagagtgctccactgacctgcagcctccagagggagttccaacatctcaagctgagagtcactctggcccactgaattccatgattcctgtttctcttggtcaggtatcttttcctaaattctataaaccaaagtttgtgttttcagtcccccaaatggcagttcctgagggagacctacatgcagcagtgggtgccccagtcatgtctcctcttagccctggagaaagagtgcagtgccccttgccaagcacccagctgccatccccaggcacctgtgtgtctcagggcccagaagagcttgtggcctccttgcagacatcagtagtggcccctggagaagccccttctgaagatgctgaccacgaagggaaagggagtcccttgaaaatgcctaagattaagcttccatcatttaggtggtccccgaagaaggaaacagggccaaaggtggacccagaatgcagcgtggaggactcaaaactcagcctggttttagacaaggatgaagtggccccgcagtctgccatccacatggatctgcctcctgagagggatggagagaaggggaggagcacaaagcctggctttgccatgccaaaacttgcacttcccaaaatgaaggcttctaagagtggggtcagcctgccacagagagacgtggatccttccctttctagtgccacagcagggggtagctttcaagacacagaaaaggccagcagtgacggtggtaggggaggacttggtgcaacagcaagtgccacaggaagtgagggtgtgaacctccaccggccacaggtccacattcccagtttgggctttgccaaacctgatctcagatcctccaaggccaaggtggaggtgagccagcctgaagctgacctgcctcttcccaaacatgatctgtctaccgaaggtgacagcagaggatgtgggctcggggatgtcccagtgagccagccttgtggggaggggatagcccccacacctgaagatcccctccagccatcctgtagaaaaccagatgctgaagtcctcacagtggaaagcccagaggaggaagccatgaccaagtactcgcaggaaagctggtttaaaatgcccaagttccgcatgcccagccttaggcgctctttcagggacagaggcggggctggaaagctggaagtggctcagacacaggcaccggcagcaacagggggtgaagcagcagctaaagtcaaagagttccttgtttctgggtcaaacgtggaggcagctatgtccctacagctcccagaggcagatgcagaagtgacagcttctgagagcaaatcatccacagatattctaaggtgtgatcttgacagcacaggcttgaagctgcacctctccactgctgggatgactggggatgagctttccacttctgaggtcaggatccatccatccaaaggacctctcccttttcagatgcctggcatgaggcttccagaaacccaggttcttccaggagaaatagatgagactcctctttccaagccaggacatgaccttgccagcatggaggataaaacagagaaatggtcttcccagcctgaaggtccacttaaattgaaagcttcaagtactgatatgccatcccagatttctgtggttaatgtggatcaactgtgggaagattctgtcctaactgtcaaattccccaaattaatggtaccaaggttctccttccctgcccccagctcagaggatgatgtgttcatccccactgtgagggaagtgcagtgtccagaggccaatattgatacagccctttgtaaggaaagtccggggctctggggagccagcatcctgaaggcaggtgctggggtccctggggagcagcctgtggaccttaacctgcctttggaagctcccccaatttcaaaggtcagagtgcatattcagggtgctcaggttgaaagtcaagaggtcactatacacagcatagtgacaccagagtttgtagatctctcagtacccaggactttttccactcagattgtgcgggaatcagagatccccacgtcagagattcaaacaccttcgtacggattttccttattaaaagtgaaaatcccagagccccacacgcaggctagagtgtacacaacaatgactcaacactctaggactcaggagggcacagaagaggctcccatacaagccaccccaggagtagactccatttctggagatctccagcctgacactggagaaccatttgagatgatctcttccagcgtcaatgtactgggacagcaaacactcacatttgaagttccttctggccaccagcttgcagacagctgttcagatgaggagccagcagaaattcttgagtttccccctgatgatagccaagaggcaaccacaccactggcagatgaaggcagggctccaaaagacaaaccagaaagtaaaaaatctggtctgctctggttttggcttccaaacattgggttttcctcttctgttgatgagacaggtgttgattccaaaaatgacgtccagagatctgctcccattcaaacacagcctgaggcacgaccagaggcagaactgcctaaaaaacaggagaaggcaggctggttccgatttcccaaattagggttctcctcatctcctaccaagaaaagcaaaagcaccgaagatggggcagagctggaagaacaaaaacttcaagaagaaacaatcacgttttttgatgcccgagaaagtttctcccctgaagagaaggaagagggtgaactgatcgggcctgtgggcactgggctggactccagagtgatggtgacatccgcggcaagaacagagttaatcctgcccgagcaggacagaaaagctgacgatgaaagcaaagggtcaggcctgggaccaaatgaaggctgagaggtatggctcatcagtacaagagagatgcaaaaaactaagttggaaagtaaaggctacacacacatatggagcaccccatcccacagcacattacatccacctcacttcacagaacggagaacagagcagaaatgaccagaacacctttgtcaccatcacacagccctcctaaaatggaaccaaagcttcccagctccctcaaagctttggatgcaaagaaggcaccctgacttccacaagacaccagaattcacacggtactcagaggcactgctggggaagtttgttggtctttattagataaatttccagagacctgtccataatacccaacagaacatgactgtttctttgaggaaagggttataatgtctgtggtgtacaagtcgtttttggtataacttctttcctgctgctgctgcttcccggcaaacatagttttcctatttcaggcagagtgcggtatattccaggaaacactgtttcctactcacttagcttacttctttgttgaatgcctcactaatggcaagtttcaagatgttttgggtgacaatgcacacatgctgggcaaaagggtgatggccagtggctggcagctgggccagcagaagctaggacatctgtgagttgtcattctcatctatccatgtccactggcctgccagcatccgccagtgccttgccagtgtgcacggtcccacactgtggcccctgagtcccctaatgtacacgctgcagcc

SEQ ID NO: 106116 - DNA, 3436 bp, Homo sapiens
  Payload ID: 803
  Gene Symbol: AHNAK2
  Gene Name: AHNAK nucleoprotein 2
  Uniprot ID: Q8IVF2
  ENST ID: ENST00000557457
  CDS Start-End: 245-2626
gacaggatgcgtcctcaaaagcggacagagtgctccactgacctgcagcctccagagggagttccaacatctcaagctgagagtcactctggcccactgaattccatgattcctgtttctcttggtcaggtggtccccgaagaaggaaacagggccaaaggtggacccagaatgcagcgtggaggactcaaaactcagcctggttttagacaaggatgaagtggccccgcagtctgccatccacatggatctgcctcctgagagggatggagagaaggggaggagcacaaagcctggctttgccatgccaaaacttgcacttcccaaaatgaaggcttctaagagtggggtcagcctgccacagagagacgtggatccttccctttctagtgccacagcagggggtagctttcaagacacagaaaaggccagcagtgacggtggtaggggaggacttggtgcaacagcaagtgccacaggaagtgagggtgtgaacctccaccggccacaggtccacattcccagtttgggctttgccaaacctgatctcagatcctccaaggccaaggtggaggtgagccagcctgaagctgacctgcctcttcccaaacatgatctgtctaccgaaggtgacagcagaggatgtgggctcggggatgtcccagtgagccagccttgtggggaggggatagcccccacacctgaagatcccctccagccatcctgtagaaaaccagatgctgaagtcctcacagtggaaagcccagaggaggaagccatgaccaagtactcgcaggaaagctggtttaaaatgcccaagttccgcatgcccagccttaggcgctctttcagggacagaggcggggctggaaagctggaagtggctcagacacaggcaccggcagcaacagggggtgaagcagcagctaaagtcaaagagttccttgtttctgggtcaaacgtggaggcagctatgtccctacagctcccagaggcagatgcagaagtgacagcttctgagagcaaatcatccacagatattctaaggtgtgatcttgacagcacaggcttgaagctgcacctctccactgctgggatgactggggatgagctttccacttctgaggtcaggatccatccatccaaaggacctctcccttttcagatgcctggcatgaggcttccagaaacccaggttcttccaggagaaatagatgagactcctctttccaagccaggacatgaccttgccagcatggaggataaaacagagaaatggtcttcccagcctgaaggtccacttaaattgaaagcttcaagtactgatatgccatcccagatttctgtggttaatgtggatcaactgtgggaagattctgtcctaactgtcaaattccccaaattaatggtaccaaggttctccttccctgcccccagctcagaggatgatgtgttcatccccactgtgagggaagtgcagtgtccagaggccaatattgatacagccctttgtaaggaaagtccggggctctggggagccagcatcctgaaggcaggtgctggggtccctggggagcagcctgtggaccttaacctgcctttggaagctcccccaatttcaaaggtcagagtgcatattcagggtgctcaggttgaaagtcaagaggtcactatacacagcatagtgacaccagagtttgtagatctctcagtacccaggactttttccactcagattgtgcgggaatcagagatccccacgtcagagattcaaacaccttcgtacggattttccttattaaaagtgaaaatcccagagccccacacgcaggctagagtgtacacaacaatgactcaacactctaggactcaggagggcacagaagaggctcccatacaagccaccccaggagtagactccatttctggagatctccagcctgacactggagaaccatttgagatgatctcttccagcgtcaatgtactgggacagcaaacactcacatttgaagttccttctggccaccagcttgcagacagctgttcagatgaggagccagcagaaattcttgagtttccccctgatgatagccaagaggcaaccacaccactggcagatgaaggcagggctccaaaagacaaaccagaaagtaaaaaatctggtctgctctggttttggcttccaaacattgggttttcctcttctgttgatgagacaggtgttgattccaaaaatgacgtccagagatctgctcccattcaaacacagcctgaggcacgaccagaggcagaactgcctaaaaaacaggagaaggcaggctggttccgatttcccaaattagggttctcctcatctcctaccaagaaaagcaaaagcaccgaagatggggcagagctggaagaacaaaaacttcaagaagaaacaatcacgttttttgatgcccgagaaagtttctcccctgaagagaaggaagagggtgaactgatcgggcctgtgggcactgggctggactccagagtgatggtgacatccgcggcaagaacagagttaatcctgcccgagcaggacagaaaagctgacgatgaaagcaaagggtcaggcctgggaccaaatgaaggctgagaggtatggctcatcagtacaagagagatgcaaaaaactaagttggaaagtaaaggctacacacacatatggagcaccccatcccacagcacattacatccacctcacttcacagaacggagaacagagcagaaatgaccagaacacctttgtcaccatcacacagccctcctaaaatggaaccaaagcttcccagctccctcaaagctttggatgcaaagaaggcaccctgacttccacaagacaccagaattcacacggtactcagaggcactgctggggaagtttgttggtctttattagataaatttccagagacctgtccataatacccaacagaacatgactgtttctttgaggaaagggttataatgtctgtggtgtacaagtcgtttttggtataacttctttcctgctgctgctgcttcccggcaaacatagttttcctatttcaggcagagtgcggtatattccaggaaacactgtttcctactcacttagcttacttctttgttgaatgcctcactaatggcaagtttcaagatgttttgggtgacaatgcacacatgctgggcaaaagggtgatggccagtggctggcagctgggccagcagaagctaggacatctgtgagttgtcattctcatctatccatgtccactggcctgccagcatccgccagtgccttgccagtgtgcacggtcccacactgtggcccctgagtcccctaatgtacacgctgcagccagaatgcagatggagctggcttggctgttccctggatgggcaataaagaaagtgctgcatccca

SEQ ID NO: 106117 - DNA, 2863 bp, Homo sapiens
  Payload ID: 804
  Gene Symbol: AAED1
  Gene Name: AhpC/TSA antioxidant enzyme domain containing 1
  Uniprot ID: Q7RTV5
  ENST ID: ENST00000375234
  CDS Start-End: 1-681
atggccgcgccggccccggtcacgcggcaggttagcggcgccgccgccctggtcccggccccgagcggccccgacagcgggcagcccctggcggccgccgtggccgagctgccggtgctggacgcccgcgggcagcgggtaccgttcggcgcgctgttccgggagcgccgcgccgtggtggtgttcgtgcggcatttcctgtgttacatctgcaaggaatacgtagaggatctggccaaaatccccaggagtttcttacaagaagcaaatgtcacccttatagtgattggacagtcatcctaccatcatattgagcctttttgcaagctgactggatattctcatgaaatctatgtcgatcctgagagagaaatttataaaagattgggaatgaaaagaggtgaagaaattgcttcctcaggacagagcccccacataaaatcaaatctactctcaggaagccttcagagcctgtggcgggcagtgactggccctctctttgattttcaaggagacccagctcagcaaggtggaaccctcattttaggtccaggtaacaacatccattttatacaccgcgataggaataggttggatcacaaacctatcaactctgttttacagcttgtaggagttcagcatgtgaactttacaaacagaccttcagttatccatgtgtgacttaaaatgcactcagtcactttcaactggaccttctggaatgtgaccttcaatgcctgggtgtaatatcctcgtgcagtgtctaacctgctgtcccttcccagcctttgaggagttagggaagcataaagggggcttgaacctgttgaattgcatgctgggaagcatcagttgtcaaaatatgttatatacttccattttataacttttaacattttatacaaaaaaaatgaatatacaaaatataactttaaaagctataaaatcataaatactctaaattattttacattatggtatattcagtcaatgaaagagttttttggcaatataaattctgacagtatataaggggacaggagaacaacacaagaccattatattcagtgaagaaggcaaaatatcaaatctgtcaacaatgtaactgcatttttatatgtatatatttgtatttttgtatgctttggaaaaagacaggaaataaacaccaaaatgttgccagtaggtatctctgtgttaagattagtgttattattttcttttctgtacttttctgtatttcccaactgttatataatgagcatgattaatattgtagggccaggaaaaggtctttaaacattataggacaattttatgccacataacaaccttcacaaaagagcaaaattatataagctgtagtccacttttccatcgtaattgctttactcagaggaagtgtggcaatccgaacatttcacatatagccagtgtccacagcaccttctcaaactacatacttgctatccgtttcactaggattttggggggttgggggagctatggagaaaaaaattgttttagatatttaagatatgtatttaaaaatatggtcagtgtgctttttgaaagggaactataagaattttttttttttttttttttgagatggagtctcactctgttgcccaggctggagtgcagtggcatgatctcggctcactgcaagttccgcctcccgggttcacgccattctcctgcctcagcctcccgagtagctgggactacaggcacccaccaccacgcccggctaattttttgtatttttattagagacggggtttcactgtgttataacagccaggatggtcttgacctcctgacctcatgatccgcccacctcggcctcccaatgtgttgggattacaggtatgagccaccttgcctggcttttttttttttttttttttttttttttttgagatggagtcttgctctgtcgcccaggctggagtgcaatggctcaatctcagctcactgcaacttccgcctccttggttcaagcaattctgcctcagcctcccaagtagctgggattacaggcacccgccaccatacctggctacttttagtagagacggggttccaccatgttggccaggctggtctcgaactccatacctcaggtgatccgtctgcctcggcctcccaaagtgctagaattgcaggcgttagccaccattcccggccaagaattgttaaaattttttaaaacttggtaacttaaatgtacactatggtttagttatgcattcctagagaactgctatttctcaccctcaaactgctcttatttgggagacttgttatctttcatttttctagaattttttttttttttttgagacggagtttcactcttgttgcacaggatggagtgcaatggcacgatctcggctcactgcaacctccacctcccgggttcaagtgattctcctgcctcagcctcctgagtagctgagattacaggcatgcgccaccatgcctggctaagtttctattttttagtaaagatggagtttctccatgtcggtcaggctggtctcgaactcccgacctcaggtgatctgcctgcctcagcctcccaaagtgctaggattataggcatgagccaccgcgcccggcctatttttctagaatcttaatatgtttagttgggaggtgtcccagaaatcctgatgaaaagtatagcaaaatcagaattttggtaatgattagcaagtataatactgctttgaactcagtacttttatatgaagcatataaagttacaaaaaaaactaatgtattcaaatatttgaatatatcttcatgtttgtataatgtttttattcaataaaaatgaaatttctcatttaaa

SEQ ID NO: 106118 - DNA, 2723 bp, Homo sapiens
  Payload ID: 804
  Gene Symbol: AAED1
  Gene Name: AhpC/TSA antioxidant enzyme domain containing 1
  ENST ID: ENST00000446045
  CDS Start-End: 1-541
aggccctcggccgccccgcgtcatggccgcgccggccccggtcacgcggcagcatttcctgtgttacatctgcaaggaatacgtagaggatctggccaaaatccccaggagtttcttacaagaagcaaatgtcacccttatagtgattggacagtcatcctaccatcatattgagcctttttgcaagctgactggatattctcatgaaatctatgtcgatcctgagagagaaatttataaaagattgggaatgaaaagaggtgaagaaattgcttcctcaggacagagcccccacataaaatcaaatctactctcaggaagccttcagagcctgtggcgggcagtgactggccctctctttgattttcaaggagacccagctcagcaaggtggaaccctcattttaggtccaggtaacaacatccattttatacaccgcgataggaataggttggatcacaaacctatcaactctgttttacagcttgtaggagttcagcatgtgaactttacaaacagaccttcagttatccatgtgtgacttaaaatgcactcagtcactttcaactggaccttctggaatgtgaccttcaatgcctgggtgtaatatcctcgtgcagtgtctaacctgctgtcccttcccagcctttgaggagttagggaagcataaagggggcttgaacctgttgaattgcatgctgggaagcatcagttgtcaaaatatgttatatacttccattttataacttttaacattttatacaaaaaaaatgaatatacaaaatataactttaaaagctataaaatcataaatactctaaattattttacattatggtatattcagtcaatgaaagagttttttggcaatataaattctgacagtatataaggggacaggagaacaacacaagaccattatattcagtgaagaaggcaaaatatcaaatctgtcaacaatgtaactgcatttttatatgtatatatttgtatttttgtatgctttggaaaaagacaggaaataaacaccaaaatgttgccagtaggtatctctgtgttaagattagtgttattattttcttttctgtacttttctgtatttcccaactgttatataatgagcatgattaatattgtagggccaggaaaaggtctttaaacattataggacaattttatgccacataacaaccttcacaaaagagcaaaattatataagctgtagtccacttttccatcgtaattgctttactcagaggaagtgtggcaatccgaacatttcacatatagccagtgtccacagcaccttctcaaactacatacttgctatccgtttcactaggattttggggggttgggggagctatggagaaaaaaattgttttagatatttaagatatgtatttaaaaatatggtcagtgtgctttttgaaagggaactataagaattttttttttttttttttttgagatggagtctcactctgttgcccaggctggagtgcagtggcatgatctcggctcactgcaagttccgcctcccgggttcacgccattctcctgcctcagcctcccgagtagctgggactacaggcacccaccaccacgcccggctaattttttgtatttttattagagacggggtttcactgtgttataacagccaggatggtcttgacctcctgacctcatgatccgcccacctcggcctcccaatgtgttgggattacaggtatgagccaccttgcctggcttttttttttttttttttttttttttttttgagatggagtcttgctctgtcgcccaggctggagtgcaatggctcaatctcagctcactgcaacttccgcctccttggttcaagcaattctgcctcagcctcccaagtagctgggattacaggcacccgccaccatacctggctacttttagtagagacggggttccaccatgttggccaggctggtctcgaactccatacctcaggtgatccgtctgcctcggcctcccaaagtgctagaattgcaggcgttagccaccattcccggccaagaattgttaaaattttttaaaacttggtaacttaaatgtacactatggtttagttatgcattcctagagaactgctatttctcaccctcaaactgctcttatttgggagacttgttatctttcatttttctagaattttttttttttttttgagacggagtttcactcttgttgcacaggatggagtgcaatggcacgatctcggctcactgcaacctccacctcccgggttcaagtgattctcctgcctcagcctcctgagtagctgagattacaggcatgcgccaccatgcctggctaagtttctattttttagtaaagatggagtttctccatgtcggtcaggctggtctcgaactcccgacctcaggtgatctgcctgcctcagcctcccaaagtgctaggattataggcatgagccaccgcgcccggcctatttttctagaatcttaatatgtttagttgggaggtgtcccagaaatcctgatgaaaagtatagcaaaatcagaattttggtaatgattagcaagtataatactgctttgaactcagtacttttatatgaagcatataaagttacaaaaaaaactaatgtattcaaatatttgaatatatcttcatgtttgtataatgtttttattcaataaaaatgaaatttctcatttaaa

SEQ ID NO: 106119 - DNA, 2514 bp, Homo sapiens
  Payload ID: 804
  Gene Symbol: AAED1
  Gene Name: AhpC/TSA antioxidant enzyme domain containing 1
  ENST ID: ENST00000411939
  CDS Start-End: 1-332
aatacgtagaggatctggccaaaatccccaggagtttcttacaagaagcaaatgtcacccttatagtgattggacagtcatcctaccatcatattgagcctttttgcaagctgactggatattctcatgaaatctatgtcgatcctgagagagaaatttataaaagattgggaatgaaaagaggtgaagaaattgcttcctcaggtaacaacatccattttatacaccgcgataggaataggttggatcacaaacctatcaactctgttttacagcttgtaggagttcagcatgtgaactttacaaacagaccttcagttatccatgtgtgacttaaaatgcactcagtcactttcaactggaccttctggaatgtgaccttcaatgcctgggtgtaatatcctcgtgcagtgtctaacctgctgtcccttcccagcctttgaggagttagggaagcataaagggggcttgaacctgttgaattgcatgctgggaagcatcagttgtcaaaatatgttatatacttccattttataacttttaacattttatacaaaaaaaatgaatatacaaaatataactttaaaagctataaaatcataaatactctaaattattttacattatggtatattcagtcaatgaaagagttttttggcaatataaattctgacagtatataaggggacaggagaacaacacaagaccattatattcagtgaagaaggcaaaatatcaaatctgtcaacaatgtaactgcatttttatatgtatatatttgtatttttgtatgctttggaaaaagacaggaaataaacaccaaaatgttgccagtaggtatctctgtgttaagattagtgttattattttcttttctgtacttttctgtatttcccaactgttatataatgagcatgattaatattgtagggccaggaaaaggtctttaaacattataggacaattttatgccacataacaaccttcacaaaagagcaaaattatataagctgtagtccacttttccatcgtaattgctttactcagaggaagtgtggcaatccgaacatttcacatatagccagtgtccacagcaccttctcaaactacatacttgctatccgtttcactaggattttggggggttgggggagctatggagaaaaaaattgttttagatatttaagatatgtatttaaaaatatggtcagtgtgctttttgaaagggaactataagaattttttttttttttttttttgagatggagtctcactctgttgcccaggctggagtgcagtggcatgatctcggctcactgcaagttccgcctcccgggttcacgccattctcctgcctcagcctcccgagtagctgggactacaggcacccaccaccacgcccggctaattttttgtatttttattagagacggggtttcactgtgttataacagccaggatggtcttgacctcctgacctcatgatccgcccacctcggcctcccaatgtgttgggattacaggtatgagccaccttgcctggcttttttttttttttttttttttttttttttgagatggagtcttgctctgtcgcccaggctggagtgcaatggctcaatctcagctcactgcaacttccgcctccttggttcaagcaattctgcctcagcctcccaagtagctgggattacaggcacccgccaccatacctggctacttttagtagagacggggttccaccatgttggccaggctggtctcgaactccatacctcaggtgatccgtctgcctcggcctcccaaagtgctagaattgcaggcgttagccaccattcccggccaagaattgttaaaattttttaaaacttggtaacttaaatgtacactatggtttagttatgcattcctagagaactgctatttctcaccctcaaactgctcttatttgggagacttgttatctttcatttttctagaattttttttttttttttgagacggagtttcactcttgttgcacaggatggagtgcaatggcacgatctcggctcactgcaacctccacctcccgggttcaagtgattctcctgcctcagcctcctgagtagctgagattacaggcatgcgccaccatgcctggctaagtttctattttttagtaaagatggagtttctccatgtcggtcaggctggtctcgaactcccgacctcaggtgatctgcctgcctcagcctcccaaagtgctaggattataggcatgagccaccgcgcccggcctatttttctagaatcttaatatgtttagttgggaggtgtcccagaaatcctgatgaaaagtatagcaaaatcagaattttggtaatgattagcaagtataatactgctttgaactcagtacttttatatgaagcatataaagttacaaaaaaaactaatgtattcaaatatttgaatatatcttcatgtttgtataatgtttttattcaataaaaatgaaatttctcatttaaa

SEQ ID NO: 106120 - DNA, 308 bp, Homo sapiens
  Payload ID: 805
  Gene Symbol:
  Gene Name: AJ239318.1
  ENST ID: ENST00000624445
  CDS Start-End: 86-274
cttctgcaaagatctatttgtttagccatgttcaaatattgccctaaaatgttcacaggttccaggataaccagatgactgaggaatgttgaagattgcagtgatggaagtgcctcagtcagcctggaagactgtatggatggaggttgcctggtcacactgtcatgtccctctctccctgaaaaagagacacatttgcctttgtgcaaggcaatacatacatttgatctatgtatacactttggtctatgcattctgttatttaacattctaataatgttgatgaccttaaaatatgcttgacaatg

SEQ ID NO: 106121 - DNA, 4262 bp, Homo sapiens
  Payload ID: 806
  Gene Symbol: AJUBA
  Gene Name: ajuba LIM protein
  Uniprot ID: Q96IF1
  ENST ID: ENST00000262713
  CDS Start-End: 377-1993
agatccggccaggcagacaaaagtttgggagagaagttcggtctgtggctagcgtgagagctaggggggcgggggccggggagagtggggcagtcgggcgagtcgacgcgtgaacagatagacctgcggactggacagccgcggccagagaccctgctagccccgctcagccccagatgcgcggggggacgcagcccctcccgctgggggatgctgtgggattcctggcgcagggcatccaggccgcccgctaagcccctgtgcctcccctgtgcccctggggaaccagagtccggctgcagggaaagagaaccggccgccgagacgccgcagggtgccaggcggggagggggcgagaggccccaggcccgagggcatggagcggttaggagagaaagccagtcgcctgctggagaagttcggccgcagaaagggtgaatctagccggtctgggtctgacgggacccccgggccgggcaaggggcgcctaagtgggttggggggacctaggaagtcagggccccgaggagctactgggggacctggggatgagccgttggagccggcccgggagcaaggttccctggacgctgagcgaaatcagcgcggctcctttgaggcgccgcgctacgaaggctcttttcccgcggggccgccgcccacccgggccttgcctctacctcagtcgttgccccccgattttcggctggagcccacggccccggccctcagcccccgctctagcttcgccagtagctcggccagcgacgcgagcaagccgtccagcccccggggcagcctgctgctggacggggcgggggctggcggagctggaggtagccggccctgcagcaatcgcaccagcggcatcagcatgggctacgaccagcgccacgggagccccttgccagcggggccgtgcctgtttggcccacccctggccggagcaccggcaggctattctcccggaggggtcccgtccgcctacccggagctccacgccgccctggaccgattgtacgctcagcggcccgcggggttcggctgccaggaaagccgccactcgtatcccccggccctgggcagccctggagctctagccggggccggagtgggagcggcggggcccttggagagacggggggcgcaacccggacgacactctgtgaccggctacggggactgcgccgtgggcgcccggtaccaggacgagctaacagctttgcttcgcctgacggtgggcaccggtgggcgagaagccggagcccgcggagaaccctcggggattgagccgtcgggtctggaggagccaccaggtcctttcgttccggaggccgcccgggcccggatgcgggagccagaggccagggaggactacttcggcacctgtatcaagtgcaacaaaggcatctatgggcagagcaatgcctgccaggccctggacagcctctaccacacccagtgctttgtttgctgctcttgtgggcgaactttgcgttgcaaggctttctacagtgtcaatggctctgtgtactgtgaggaagattatctgttttcagggtttcaggaggcagctgagaaatgctgtgtctgtggtcacttgattttggagaagatcctacaagcaatggggaagtcctatcatccaggctgtttccgatgcattgtttgcaacaagtgcctggatggcatccccttcacagtggacttctccaaccaagtatactgtgtcaccgactaccacaaaaattatgctcctaagtgtgcagcctgtggccaacccatcctcccctctgagggctgtgaggacatcgtgagggtgatatccatggaccgggattatcactttgagtgctaccactgtgaggactgccggatgcagctgagtgatgaggaaggctgctgctgtttccctctggatgggcacttgctctgccatggttgccacatgcagcggctcaatgcccgacaaccccctgccaactatatctgagctgcaatcactgctgctgctgtcaccctgcagacaaactgctgtggccagtgggcccctctgaggccagccaaggcaaagaatgcactctgcaggcctggcagaagagtcctctggggaggaccccaagggccggagacccaaagatcatgatattccaaatggattgtggaagagaaaccttatatttaccagggtgggggcgactggcctttttcccatgtgtgcagtctgagcttaggcacacacaggagggttccaggactttctgaacatctgattctgtatcttcagtatatatattttgtttgttttagagatgggatctcaccatgttgcccaggctagtcttgaactcctgggctcgaatgatcctcccaccttggcctcccaaagtgctgggattataggcgtaagccactgtgtctggcctagtgtatgattatgcatgagtcacgcaatgttctggtcctggattccaggagtagaggacctagctttaaatcaattagtttcagctaaactgactagaaccaaatcaaagtgtaattctccctccagctcccccaaaccccagagttttggggttgtggttgatgcagtgtgggatgtccctgagaggtagcaagtctagggtggtgagttcctgctaggcaaccaaatttaagctcctcactttttgtgacacatggtgtcagatatggggtcccgcacctatatctggatgaagaggtagaaactctggacctcattaatgagttatttcttggccttcttctaaggactaggagagctccttatctgtctgagaatggggaccagctctgagtggggttgctgcctgtattccctgtttctcaggaacttacatgggtctggggaggctaggtaggtgattgtacgtggttgctcttctccttggctgggggaggtaatgagcagatctctgtgggtgtggagcttgttggggggatgtctaggaagcttcagcttagccacattcccaagtttaggtgcactgagccatatagcccagtgtatgcatgtgtgggtgtgttcatgcacacacacactctctctcttgtctctctgtctctctctcactctttcttactctcttctcaggtcacttgtacacttggtttcctagtagaagctcacttgccacctctcagaggggtcccggattgcatccatcacaatcccaaaactagagttggggggaactggagggagcaaaacactgatttgatactagtcagtttgcttgaaactagttcacctaaagctagatctcttaaaaccaatttactgaaaacttgtttgcttaaagttaatgacttaatgactaatttgccaaaagctcaattcctattttggtgtgtttatatccatttaggtgtcctattcttttttgtcatgctttggatatttcaaggatttatatctattcatccaagagtacttctgagctattatcagcaacataaatttatcaaatttgcagcactttgtaaatgatgagattgcttcctacctttatggatgtctttttctatgttatctaccattcaaaaacttttttaaaaagtttaaagtttctagcaataaatacaattggtacagacattttgtgtatcatttttttgtttcttaatccaatattcctttacaaattaaatgccttgaaaaatataatggagttcaatgtgattttgatgctttggtctaacttctacattcctactgttaaaaaggccagtatatcttaaacaaatgaataggcatgaggcatattcagttgacttacaatgaaaagttatacagacaacagtaataactaaaagggtgaatctgctaaatccttttgaaatgctgcagatttgataaatatttattttagactaattggttttaggtgaattggttttaggcaaattaatttagtaatctttgatctttagtcttcattttctgtcactcagtgagtttcttactggaaatgatgactcctgacaacagaatttccacatttgggggctattctaaggtgactatgccagccaacctgggaaatacataaaagagatctctgagtgagagggaaagaggtcagatttatacaactgagcgccagaggggaaaatgcaccttgttggagtgagaaatgttctgaaactgaattacttcttgtacagctgagatagcttcttctgaactattattaaataagtgaatacaaaggccctatgatgggaaatccagacaa

SEQ ID NO: 106122 - DNA, 2569 bp, Homo sapiens
  Payload ID: 806
  Gene Symbol: AJUBA
  Gene Name: ajuba LIM protein
  Uniprot ID: Q96IF1
  ENST ID: ENST00000361265
  CDS Start-End: 73-1689
aaagagaaccggccgccgagacgccgcagggtgccaggcggggagggggcgagaggccccaggcccgagggcatggagcggttaggagagaaagccagtcgcctgctggagaagttcggccgcagaaagggtgaatctagccggtctgggtctgacgggacccccgggccgggcaaggggcgcctaagtgggttggggggacctaggaagtcagggccccgaggagctactgggggacctggggatgagccgttggagccggcccgggagcaaggttccctggacgctgagcgaaatcagcgcggctcctttgaggcgccgcgctacgaaggctcttttcccgcggggccgccgcccacccgggccttgcctctacctcagtcgttgccccccgattttcggctggagcccacggccccggccctcagcccccgctctagcttcgccagtagctcggccagcgacgcgagcaagccgtccagcccccggggcagcctgctgctggacggggcgggggctggcggagctggaggtagccggccctgcagcaatcgcaccagcggcatcagcatgggctacgaccagcgccacgggagccccttgccagcggggccgtgcctgtttggcccacccctggccggagcaccggcaggctattctcccggaggggtcccgtccgcctacccggagctccacgccgccctggaccgattgtacgctcagcggcccgcggggttcggctgccaggaaagccgccactcgtatcccccggccctgggcagccctggagctctagccggggccggagtgggagcggcggggcccttggagagacggggggcgcaacccggacgacactctgtgaccggctacggggactgcgccgtgggcgcccggtaccaggacgagctaacagctttgcttcgcctgacggtgggcaccggtgggcgagaagccggagcccgcggagaaccctcggggattgagccgtcgggtctggaggagccaccaggtcctttcgttccggaggccgcccgggcccggatgcgggagccagaggccagggaggactacttcggcacctgtatcaagtgcaacaaaggcatctatgggcagagcaatgcctgccaggccctggacagcctctaccacacccagtgctttgtttgctgctcttgtgggcgaactttgcgttgcaaggctttctacagtgtcaatggctctgtgtactgtgaggaagattatctgttttcagggtttcaggaggcagctgagaaatgctgtgtctgtggtcacttgattttggagaagatcctacaagcaatggggaagtcctatcatccaggctgtttccgatgcattgtttgcaacaagtgcctggatggcatccccttcacagtggacttctccaaccaagtatactgtgtcaccgactaccacaaaaattatgctcctaagtgtgcagcctgtggccaacccatcctcccctctgagggctgtgaggacatcgtgagggtgatatccatggaccgggattatcactttgagtgctaccactgtgaggactgccggatgcagctgagtgatgaggaaggctgctgctgtttccctctggatgggcacttgctctgccatggttgccacatgcagcggctcaatgcccgacaaccccctgccaactatatctgagctgcaatcactgctgctgctgtcaccctgcagacaaactgctgtggccagtgggcccctctgaggccagccaaggcaaagaatgcactctgcaggcctggcagaagagtcctctggggaggaccccaagggccggagacccaaagatcatgatattccaaatggattgtggaagagaaaccttatatttaccagggtgggggcgactggcctttttcccatgtgtgcagtctgagcttaggcacacacaggagggttccaggactttctgaacatctgattctgtatcttcagtatatatattttgtttgttttagagatgggatctcaccatgttgcccaggctagtcttgaactcctgggctcgaatgatcctcccaccttggcctcccaaagtgctgggattataggcgtaagccactgtgtctggcctagtgtatgattatgcatgagtcacgcaatgttctggtcctggattccaggagtagaggacctagctttaaatcaattagtttcagtttgcttgaaactagttcacctaaagctagatctcttaaaaccaatttactgaaaacttgtttgcttaaagttaatgacttaatgactaatttgccaaaagctcaattcctattttggtgtgtttatatccatttaggtgtcctattcttttttgtcatgctttggatatttcaaggatttatatctattcatccaagagtacttctgagctattatcagcaacataaatttatcaaatttgcagcactttgtaaatgatgagattgcttcctacctttatggatgtctttttctatgttatctaccattcaaaaacttttttaaaaagtttaaagtttctagcaataaatacaattggtac

SEQ ID NO: 106123 - DNA, 2648 bp, Homo sapiens
  Payload ID: 806
  Gene Symbol: AJUBA
  Gene Name: ajuba LIM protein
  Uniprot ID: Q96IF1
  ENST ID: ENST00000397388
  CDS Start-End: 655-1020
taactccagtcctgacctccatggagtctgtccctggaaggagacaggcatttgagagcaggatagatatgctcaggcaaagaggcttctaggttgaagggtcccagagggaaaggcctgttaacaatgtggttctctctatgcaaatcatatagcaccttattaagagctcacgtattccagcacgtagttggctttactctcccaggtggcttcctatgcactggagaggaaggcagtttgtttaggggaggggccctagaaaactgttaaggaggcaggagctggaggagcagcaagcagaggagaggggaagttggctggaatgaagccaaagcaaattggaattgcatcagatggaatttttgtgcggggaaggacagacagcagttaggaggaaaagcacaaagtccaggtttaaatatattatgcagcagcggggagcagtgaccccagaagtcttgcacctgggctgtgggataggttccagccccttctctattgtttctagggcgaactttgcgttgcaaggctttctacagtgtcaatggctctgtgtactgtgaggaagattatctgttttcagggtttcaggaggcagctgagaaatgctgtgtctgtggtcacttgattttggagaagatcctacaagcaatggggaagtcctatcatccaggctgtttccgatgcattgtttgcaacaagtgcctggatggcatccccttcacagtggacttctccaaccaagtatactgtgtcaccgactaccacaaaaattatgctcctaagtgtgcagcctgtggccaacccatcctcccctctgagggctgtgaggacatcgtgagggtgatatccatggaccgggattatcactttgagtgctaccactgtgaggactgccggatgcagctgagtgatgaggaaggctgctgctgtttccctctggatgggcacttgctctgccatggttgccacatgcagcggctcaatgcccgacaaccccctgccaactatatctgagctgcaatcactgctgctgctgtcaccctgcagacaaactgctgtggccagtgggcccctctgaggccagccaaggcaaagaatgcactctgcaggcctggcagaagagtcctctggggaggaccccaagggccggagacccaaagatcatgatattccaaatggattgtggaagagaaaccttatatttaccagggtgggggcgactggcctttttcccatgtgtgcagtctgagcttaggcacacacaggagggttccaggactttctgaacatctgattctgtatcttcagtatatatattttgtttgttttagagatgggatctcaccatgttgcccaggctagtcttgaactcctgggctcgaatgatcctcccaccttggcctcccaaagtgctgggattataggcgtaagccactgtgtctggcctagtgtatgattatgcatgagtcacgcaatgttctggtcctggattccaggagtagaggacctagctttaaatcaattagtttcagctaaactgactagaaccaaatcaaagtgtaattctccctccagctcccccaaaccccagagttttggggttgtggttgatgcagtgtgggatgtccctgagaggtagcaagtctagggtggtgagttcctgctaggcaaccaaatttaagctcctcactttttgtgacacatggtgtcagatatggggtcccgcacctatatctggatgaagaggtagaaactctggacctcattaatgagttatttcttggccttcttctaaggactaggagagctccttatctgtctgagaatggggaccagctctgagtggggttgctgcctgtattccctgtttctcaggaacttacatgggtctggggaggctaggtaggtgattgtacgtggttgctcttctccttggctgggggaggtaatgagcagatctctgtgggtgtggagcttgttggggggatgtctaggaagcttcagcttagccacattcccaagtttaggtgcactgagccatatagcccagtgtatgcatgtgtgggtgtgttcatgcacacacacactctctctcttgtctctctgtctctctctcactctttcttactctcttctcaggtcacttgtacacttggtttcctagtagaagctcacttgccacctctcagaggggtcccggattgcatccatcacaatcccaaaactagagttggggggaactggagggagcaaaacactgatttgatactagtcagtttgcttgaaactagttcacctaaagctagatctcttaaaaccaatttactgaaaacttgtttgcttaaagttaatgacttaatgactaatttgccaaaagctcaattcctattttggtgtgtttatatccatttaggtgtcctattcttttttgtcatgctttggatatttcaaggatttatatctattcatccaagagtacttctgagctattatcagcaacataaatttatcaaatttgcagcactttgtaaatgatgagattgcttcctacctttatggatgtctttttctatgttatctaccattcaaaaacttttttaaaaagtttaaagtttctagcaataaatacaattggtacagac

SEQ ID NO: 106124 - DNA, 651 bp, Homo sapiens
  Payload ID: 806
  Gene Symbol: AJUBA
  Gene Name: ajuba LIM protein
  ENST ID: ENST00000556731
  CDS Start-End: 412-651
actgcttacccattctgattcctttgctaaacctttaatctcctatctctgcctgtctgacttcagcactcagcttttctcactcccccagtttctgcctggttctctttaggctcatctgtctgtctatccttctgtttacagggcctcttctggctatatctctttccctatctttcctcccctgtgtctcatgagcttctaagtcagctttcctaacccactggacagagttggaagtagggattttgaggggaagaaggcaaagggcgaactttgcgttgcaaggctttctacagtgtcaatggctctgtgtactgtgaggaagattatctgttttcagggtttcaggaggcagctgagaaatgctgtgtctgtggtcacttgattttggagaagatcctacaagcaatggggaagtcctatcatccaggctgtttccgatgcattgtttgcaacaagtgcctggatggcatccccttcacagtggacttctccaaccaagtatactgtgtcaccgactaccacaaaaattatgctcctaagtgtgcagcctgtggccaacccatcctcccctctgagggctgtgaggacatcgtgagggtgatatccatggaccgggattatcactttgagtgctaccactgtgag

SEQ ID NO: 106125 - DNA, 751 bp, Homo sapiens
  Payload ID: 806
  Gene Symbol: AJUBA
  Gene Name: ajuba LIM protein
  ENST ID: ENST00000553736
  CDS Start-End: 1-430
ccgccactcgtatcccccggccctgggcagccctggagctctagccggggccggagtgggagcggcggggcccttggagagacggggggcgcaacccggacgacactctgtgaccggctacggggactgcgccgtgggcgcccggtaccaggacgagctaacagctttgcttcgcctgacggtgggcaccggtgggcgagaagccggagcccgcggagaaccctcggggattgagccgtcgggtctggaggagccaccaggtcctttcgttccggaggccgcccgggcccggatgcgggagccagaggccagggaggactacttcggaatcatgctcacatggtcccctctgcacggagccctctgccaagccagatccttttctccatccttggaagtctgcagtggagagaaatcattctataactgaacagctcgtttgactgatgggaaactgaagtcccagagacgatttctgggcctagcctgctttctctagaaagtattttcaagtctgctgctgagcacctgtggactggcatctttgaccgttcatcctacacactgcaacagagatcataccttgcctgtgtagtcttttctccccaacagaaactaagcatctgaatgccagggaccatatcttcgactttctccaggtttccttaggtagtggtgctgtgttaagcacaaaacagatgctcagaaaatatctgttgagtaattaaataaacaagaatggatctgctca

SEQ ID NO: 106126 - DNA, 567 bp, Homo sapiens
  Payload ID: 806
  Gene Symbol: AJUBA
  Gene Name: ajuba LIM protein
  ENST ID: ENST00000553911
  CDS Start-End: 374-567
aaatatattatgcagcagcggggagcagtgaccccagaagtcttgcacctgggctgtgggataggttccagccccttctctattgtttctagggcgaactttgcgttgcaaggctttctacagtgtcaatggctctgtgtactgtgaggaagattatctgttttcagggtttcaggaggcagctgagaaatgctgtgtctgtggtcacttgattttggagaagatggagtctcactctgttgcccaggctggagtccagtggtgcgatctcggcttactgcaagctccgcctcctggttcacgccattctcctgcctagctgggactacaggcgcccgccacatgcccggctaattttttgatcctacaagcaatggggaagtcctatcatccaggctgtttccgatgcattgtttgcaacaagtgcctggatggcatccccttcacagtggacttctccaaccaagtatactgtgtcaccgactaccacaaaaattatgctcctaagtgtgcagcctgtggccaacccatcctcccctctgagggctgtgaggacatcgtgagggt

SEQ ID NO: 106127 - DNA, 418 bp, Homo sapiens
  Payload ID: 806
  Gene Symbol: AJUBA
  Gene Name: ajuba LIM protein
  ENST ID: ENST00000553592
  CDS Start-End: 179-418
cagacagcagttaggaggaaaagcacaaagtccagggcgaactttgcgttgcaaggctttctacagtgtcaatggctctgtgtactgtgaggaagattatctgttttcagggtttcaggaggcagctgagaaatgctgtgtctgtggtcacttgattttggagaagatcctacaagcaatggggaagtcctatcatccaggctgtttccgatgcattgtttgcaacaagtgcctggatggcatccccttcacagtggacttctccaaccaagtatactgtgtcaccgactaccacaaaaattatgctcctaagtgtgcagcctgtggccaacccatcctcccctctgagggctgtgaggacatcgtgagggtgatatccatggaccgggattatcactttgagtgctaccactgtgag

SEQ ID NO: 106128 - DNA, 1330 bp, Homo sapiens
  Payload ID: 807
  Gene Symbol: AKIRIN1
  Gene Name: akirin 1
  ENST ID: ENST00000372984
  CDS Start-End: 94-531
attggagccggcttggctggcgagcccggctgaggagcctcttgggccgcacttaccgccgcgtccgctcccggtccctggcccctcagcggcatggcgtgcggggcgacgctgaagcggcccatggagttcgaggcggcgctgctgagccccggctccccgaagcggcggcgctgcgcccctctgcccggccccactccgggcctcaggcccccggacgccgagccgccgccgccgtttcagacgcagaccccaccgcagagtctgcagcagcccgccccgcccggcagcgagcggcgccttccaactccgggttcctcatggatgaagaaggaccagcccacatttaccctccgacaagttggcataatatgtgagcgcctcttaaaagactatgaagataaaattcgggaggagtatgagcaaatcctcaataccaaactagcagaacaatatgaatcttttgtgaaattcacacatgatcagattatgcgacggtatgggacaaggccaacaagctatgtgtcatgaagctttgtcacatatctgggtaccaggtttgacctcaagagatggctgctgtacactttttgcaactggtttgatgtcacatttcagctccaactttgcatcctgagaacacttaaacgtttctgcaggtccattttatacaacttgaaagaccgtaaaactttctggttgccacaagcatatctttcttttctgctcatccaataaacagctgtgccctactgtgatagattttccaaacaaaaatacctggagcagcagtttagcaaaatatgccttcagtggcattcaacaaatggagtttccccaagcacagttctgtaagaagtgcgtgtgagagtgtgtgtatatgtgtgtatgtgtattttaagttattatttgtattgtgcaaaaatttttttttgatcttggggattctggctgtgaatttggtgcacgacaattatggtaaaaaaacatttgcttggtctaaagaagatcattaatgttttgtgaccatacaagttgtaacagtggattgtttttatgtgtaggtattgttaaatacagggactgtttccaggcacagaatatgaatcgtaagttaggatggacattagatgtgattatgatgataaagcgaaggtctgcggtcctatatctacagacacgtggtgagaaattagaacaaactggagacgggccattgacacatggactctgcctgggcatgttaggttaattctttgactccaagccttaaaatactcacatggagtcagcgctcacctcattcacacaattatcatagagctccctg

SEQ ID NO: 106129 - DNA, 1243 bp, Homo sapiens
  Payload ID: 807
  Gene Symbol: AKIRIN1
  Gene Name: akirin 1
  Uniprot ID: Q9H9L7
  ENST ID: ENST00000446189
  CDS Start-End: 94-537
attggagccggcttggctggcgagcccggctgaggagcctcttgggccgcacttaccgccgcgtccgctcccggtccctggcccctcagcggcatggcgtgcggggcgacgctgaagcggcccatggagttcgaggcggcgctgctgagccccggctccccgaagcggcggcgctgcgcccctctgcccggccccactccgggcctcaggcccccggacgccgagccgccgccgccgtttcagacgcagaccccaccgcagagtctgcagcagcccgccccgcccggcagcgagcggcgccttccaactccggagcaaatttttcagaacataaaacaagaatatagtcgttatcagaggtggagacatttagaagttgttcttaatcagagtgaagcttgtgcttcggaaagtcaacctcactcctcagcactcacagcacctagctctccagaacaatatgaatcttttgtgaaattcacacatgatcagattatgcgacggtatgggacaaggccaacaagctatgtgtcatgaagctttgtcacatatctgggtaccaggtttgacctcaagagatggctgctgtacactttttgcaactggtttgatgtcacatttcagctccaactttgcatcctgagaacacttaaacgtttctgcaggtccattttatacaacttgaaagaccgtaaaactttctggttgccacaagcatatctttcttttctgctcatccaataaacagctgtgccctactgtgatagattttccaaacaaaaatacctggagcagcagtttagcaaaatatgccttcagtggcattcaacaaatggagtttccccaagcacagttctgtaagaagtgcgtgtgagagtgtgtgtatatgtgtgtatgtgtattttaagttattatttgtattgtgcaaaaatttttttttgatcttggggattctggctgtgaatttggtgcacgacaattatggtaaaaaaacatttgcttggtctaaagaagatcattaatgttttgtgaccatacaagttgtaacagtggattgtttttatgtgtaggtattgttaaatacagggactgtttccaggcacagaatatgaatcgtaagttaggatggacattagatgtgattatgatgataaagcgaaggtctgcggtcctatatctacagacacgtggtgagaaattagaacaaactggagacgggccattgacacatggactctgcctg

SEQ ID NO: 106130 - DNA, 2741 bp, Homo sapiens
  Payload ID: 807
  Gene Symbol: AKIRIN1
  Gene Name: akirin 1
  Uniprot ID: Q9H9L7
  ENST ID: ENST00000432648
  CDS Start-End: 159-737
gatggtgtgcgcccgtgacgtcacagaaggcggggccagcgccgctgccgggtgctggaggcgccattggagccggcttggctggcgagcccggctgaggagcctcttgggccgcacttaccgccgcgtccgctcccggtccctggcccctcagcggcatggcgtgcggggcgacgctgaagcggcccatggagttcgaggcggcgctgctgagccccggctccccgaagcggcggcgctgcgcccctctgcccggccccactccgggcctcaggcccccggacgccgagccgccgccgccgtttcagacgcagaccccaccgcagagtctgcagcagcccgccccgcccggcagcgagcggcgccttccaactccggagcaaatttttcagaacataaaacaagaatatagtcgttatcagaggtggagacatttagaagttgttcttaatcagagtgaagcttgtgcttcggaaagtcaacctcactcctcagcactcacagcacctagctctccaggttcctcatggatgaagaaggaccagcccacatttaccctccgacaagttggcataatatgtgagcgcctcttaaaagactatgaagataaaattcgggaggagtatgagcaaatcctcaataccaaactagcagaacaatatgaatcttttgtgaaattcacacatgatcagattatgcgacggtatgggacaaggccaacaagctatgtgtcatgaagctttgtcacatatctgggtaccaggtttgacctcaagagatggctgctgtacactttttgcaactggtttgatgtcacatttcagctccaactttgcatcctgagaacacttaaacgtttctgcaggtccattttatacaacttgaaagaccgtaaaactttctggttgccacaagcatatctttcttttctgctcatccaataaacagctgtgccctactgtgatagattttccaaacaaaaatacctggagcagcagtttagcaaaatatgccttcagtggcattcaacaaatggagtttccccaagcacagttctgtaagaagtgcgtgtgagagtgtgtgtatatgtgtgtatgtgtattttaagttattatttgtattgtgcaaaaatttttttttgatcttggggattctggctgtgaatttggtgcacgacaattatggtaaaaaaacatttgcttggtctaaagaagatcattaatgttttgtgaccatacaagttgtaacagtggattgtttttatgtgtaggtattgttaaatacagggactgtttccaggcacagaatatgaatcgtaagttaggatggacattagatgtgattatgatgataaagcgaaggtctgcggtcctatatctacagacacgtggtgagaaattagaacaaactggagacgggccattgacacatggactctgcctgggcatgttaggttaattctttgactccaagccttaaaatactcacatggagtcagcgctcacctcattcacacaattatcatagagctccctggacactgaacctctaaagggaaaaggtctaccctggagccaggagcatcagggttggcttgggagcatgagaggtgagcccagggctaggcctgggccaggccccggcagcactgctacttgggaggagccacttcacctttgtattagttattaaaaaatataatttgggctgggcgcagtggctcacgcctgtaatcccagcactttgggagtccgaggcatgcggatcacttgaggtcaggagttcgagaccaccctggccaatatggtgaaaccccatctctactaaaaatacaacaaagttagccgggcgtggtggcaggcgtctgtaatcccagctgcttgggaggctgaggcaggagaatcacttgaaccctggaggtggcggttgcagtgagcacagatcatgccactgcactccagcctgggcaacaaaacgagacttcgtctcaaaaaaaaaaaaaaaacatagaatttggatcctttggtcgggttctcccaaattcttttgaggtgtccatggtcaactgcttcagctttgttttggcaaccccctgcccgaagtcgcatataggctgttcttcaccttgtttccaaggctgaggaacagaaagtagcctctgttttgaggaggtggaagttaagtatacatttattttttactgtgacttgttcaggaccacattttacaaaatgccttgtttccttcattgtttctggaaaggaaagttctattaatattgttttactttgaatatagaatagtttttttaattagggcttattttgaaaaattctgagtttaattcaaatgtatgccaataccttccaaagtaaggtaatattcagagacagttgttgtgatcagatggcttagagaaatttctggaatattcacattcgaagattccttattaatgaatgtctttgacttaaatctaaccaaaaactgcaacattattctttgtacattttcattatatagtgttaacaagcttagttgcaaacaaataaaatacttaagctatttgtttaccttgccttcttaatactgtgataatgtttattaattcaaataacttatgtgagagctgctataaccatttccccagttcaacattgcattgaaaatttatggacctttaaaaaaaaaagcccaacagtgatttttttttaataattaaagaatgattttactttgta

SEQ ID NO: 106131 - DNA, 718 bp, Homo sapiens
  Payload ID: 807
  Gene Symbol: AKIRIN1
  Gene Name: akirin 1
  ENST ID: ENST00000531822
  CDS Start-End: 1-392
ggcccccggacgccgagccgccgccgccgtttcagacgcagaccccaccgcagagtctgcagcagcccgccccgcccggcagcgagcggcgccttccaactccggagcaaatttttcagaacataaaacaagaatatagtcgttatcagaggtggagacatttagaagttgttcttaatcagagtgaagcttgtgcttcggaaagtcaacctcactcctcagcactcacagcacctagctctccaggttcctcatggatgaagaaggaccagcccacatttaccctccgacaagttggcataatatgtgagcgcctcttaaaagactatgaagataaaattcgggaggagtatgagcaaatcctcaataccaaactagcagatgtgtcatgaagctttgtcacatatctgggtaccaggtttgacctcaagagatggctgctgtacactttttgcaactggtttgatgtcacatttcagctccaactttgcatcctgagaacacttaaacgtttctgcaggtccattttatacaacttgaaagaccgtaaaactttctggttgccacaagcatatctttcttttctgctcatccaataaacagctgtgccctactgtgatagattttccaaacaaaaatacctggagcagcagtttagcaaaatatgccttcagtggcattcaacaaatggagtttccccaagcacagttctgtaaga

SEQ ID NO: 106132 - DNA, 1662 bp, Homo sapiens
  Payload ID: 808
  Gene Symbol: AKIRIN2
  Gene Name: akirin 2
  Uniprot ID: Q53H80
  ENST ID: ENST00000257787
  CDS Start-End: 526-1137
ggttggacgtgttcgcttgggttcctgctgcggcagctacctcgcaatctctctgcatcgatcgccgctcgcaagctactgaccgtactcgggcgtattaggagccgcgttccagcctcacaccccacggtgctgttttcgacttcagaaaggatctagtctcagcacagaagcgcctcaggcgcggcgcaaagctcgagcggacggcgggggcggccggagcctctctcgggggagccgcgcctgaggaggcggaagaacccccctgacgcgactggcgtgtgcttctgcccgccaccgcccctcccgctctcacccgggccgtccctggccactgcccctgccgcggaggcagcggcggcagcggctctcctttccacagccggcgctccgcgacccgcttggctcctgagcccgtcgggtaggctctcctcgagttcccgctcttcaccccttccctcaccctcttctttcgtcacccgtccccgaccccacccgagcccggcgcctcagctgcccccggccatggcgtgcggagccactctgaaaaggactctggatttcgacccgctgttgagcccggcgtccccgaagcgcaggcgatgtgcgccattgtcggcgcccacctcggccgctgcctccccgttgtcggcggccgcggccaccgccgcctccttctccgctgcggccgcctcgccgcagaagtatctccgaatggagccatcccccttcggcgacgtctcctcccgcctcaccacagaacaaattctgtacaacataaaacaagagtataaacgaatgcagaagagaagacatttagaaacgagtttccaacagacagatccgtgttgtacttctgatgcacagccacatgcatttctcctcagtggaccagcttcaccagggacttcatctgcagcatcctcaccattaaaaaaagaacagcccttatttactctacggcaggttgggatgatctgtgaacgtttgttgaaagaacgtgaagagaaagttcgagaagaatatgaagaaatattgaacacaaaacttgcagaacaatatgatgcgtttgtgaagtttacgcatgatcaaataatgcgacgatatggagaacagcctgctagctatgtttcatgaatcacgtatcctgcatttgtgggctgccttgttccttgttgagttgttgcaagaggtcccaattatgacatgcagcaatgccaataccccttctgtgaatacaggttatttcaagctttcgtcagtggcaaccactcttaggcagcagcaactggttttggaaatttccctgatgtcagtaccacctggatgtggacctttgctacctgtattaataccagtggcctcattttgctgtatcattacaatttggcttcttatattaatgtttgaaaaggattaaagctggtattctagaacatgcccttcactggttgtgtaaataaaactgtagaatgacacttcagatgaagttagtgtgattttaattgtgcactacaaccgagctgtaaccagttactaattttagaatgtaatcccaggacaatattaagcaaatagcctgcagtgcttcctgtgaaatagtgaaggaggagggcatttctgtattccaggacttcttggggtttcagaatgggtttgtat

SEQ ID NO: 106133 - DNA, 2318 bp, Homo sapiens
  Payload ID: 809
  Gene Symbol: AKNAD1
  Gene Name: AKNA domain containing 1
  ENST ID: ENST00000369994
  CDS Start-End: 54-2222
tgacagcagccagctcaggaggcagaggacgagagcgatcgggctgcacacacatggatgaggctgatttttcagaacacacgacttataagcaggaggatttgccttatgatggggacctctctcagattaagataggcaatgattacagttttacctcaaaaaaggatggccttgaagtcttaaatcaaattattttcatagcagatgaccctcaagagaaggctatgcatagtgagacttgtggaaatacagctgtgaccatacccctgggtaaaattactgaaaatgctgccaacaaaaaagacgagaaagagaaacaatgcactgcagctcttcatattccagcaaatgaaggagacgcttctaagtcaagcatttctgatattttacttcatcatctttccaaagagccattcttaagaggtcaaggcattgattgtgaaaccctcccagagatctcaaatgccgacagttttgaagaggaagctattattaaaagtattatttcatgttataataagaattcttggccaaaagaacaaaccccagaactcactgaccaactcaacccgaaaagggatggtgaaaacagcaataagcctggttctgccaccacgacagaggaaaatacctctgatttagaagggccagtggctgctggagatagcagccatcaagaaaatgtgaatgttctaactaaaaccaagggtccaggtgataaacaaaaaagttatcaagggcagtcaccccagaaacagcagactgaaaaagcaaattcaggcaacacgttcaaatacggccaaggtcaagttcattaccagctccctgatttctctaagattgctcccaaagtgaaaattcctaaaaataagataattaataaaccacttgcaatagctaaacaagccagcttttcttccaagtcgagagataaacccactcttgtgcaagatagtctagaaaccacgcctgagtcaaactgtgttgaaaaacaacatcaagagcagaaagggaaaatcactgaaccttcacaacaaatccagatggagcccatagtacatatccaccaagaacttctcacaggaatagaatctgaggcaagtctctctaagttgtcaccaacctctcagaaaggcacttcctcaagttcttcttacatatttcaaaagatatcccaagggaaacagatgtgtcagaagttgaaagaacagactgatcaactgaagactaaagtacaagaattttccaaaagaataaaacaggactctccttaccatttgcaagacaagaagctggtcctggagaaactgcagggacaccttgaactgctggagcagaactttctggccaccaaggacaagcatctgactttgcagcagcaagtccacaagcacgaatcaacaatcgttggtgactttgatccagaaagaaaagtggaaggtgaaatcttcaaattggagatgctgcttgaagatgttaaagagaaaatggatgaaagcaaatatacttcagctccttcccttcctgtgagttctccagttaccctggatgacttggcctccaccttctcttcactctcaaatgaggcccccaacgaggagctctgtgagctggccccgcagacttacctaaacggtcattatggagatgcagctgcccagaacaagccagaccaagtggccatgaggctgtcttctaactctggggaggatcccaacggcactccaagaaggcaggattgtgcagagatgacggcacccagtccgagctgtgccttctgtcgcaggctccttgaatggaagcaaaacgtggagaaaaagggccacggaaggatcaactgtggaagattttcaattgtccttcatgaaaaggcaccacactcagattcaactcccaattctgatacaggacacagcttctgttctgattctggcactgaaatgcagagtaacaaatgtcaggactgtggcactaagattcctacctcccgaagagcctgcaggaaagaaccaactaaagaatttcattatagatacaacactccaggacagaattactcaaatcatagcaaaagaggtgcctttgtccagccccattctttagatgaaagtaaaaactcttcaccctgtcttgtgcactcacctgacacttccaaatccagccctacatctggatggcaagaggctgagctggggctggaaaatatgaaatcgcagtgaccaaggactttgaaagttattaagggctacaccagtgcaagttggtagcaacccataaatgtttgctgaacaaataaatgacttactggataatca

SEQ ID NO: 106134 - DNA, 2641 bp, Homo sapiens
  Payload ID: 809
  Gene Symbol: AKNAD1
  Gene Name: AKNA domain containing 1
  Uniprot ID: Q5T1N1
  ENST ID: ENST00000369995
  CDS Start-End: 260-2545
agaaaatcaatttggattctacagaaaggttctgttggattctgagtggaacctctttggatatgcctttggatttcaagattgagccaagtgttgacatgggaagatgctccagttcctccagttatctcaaagaagctcattaccttgctaaggaatagcacacagtgaagacagtcagtgagaaccagagctattgttacaactgacagcagccagctcaggaggcagaggacgagagcgatcgggctgcacacacatggatgaggctgatttttcagaacacacgacttataagcaggaggatttgccttatgatggggacctctctcagattaagataggcaatgattacagttttacctcaaaaaaggatggccttgaagtcttaaatcaaattattttcatagcagatgaccctcaagagaaggctatgcatagtgagacttgtggaaatacagctgtgaccatacccctgggtaaaattactgaaaatgctgccaacaaaaaagacgagaaagagaaacaatgcactgcagctcttcatattccagcaaatgaaggagacgcttctaagtcaagcatttctgatattttacttcatcatctttccaaagagccattcttaagaggtcaaggcattgattgtgaaaccctcccagagatctcaaatgccgacagttttgaagaggaagctattattaaaagtattatttcatgttataataagaattcttggccaaaagaacaaaccccagaactcactgaccaactcaacccgaaaagggatggtgaaaacagcaataagcctggttctgccaccacgacagaggaaaatacctctgatttagaagggccagtggctgctggagatagcagccatcaagaaaatgtgaatgttctaactaaaaccaagggtccaggtgataaacaaaaaagttatcaagggcagtcaccccagaaacagcagactgaaaaagcaaattcaggcaacacgttcaaatacggccaaggtcaagttcattaccagctccctgatttctctaagattgctcccaaagtgaaaattcctaaaaataagataattaataaaccacttgcaatagctaaacaagccagcttttcttccaagtcgagagataaacccactcttgtgcaagatagtctagaaaccacgcctgagtcaaactgtgttgaaaaacaacatcaagagcagaaagggaaaatcactgaaccttcacaacaaatccagatggagcccatagtacatatccaccaagaacttctcacaggaatagaatctgaggcaagtctctctaagttgtcaccaacctctcagaaaggcacttcctcaagttcttcttacatatttcaaaagatatcccaagggaaacagatgtgtcagaagttgaaagaacagactgatcaactgaagactaaagtacaagaattttccaaaagaataaaacaggactctccttaccatttgcaagacaagaagctggtcctggagaaactgcagggacaccttgaactgctggagcagaactttctggccaccaaggacaagcatctgactttgcagcagcaagtccacaagcacgaatcaacaatcgttggtgactttgatccagaaagaaaagtggaaggtgaaatcttcaaattggagatgctgcttgaagatgttaaagagaaaatggatgaaagcaaatatacttcagctccttcccttcctgtgagttctccagttaccctggatgacttggcctccaccttctcttcactctcaaatgagattcccaaggagcaccccggccacccttctgggcctcgaggctcaggtgggagtgaggtaacagggacaccccaaggagggccgcaggaggcccccaacgaggagctctgtgagctggccccgcagacttacctaaacggtcattatggagatgcagctgcccagaacaagccagaccaagtggccatgaggctgtcttctaactctggggaggatcccaacggcactccaagaaggcaggattgtgcagagatgacggcacccagtccgagctgtgccttctgtcgcaggctccttgaatggaagcaaaacgtggagaaaaagggccacggaaggatcaactgtggaagattttcaattgtccttcatgaaaaggcaccacactcagattcaactcccaattctgatacaggacacagcttctgttctgattctggcactgaaatgcagagtaacaaatgtcaggactgtggcactaagattcctacctcccgaagagcctgcaggaaagaaccaactaaagaatttcattatagatacaacactccaggacagaattactcaaatcatagcaaaagaggtgcctttgtccagccccattctttagatgaaagtaaaaactcttcaccctccctggcctctccattttgctgcccaggtcttgtgcactcacctgacacttccaaatccagccctacatctggatggcaagaggctgagctggggctggaaaatatgaaatcgcagtgaccaaggactttgaaagttattaagggctacaccagtgcaagttggtagcaacccataaatgtttgctgaacaaataaatgacttactggataatca

SEQ ID NO: 106135 - DNA, 3053 bp, Homo sapiens
  Payload ID: 809
  Gene Symbol: AKNAD1
  Gene Name: AKNA domain containing 1
  Uniprot ID: Q5T1N1
  ENST ID: ENST00000370001
  CDS Start-End: 270-2780
acctgacttcagaaaatcaatttggattctacagaaaggttctgttggattctgagtggaacctctttggatatgcctttggatttcaagattgagccaagtgttgacatgggaagatgctccagttcctccagttatctcaaagaagctcattaccttgctaaggaatagcacacagtgaagacagtcagtgagaaccagagctattgttacaactgacagcagccagctcaggaggcagaggacgagagcgatcgggctgcacacacatggatgaggctgatttttcagaacacacgacttataagcaggaggatttgccttatgatggggacctctctcagattaagataggcaatgattacagttttacctcaaaaaaggatggccttgaagtcttaaatcaaattattttcatagcagatgaccctcaagagaaggctatgcatagtgagacttgtggaaatacagctgtgaccatacccctgggtaaaattactgaaaatgctgccaacaaaaaagacgagaaagagaaacaatgcactgcagctcttcatattccagcaaatgaaggagacgcttctaagtcaagcatttctgatattttacttcatcatctttccaaagagccattcttaagaggtcaaggcattgattgtgaaaccctcccagagatctcaaatgccgacagttttgaagaggaagctattattaaaagtattatttcatgttataataagaattcttggccaaaagaacaaaccccagaactcactgaccaactcaacccgaaaagggatggtgaaaacagcaataagcctggttctgccaccacgacagaggaaaatacctctgatttagaagggccagtggctgctggagatagcagccatcaagaaaatgtgaatgttctaactaaaaccaagggtccaggtgataaacaaaaaagttatcaagggcagtcaccccagaaacagcagactgaaaaagcaaattcaggcaacacgttcaaatacggccaaggtcaagttcattaccagctccctgatttctctaagattgctcccaaagtgaaaattcctaaaaataagataattaataaaccacttgcaatagctaaacaagccagcttttcttccaagtcgagagataaacccactcttgtgcaagatagtctagaaaccacgcctgagtcaaactgtgttgaaaaacaacatcaagagcagaaagggaaaatcactgaaccttcacaacaaatccagatggagcccatagtacatatccaccaagaacttctcacaggaatagaatctgaggcaagtctctctaagttgtcaccaacctctcagaaaggcacttcctcaagttcttcttacatatttcaaaagatatcccaagggaaacagatgtgtcagaagttgaaagaacagactgatcaactgaagactaaagtacaagaattttccaaaagaataaaacaggactctccttaccatttgcaagacaagaagctggtcctggagaaactgcagggacaccttgaactgctggagcagaactttctggccaccaaggacaagcatctgactttgcagcagcaagtccacaagcacgaatcaacaatcgttggtgactttgatccagaaagaaaagtggaaggtgaaatcttcaaattggagatgctgcttgaagatgttaaagagaaaatggatgaaagcaaatatacttcagctccttcccttcctgtgagttctccagttaccctggatgacttggcctccaccttctcttcactctcaaatgagattcccaaggagcaccccggccacccttctgggcctcgaggctcaggtgggagtgaggtaacagggacaccccaaggagggccgcaggaggcccccaacgaggagctctgtgagctggccccgcagacttacctaaacggtcattatggagatgcagctgcccagaacaagccagaccaagtggccatgaggctgtcttctaactctggggaggatcccaacggcactccaagaaggcaggattgtgcagagatgacggcacccagtccgagctgtgccttctgtcgcaggctccttgaatggaagcaaaacgtggagaaaaagggccacggaaggatcaactgtggaagattttcaattgtccttcatgaaaaggcaccacactcagattcaactcccaattctgatacaggacacagcttctgttctgattctggcactgaaatgcagagtaacaaatgtcaggactgtggcactaagattcctacctcccgaagagcctgcaggaaagaaccaactaaagaatttcattatagatacaacactccaggacagaattactcaaatcatagcaaaagaggtgcctttgtccagccccattctttagatgaaagtaaaaactcttcaccctcttttttaaaacccaaacggatctgttctcagagagtgaattcaaaatcctttaaaggtgaacatgagcccacaccaggaaaaaaaaaacttcaggctttcatgacctacagctcagaccctgcaacaccctcaccccatttctactcctgcaggatttctggaagcaaatccttatgtgactttgatagcactgaagaaataaaatctgagattttaaactcggctttggatcatgccctaaggacagcaaccattttgaaagaaactacagatcaaatgattaaaacgattgcagaagaccttgctaaagcacagaggtggaggaatcgactgaaatactagttcaacgctaggctaccaaggattcaaaagaaaaaaatgcaaagaaaacttgatcttcccccaaaatgtattttacttactacacaatttaggaagatgactttctagagaaaacacagaaaccataagaaatgggtaacacaaagtacttaaaggaaaaagaaaaaagaaaggacttctgattcttaaaatcaaaagcaaccaacaagtatttattttaaaataaatctatgttcttcttaactcataataaaagaaatcaaaacaaaacaa

SEQ ID NO: 106136 - DNA, 2638 bp, Homo sapiens
  Payload ID: 809
  Gene Symbol: AKNAD1
  Gene Name: AKNA domain containing 1
  Uniprot ID: Q5T1N1
  ENST ID: ENST00000472781
  CDS Start-End: 260-1507
agaaaatcaatttggattctacagaaaggttctgttggattctgagtggaacctctttggatatgcctttggatttcaagattgagccaagtgttgacatgggaagatgctccagttcctccagttatctcaaagaagctcattaccttgctaaggaatagcacacagtgaagacagtcagtgagaaccagagctattgttacaactgacagcagccagctcaggaggcagaggacgagagcgatcgggctgcacacacatggatgaggctgatttttcagaacacacgacttataagcaggaggatttgccttatgatggggacctctctcagattaagataggcaatgattacagttttacctcaaaaaaggatggccttgaagtcttaaatcaaattattttcatagcagatgaccctcaagagaaggctatgcatagtgagacttgtggaaatacagctgtgaccatacccctgggtaaaattactgaaaatgctgccaacaaaaaagacgagaaagagaaacaatgcactgcagctcttcatattccagcaaatgaaggagacgcttctaagtcaagcatttctgatattttacttcatcatctttccaaagagccattcttaagaggtcaaggcattgattgtgaaaccctcccagagatctcaaatgccgacagttttgaagaggaagctattattaaaagtattatttcatgttataataagaattcttggccaaaagaacaaaccccagaactcactgaccaactcaacccgaaaagggatggtgaaaacagcaataagcctggttctgccaccacgacagaggaaaatacctctgatttagaagggccagtggctgctggagatagcagccatcaagaaaatgtgaatgttctaactaaaaccaagggtccaggtgataaacaaaaaagttatcaagggcagtcaccccagaaacagcagactgaaaaagcaaattcaggcaacacgttcaaatacggccaaggtcaagttcattaccagctccctgatttctctaagattgctcccaaagtgaaaattcctaaaaataagataattaataaaccacttgcaatagctaaacaagccagcttttcttccaagtcgagagataaacccactcttgtgcaagatagtctagaaaccacgcctgagtcaaactgtgttgaaaaacaacatcaagagcagaaagggaaaatcactgaaccttcacaacaaatccagatggagcccatagtacatatccaccaagaacttctcacaggaatagaatctgaggcaagtctctctaagttgtcaccaacctctcagaaaggcacttcctcaagttcttcttacatatttcaaaagatatcccaagggaaacagatgtgtcagaagttgaaagaacagactgatcaactgaagactaaagtacaagaattttccaaaagaataaaacaggactctccttaccatttgcaagacaagaagctgtgacttcaccgctgcaggtcctggagaaactgcagggacaccttgaactgctggagcagaactttctggccaccaaggacaagcatctgactttgcagcagcaagtccacaagcacgaatcaacaatcgttggtgactttgatccagaaagaaaagtggaaggtgaaatcttcaaattggagatgctgcttgaagatgttaaagagaaaatggatgaaagcaaatatacttcagctccttcccttcctgtgagttctccagttaccctggatgacttggcctccaccttctcttcactctcaaatgaggtaatacagcaatgtacagtctaattttgtgccaggaaaaatggtgtttttgcatttatagactcctaattcatggattcactgaattccatttttaatatctcatgaaaatttaactttccaaagtcccatgaattatattattttaaatggaaccagcttttaaagattagaagctatttcaagtgttaatttttgaaacatctttatagtttaggatgtaacaatgctgtttaaatccattaaaccaccgaagagctatttcttccaaattaataagaaaatttttgtagatcatgcctggaagaaataattttttttcttcatagttttgtactcaccaggctggagtgtggtagcacgatctcagctcactgcaacctttgtctcccgggctcaagtgattctcctccctcagcctcccaagcagctgagattacaggtgcatgccaccactgcctggctaattttttatatttttggtagagatggggtttcaccatgttggccaggctggtctcaaactcctgacctcaagtgatccgcccgcttggccttccaaagtgttgggattacaggcatgagccacctgaaaataaagaatagcacactcagtgaaataattatttcccatgaatccacttctgcattttccttctctcaagttaaattcttttggatttctacttatgcaagattgggaattcaaattaaccaccactgtctttctatactttttgcctttgtagcctcaactatcagaacattcagactaaaatcaaaattctgagaaacagaatcatttaaataaataccttaaattgac

SEQ ID NO: 106137 - DNA, 2646 bp, Homo sapiens
  Payload ID: 809
  Gene Symbol: AKNAD1
  Gene Name: AKNA domain containing 1
  ENST ID: ENST00000461774
  CDS Start-End: 252-1961
aatttggattctacagaaaggttctgttggattctgagtggaacctctttggatatgcctttggatttcaagattgagccaagtgttgacatgggaagatgctccagttcctccagttatctcaaagaagctcattaccttgctaaggaatagcacacagtgaagacagtcagtgagaaccagagctattgttacaactgacagcagccagctcaggaggcagaggacgagagcgatcgggctgcacacacatggatgaggctgatttttcagaacacacgacttataagcaggaggatttgccttatgatggggacctctctcagattaagataggcaatgattacagttttacctcaaaaaaggatggccttgaagtcttaaatcaaattattttcatagcagatgaccctcaagagaaggctatgcatagtgagacttgtggaaatacagctgtgaccatacccctgggtaaaattactgaaaatgctgccaacaaaaaagacgagaaagagaaacaatgcactgcagctcttcatattccagcaaatgaaggagacgcttctaagtcaagcatttctgatattttacttcatcatctttccaaagagccattcttaagaggtcaaggcattgattgtgaaaccctcccagagatctcaaatgccgacagttttgaagaggaagctattattaaaagtattatttcatgttataataagaattcttggccaaaagaacaaaccccagaactcactgaccaactcaacccgaaaagggatggtgaaaacagcaataagcctggttctgccaccacgacagaggaaaatacctctgatttagaagggccagtggctgctggagatagcagccatcaagaaaatgtgaatgttctaactaaaaccaagggtccaggtgataaacaaaaaagttatcaagggcagtcaccccagaaacagcagactgaaaaagcaaattcaggcaacacgttcaaatacggccaaggtcaagttcattaccagctccctgatttctctaagattgctcccaaagtgaaaattcctaaaaataagataattaataaaccacttgcaatagctaaacaagccagcttttcttccaagtcgagagataaacccactcttgtgcaagatagtctagaaaccacgcctgagtcaaactgtgttgaaaaacaacatcaagagcagaaagggaaaatcactgaaccttcacaacaaatccagatggagcccatagtacatatccaccaagaacttctcacaggaatagaatctgaggcaagtctctctaagttgtcaccaacctctcagaaaggcacttcctcaagttcttcttacatatttcaaaagatatcccaagggaaacagatgtgtcagaagttgaaagaacagactgatcaactgaagactaaagtacaagaattttccaaaagaataaaacaggactctccttaccatttgcaagacaagaagctggtcctggagaaactgcagggacaccttgaactgctggagcagaactttctggccaccaaggacaagcatctgactttgcagcagcaagtccacaagcacgaatcaacaatcgttggtgactttgatccagaaagaaaagtggaaggtgaaatcttcaaattggagatgctgcttgaagatgttaaagagaaaatggatgaaagcaaatatacttcagctccttcccttcctgtgagttctccagttaccctggatgacttggcctccaccttctcttcactctcaaatgagattcccaaggagcaccccggccacccttctgggcctcgaggctcaggtgggagtgaggtaacagggacaccccaaggagggccgcaggaggcccccaacgaggagctctgtgagctggccccgcagacgaggatcccaacggcactccaagaaggcaggattgtgcagagatgacggcacccagtccgagctgtgccttctgtcgcaggctccttgaatggaagcaaaacgtggagaaaaagggccacggaaggatcaactgtggaagattttcaattgtccttcatgaaaaggcaccacactcagattcaactcccaattctgatacaggacacagcttctgttctgattctggcactgaaatgcagagtaacaaatgtcaggactgtggcactaagattcctacctcccgaagagcctgcaggaaagaaccaactaaagaatttcattatagatacaacactccaggacagaattactcaaatcatagcaaaagaggtgcctttgtccagccccattctttagatgaaagtaaaaactcttcaccctgtaagtacatctcctgcatgaccccatccatatcaacaacctaatgtcccaggtatgggacattcacatgacactggccactgcttccatctgggaagccctggcctctccattttgctgcccaggtcttgtgcactcacctgacacttccaaatccagccctacatctggatggcaagaggctgagctggggctggaaaatatgaaatcgcagtgaccaaggactttgaaagttattaagggctacaccagtgcaagttggtagcaacccataaatgtttgctgaacaaataaatgacttactggataa

SEQ ID NO: 106138 - DNA, 2895 bp, Homo sapiens
  Payload ID: 809
  Gene Symbol: AKNAD1
  Gene Name: AKNA domain containing 1
  Uniprot ID: Q5T1N1
  ENST ID: ENST00000474186
  CDS Start-End: 407-2365
agaagaagcaggcacgccatgattttgaagctccgtttttgttctgttattcaactgcagtcaacttccaactgttgaaaaaaagatgatttagaattaaagggttgcttgtctgtgtcgcaaggcccttcaacttgttcacctgtgatatccagagactccaagatgttgaaaggttctgttggattctgagtggaacctctttggatatgcctttggatttcaagattgagccaagtgttgacatgggaagatgctccagttcctccagttatctcaaagaagctcattaccttgctaaggaatagcacacagtgaagacagtcagtgagaaccagagctattgttacaactgacagcagccagctcaggaggcagaggacgagagcgatcgggctgcacacacatggatgaggctgatttttcagaacacacgacttataagcaggaggatttgccttatgatggggacctctctcagattaagataggcaatgattacagttttacctcaaaaaaggatggccttgaagtcttaaatcaaattattttcatagcagatgaccctcaagagaaggctatgcatagtgagacttgtggaaatacagctgtgaccatacccctgggtaaaattactgaaaatgctgccaacaaaaaagacgagaaagagaaacaatgcactgcagctcttcatattccagcaaatgaaggagacgcttctaagtcaagcatttctgatattttacttcatcatctttccaaagagccattcttaagaggtcaaggcattgattgtgaaaccctcccagagatctcaaatgccgacagttttgaagaggaagctattattaaaagtattatttcatgttataataagaattcttggccaaaagaacaaaccccagaactcactgaccaactcaacccgaaaagggatggtgaaaacagcaataagcctggttctgccaccacgacagaggaaaatacctctgatttagaagggccagtggctgctggagatagcagccatcaagaaaatgtgaatgttctaactaaaaccaagggtccaggtgataaacaaaaaagttatcaagggcagtcaccccagaaacagcagactgaaaaagcaaattcaggcaacacgttcaaatacggccaaggtcaagttcattaccagctccctgatttctctaagattgctcccaaagtgaaaattcctaaaaataagataattaataaaccacttgcaatagctaaacaagccagcttttcttccaagtcgagagataaacccactcttgtgcaagatagtctagaaaccacgcctgagtcaaactgtgttgaaaaacaacatcaagagcagaaagggaaaatcactgaaccttcacaacaaatccagatggagcccatagtacatatccaccaagaacttctcacaggaatagaatctgaggcaagtctctctaagttgtcaccaacctctcagaaaggcacttcctcaagttcttcttacatatttcaaaagatatcccaagggaaacagatgtgtcagaagttgaaagaacagactgatcaactgaagactaaagtacaagaattttccaaaagaataaaacaggactctccttaccatttgcaagacaagaagctggtcctggagaaactgcagggacaccttgaactgctggagcagaactttctggccaccaaggacaagcatctgactttgcagcagcaagtccacaagcacgaatcaacaatcgttggtgactttgatccagaaagaaaagtggaaggtgaaatcttcaaattggagatgctgcttgaagatgttaaagagaaaatggatgaaagcaaatatacttcagctccttcccttcctgtgagttctccagttaccctggatgacttggcctccaccttctcttcactctcaaatgaggaggatcccaacggcactccaagaaggcaggattgtgcagagatgacggcacccagtccgagctgtgccttctgtcgcaggctccttgaatggaagcaaaacgtggagaaaaagggccacggaaggatcaactgtggaagattttcaattgtccttcatgaaaaggcaccacactcagattcaactcccaattctgatacaggacacagcttctgttctgattctggcactgaaatgcagagtaacaaatgtcaggactgtggcactaagattcctacctcccgaagagcctgcaggaaagaaccaactaaagaatttcattatagatacaacactccaggacagaattactcaaatcatagcaaaagaggtgcctttgtccagccccattctttagatgaaagtaaaaactcttcaccctaaaaaaacttcaggctttcatgacctacagctcagaccctgcaacaccctcaccccatttctactcctgcaggatttctggaagcaaatccttatgtgactttgatagcactgaagaaataaaatctgagattttaaactcggctttggatcatgccctaaggacagcaaccattttgaaagaaactacagatcaaatgattaaaacgattgcagaagaccttgctaaagcacagaggtggaggaatcgactgaaatactagttcaacgctaggctaccaaggattcaaaagaaaaaaatgcaaagaaaacttgatcttcccccaaaatgtattttacttactacacaatttaggaagatgactttctagagaaaacacagaaaccataagaaatgggtaacacaaagtacttaaaggaaaaagaaaaaagaaaggacttctgattcttaaaatcaaaagcaaccaacaagtatttattttaaaataaatctatgttcttcttaactcataataaaagaaatcaaaacaaaa

SEQ ID NO: 106139 - DNA, 2133 bp, Homo sapiens
  Payload ID: 810
  Gene Symbol: AKTIP
  Gene Name: AKT interacting protein
  Uniprot ID: Q9H8T0
  ENST ID: ENST00000300245
  CDS Start-End: 219-1100
cggggatcaagcaggggcagggctggcgctgcggcgggagatgctgtcgggccgcggcggcgcttggcagccaggagctctgcattgaaggcactgggccgtttgattggtgcaagtaggaattcagagaaggagctctgctttaaaggtaaagtgaatgccgaagacagaagatttggatgatacaccactgactttctttgtttggaatacacgttatgaaccctttctggagcatgtctacaagctctgtacgcaaacgatctgaaggtgaagagaagacattaacaggggacgtgaaaaccagtcctccacgaactgcaccaaagaaacagctgccttctattcccaaaaatgctttgcccataactaagcctacatctcctgccccagcagcacagtcaacaaatggcacgcatgcgtcctatggacccttctacctggaatactctcttcttgcagaatttaccttggttgtgaagcagaagctaccaggcgtctatgtgcagccatcttatcgctctgcattaatgtggtttggagtaatattcatacggcatggactttaccaagatggcgtatttaagtttacagtttacatccctgataactatccagatggtgactgtccacgcttggtgttcgatattcctgtctttcacccgctagttgatcccacctcaggtgagctggatgtgaagagagcatttgcaaaatggaggcggaaccataatcatatttggcaggtattaatgtatgcaaggagagttttctacaagattgatacagcaagccccctgaacccagaggctgcagtactgtatgaaaaagatattcagctttttaaaagtaaagttgttgacagtgttaaggtgtgcactgctcgtttgtttgaccaacctaaaatagaagacccctatgcaattagcttttctccatggaatccttctgtacatgatgaagccagagaaaagatgctgactcagaaaaagaagcctgaagaacagcacaataaaagtgttcatgttgctggcctgtcatgggtaaagcctggctcagtacagcctttcagtaaagaagagaaaacagtggcgacttaagagatggtgaatctggtgcaccatgcactttcctgctagactctggcctagttcaagctgaccaatggcagaggactgcctgaagagtaaaactgtgtgaacaatgactgactgccagtgttttccatgtatgcataggttctaacagcagggtttggaaacctgtctctaagtaatgcattacttctgtcagaagtgtcttagggtggttatctagttcagtactccaaattattggggaccttgaggcttaagtaagtatttttctgaatataatgctaaaggtaagttgcattcatttaaactaatagagcagacagaattcagcactacttaatagtttataaatcagtggtttcagttgtatatatgttaggaaatggagaggtatagagagagcaggttccatagctcagcacttttaagtggaagatcatttgaatctcagtcttcagcctgcactgatttgtagcctgcactgtcttactgatttacaaactgaaatcactgagaaatgtctttagttcagtgagaagaaaccagaacacttgttcctagtgttgtgttgttttttttaagcaaattacttactgtatttttatggcaggagggagaaaaagtgttacaacggtttctaatgaagtccggtatttaaatgataaatgactaatgtgtttagtagagacaaaataaaccaataaatgattgttctttgccatttatgcaggaaactacccttttctcaatataaccaaacaaaggctaatttataaatgctttattgaaaaatacacttatcttcatataaaattacagtagcagtatcttgagaagttttataaatatttttgcagaacactattctaattgaacaatgtaagttccatatttctctcagcaatatgaagttacctagtaactttgtttatactgattcaatttacaattgaattttctccctaataagattattaatttgacttgaaaactgctggaacaatagtgattaataaagatatgtatagataattca

SEQ ID NO: 106140 - DNA, 2426 bp, Homo sapiens
  Payload ID: 810
  Gene Symbol: AKTIP
  Gene Name: AKT interacting protein
  Uniprot ID: Q9H8T0
  ENST ID: ENST00000394657
  CDS Start-End: 176-1054
ggcggggcggggatcaagcaggggcagggctggcgctgcggcgggagatgctgtcgggccgcggcggcgcttggcagccaggagctctgcattgaaggcactggggtaaagtgaatgccgaagacagaagatttggatgatacaccactgactttctttgtttggaatacacgttatgaaccctttctggagcatgtctacaagctctgtacgcaaacgatctgaaggtgaagagaagacattaacaggggacgtgaaaaccagtcctccacgaactgcaccaaagaaacagctgccttctattcccaaaaatgctttgcccataactaagcctacatctcctgccccagcagcacagtcaacaaatggcacgcatgcgtcctatggacccttctacctggaatactctcttcttgcagaatttaccttggttgtgaagcagaagctaccaggcgtctatgtgcagccatcttatcgctctgcattaatgtggtttggagtaatattcatacggcatggactttaccaagatggcgtatttaagtttacagtttacatccctgataactatccagatggtgactgtccacgcttggtgttcgatattcctgtctttcacccgctagttgatcccacctcaggtgagctggatgtgaagagagcatttgcaaaatggaggcggaaccataatcatatttggcaggtattaatgtatgcaaggagagttttctacaagattgatacagcaagccccctgaacccagaggctgcagtactgtatgaaaaagatattcagctttttaaaagtaaagttgttgacagtgttaaggtgtgcactgctcgtttgtttgaccaacctaaaatagaagacccctatgcaattagcttttctccatggaatccttctgtacatgatgaagccagagaaaagatgctgactcagaaaaagcctgaagaacagcacaataaaagtgttcatgttgctggcctgtcatgggtaaagcctggctcagtacagcctttcagtaaagaagagaaaacagtggcgacttaagagatggtgaatctggtgcaccatgcactttcctgctagactctggcctagttcaagctgaccaatggcagaggactgcctgaagagtaaaactgtgtgaacaatgactgactgccagtgttttccatgtatgcataggttctaacagcagggtttggaaacctgtctctaagtaatgcattacttctgtcagaagtgtcttagggtggttatctagttcagtactccaaattattggggaccttgaggcttaagtaagtatttttctgaatataatgctaaaggtaagttgcattcatttaaactaatagagcagacagaattcagcactacttaatagtttataaatcagtggtttcagttgtatatatgttaggaaatggagaggtatagagagagcaggttccatagctcagcacttttaagtggaagatcatttgaatctcagtcttcagcctgcactgatttgtagcctgcactgtcttactgatttacaaactgaaatcactgagaaatgtctttagttcagtgagaagaaaccagaacacttgttcctagtgttgtgttgttttttttaagcaaattacttactgtatttttatggcaggagggagaaaaagtgttacaacggtttctaatgaagtccggtatttaaatgataaatgactaatgtgtttagtagagacaaaataaaccaataaatgattgttctttgccatttatgcaggaaactacccttttctcaatataaccaaacaaaggctaatttataaatgctttattgaaaaatacacttatcttcatataaaattacagtagcagtatcttgagaagttttataaatatttttgcagaacactattctaattgaacaatgtaagttccatatttctctcagcaatatgaagttacctagtaactttgtttatactgattcaatttacaattgaattttctccctaataagattattaatttgacttgaaaactgctggaacaatagtgattaataaagatatgtatagataattcagctgttaaataacattttctaatttgtataaatggtactatggtactaataaaaacctaaattctccaaccaatttttttaaactgccaggaacacccaaaaatatttttaaatatatcaccttaatagacatttcttttagataactccctcctaaaggaagaggtcataagttttcatattaatcccctcaattcaacttgattaaaatcttttcttagctggttgatccctatataacaaaaaactggagaatttaaaacattcccaaaaggtggctataggggttttaacattttaaaaaaatataaaagcattaaagaaaatattggatgttta

SEQ ID NO: 106141 - DNA, 819 bp, Homo sapiens
  Payload ID: 810
  Gene Symbol: AKTIP
  Gene Name: AKT interacting protein
  ENST ID: ENST00000568022
  CDS Start-End: 71-819
gtaaagtgaatgccgaagacagaagatttggatgatacaccactgactttctttgtttggaatacacgttatgaaccctttctggagcatgtctacaagctctgtacgcaaacgatctgaaggtgaagagaagacattaacaggggacgtgaaaaccagtcctccacgaactgcaccaaagaaacagctgccttctattcccaaaaatgctttgcccataactaagcctacatctcctgccccagcagcacagtcaacaaatggcacgcatgcgtcctatggacccttctacctggaatactctcttcttgcagaatttaccttggttgtgaagcagaagctaccaggcgtctatgtgcagccatcttatcgctctgcattaatgtggtttggagtaatattcatacggcatggactttaccaagatggcgtatttaagtttacagtttacatccctgataactatccagatggtgactgtccattgtccagggggacttctgtgctttgcagcagcttccggcatgccatcagagctttgtttctctgctcagggtctgcaagggaggctggctgcctgccatcctgcagcactcaccagcgcttggtgttcgatattcctgtctttcacccgctagttgatcccacctcaggtgagctggatgtgaagagagcatttgcaaaatggaggcggaaccataatcatatttggcaggtattaatgtatgcaaggagagttttctacaagattgatacagcaagccccctgaacccagaggctgcagtactgtatgaaaaagatattcagctttttaaaag

SEQ ID NO: 106142 - DNA, 959 bp, Homo sapiens
  Payload ID: 810
  Gene Symbol: AKTIP
  Gene Name: AKT interacting protein
  ENST ID: ENST00000568596
  CDS Start-End: 578-959
agatgctgtcgggccgcggcggcgcttggcagccaggagctctgcattgaaggcactggggtgaggcttactgcccggcaggctggtgggtacgcgagggctgaggtgtctgtaaatctggccgccagcctccacgggcccggcatttgtccatctttctaggcgctcgcgactcggcgacggcggccgcagtgggacacggaggcggggccgggcacctgtgcgcgtttgcaggcacctgctgcgctggccgcctcgcagcccgggactgctgctggggactgcggctggagctgggctggcccggcccgagggagaggggggcccagctggctcgccccggcccgtgcccgccctccccggccgggtcccgaccccgagctctggttaagggggcgtcgccgggccccagagcccccccactggaggggcccgcggctcccgggccagcatcgagctagctgcgaggccaggacagggcccccgccttgcatcacctcgagacaggtaaagtgaatgccgaagacagaagatttggatgatacaccactgactttctttgtttggaatacacgttatgaaccctttctggagcatgtctacaagctctgtacgcaaacgatctgaaggtgaagagaagacattaacaggggacgtgaaaaccagtcctccacgaactgcaccaaagaaacagctgccttctattcccaaaaatgctttgcccataactaagcctacatctcctgccccagcagcacagtcaacaaatggcacgcatgcgtcctatggacccttctacctggaatactctcttcttgcagaatttaccttggttgtgaagcagaagctaccaggcgtctatgtgcagccatcttatcgctctgcattaatgtggtttggagtaatattcatacggcatggactttaccaagatggcgtatttaagtttacagtttaca

SEQ ID NO: 106143 - DNA, 1162 bp, Homo sapiens
  Payload ID: 810
  Gene Symbol: AKTIP
  Gene Name: AKT interacting protein
  Uniprot ID: Q9H8T0
  ENST ID: ENST00000570004
  CDS Start-End: 177-1055
gctggcgctgcggcgggagatgctgtcgggccgcggcggcgcttggcagccaggagctctgcattgaaggcactggggtgaggcttactgcccggcaggctggtgggtaaagtgaatgccgaagacagaagatttggatgatacaccactgactttctttgtttggaatacacgttatgaaccctttctggagcatgtctacaagctctgtacgcaaacgatctgaaggtgaagagaagacattaacaggggacgtgaaaaccagtcctccacgaactgcaccaaagaaacagctgccttctattcccaaaaatgctttgcccataactaagcctacatctcctgccccagcagcacagtcaacaaatggcacgcatgcgtcctatggacccttctacctggaatactctcttcttgcagaatttaccttggttgtgaagcagaagctaccaggcgtctatgtgcagccatcttatcgctctgcattaatgtggtttggagtaatattcatacggcatggactttaccaagatggcgtatttaagtttacagtttacatccctgataactatccagatggtgactgtccacgcttggtgttcgatattcctgtctttcacccgctagttgatcccacctcaggtgagctggatgtgaagagagcatttgcaaaatggaggcggaaccataatcatatttggcaggtattaatgtatgcaaggagagttttctacaagattgatacagcaagccccctgaacccagaggctgcagtactgtatgaaaaagatattcagctttttaaaagtaaagttgttgacagtgttaaggtgtgcactgctcgtttgtttgaccaacctaaaatagaagacccctatgcaattagcttttctccatggaatccttctgtacatgatgaagccagagaaaagatgctgactcagaaaaagcctgaagaacagcacaataaaagtgttcatgttgctggcctgtcatgggtaaagcctggctcagtacagcctttcagtaaagaagagaaaacagtggcgacttaagagatggtgaatctggtgcaccatgcactttcctgctagactctggcctagttcaagctgaccaatggcagaggactgcctgaagagtaaaactgtgtgaacaatga

SEQ ID NO: 106144 - DNA, 541 bp, Homo sapiens
  Payload ID: 810
  Gene Symbol: AKTIP
  Gene Name: AKT interacting protein
  ENST ID: ENST00000564497
  CDS Start-End: 500-541
gggcagggctggcgctgcggcgggagatgctgtcgggccgcggcggcgcttggcagccaggagctctgcattgaaggcactggggcgctcgcgactcggcgacggcggccgcagtgggacacggaggcggggccgggcacctgtgcgcgtttgcaggcacctgctgcgctggccgcctcgcagcccgggactgctgctggggactgcggctggagctgggctggcccggcccgagggagaggggggcccagctggctcgccccggcccgtgcccgccctccccggccgggtcccgaccccgagctctggttaagggggcgtcgccgggccccagagcccccccactggaggggcccgcggctcccgggccagcatcgagctagctgcgaggccaggacagggcccccgccttgcatcacctcgagacaggtaaagtgaatgccgaagacagaagatttggatgatacaccactgactttctttgtttggaatacacgttatgaaccctttctggagcatgtctacaagctctgtacgcaaa

SEQ ID NO: 106145 - DNA, 562 bp, Homo sapiens
  Payload ID: 810
  Gene Symbol: AKTIP
  Gene Name: AKT interacting protein
  ENST ID: ENST00000563928
  CDS Start-End: 114-562
ttttctcttggaaaacaaaacagcagtaatgggcactggcaaggtaaagtgaatgccgaagacagaagatttggatgatacaccactgactttctttgtttggaatacacgttatgaaccctttctggagcatgtctacaagctctgtacgcaaacgatctgaaggtgaagagaagacattaacaggggacgtgaaaaccagtcctccacgaactgcaccaaagaaacagctgccttctattcccaaaaatgctttgcccataactaagcctacatctcctgccccagcagcacagtcaacaaatggcacgcatgcgtcctatggacccttctacctggaatactctcttcttgcagaatttaccttggttgtgaagcagaagctaccaggcgtctatgtgcagccatcttatcgctctgcattaatgtggtttggagtaatattcatacggcatggactttaccaagatggcgtatttaagtttacagtttacatccctgataactatccagatggtgactgtccacgcttggtgttcgatattcctgtctttcacccgct

SEQ ID NO: 106146 - DNA, 574 bp, Homo sapiens
  Payload ID: 810
  Gene Symbol: AKTIP
  Gene Name: AKT interacting protein
  ENST ID: ENST00000570041
  CDS Start-End: 454-574
ggaagttgctgttcttacagctgggcttggctgcttttcctttgcttctttgtatttttagtaaatgacccactgactttatgacctttgagacatgctttcttatccacgacttgaagcttcggctggaagatctgtacttgtgaaatgtctctcttgcgtgcctgtgttgcatttgtctggattgcttggcagttccttaagtacatgatcctgcagtttctatatgtttcgaagttgtagaaggcagtttattgggggatggtactgacaggactcaggtaactacttttgtcgtcttagtgacatacttgtgctgtgccttcctgttttctcttatttctttggctaatactttgctggaggaatcattttgtactcaggtaaagtgaatgccgaagacagaagatttggatgatacaccactgactttctttgtttggaatacacgttatgaaccctttctggagcatgtctacaagctctgtacgcaaacgatctgaaggtgaagagaagacattaacaggggacgtgaaaaccagtcctccacgaactgcaccaaagaaacagctgc

SEQ ID NO: 106147 - DNA, 562 bp, Homo sapiens
  Payload ID: 810
  Gene Symbol: AKTIP
  Gene Name: AKT interacting protein
  ENST ID: ENST00000565408
  CDS Start-End: 154-562
agaggcaaccaaaaatggaccaaacaacccggccagagaatgcggcttctgagtgtaagacactgaggcggtgtcacagacaggtaaagtgaatgccgaagacagaagatttggatgatacaccactgactttctttgtttggaatacacgttatgaaccctttctggagcatgtctacaagctctgtacgcaaacgatctgaaggtgaagagaagacattaacaggggacgtgaaaaccagtcctccacgaactgcaccaaagaaacagctgccttctattcccaaaaatgctttgcccataactaagcctacatctcctgccccagcagcacagtcaacaaatggcacgcatgcgtcctatggacccttctacctggaatactctcttcttgcagaatttaccttggttgtgaagcagaagctaccaggcgtctatgtgcagccatcttatcgctctgcattaatgtggtttggagtaatattcatacggcatggactttaccaagatggcgtatttaagtttacagtttacatccctgataactatccagatggtgact

SEQ ID NO: 106148 - DNA, 1760 bp, Homo sapiens
  Payload ID: 811
  Gene Symbol: AKT1S1
  Gene Name: AKT1 substrate 1 (proline-rich)
  Uniprot ID: Q96B36
  ENST ID: ENST00000344175
  CDS Start-End: 112-882
ggcatggcctaagccggtcagctaaggccatgttaatacggggctgtcccatctctctgcggggcgcgacagctggaagagccgaacggataagagaagaggagggcgcggatggcgtcggggcgccccgaggagctgtgggaggccgtggtgggggccgctgagcgcttccgggcccggactggcacggagctggtgctgctgaccgcggccccgccgccaccaccccgcccgggcccctgtgcctatgctgcccatggtcgaggagccctggcggaggcagcgcgccgttgcctccacgacatcgcactggcccacagggctgccactgctgctcggcctcctgcgcccccaccagcaccacagccacccagtcccacacccagcccaccccggcctaccctggccagagaggacaacgaggaggacgaggatgagcccacagagacagagacctccggggagcagctgggcattagtgataatggagggctctttgtgatggatgaggacgccaccctccaggaccttccccccttctgtgagtcagaccccgagagtacagatgatggcagcctgagcgaggagacccccgccggcccccccacctgctcagtgcccccagcctcagccctacccacacagcagtacgccaagtccctgcctgtgtctgtgcccgtctggggcttcaaggagaagaggacagaggcgcggtcatcagatgaggagaatgggccgccctcttcgcccgacctggaccgcatcgcggcgagcatgcgcgcgctggtgctgcgagaggccgaggacacccaggtcttcggggacctgccacggccgcggcttaacaccagcgacttccagaagctgaagcggaaatattgaagtccagggagggagcgccccgggccgcgtccgccccgtcccacactacgcccccgccccactcccggggcctgctaatctgaggccgatccgggaccggcctccttgcgtctcccattcccaagattgtcccgcctctgccaatccccgccgtccttccagcccacgacctgccgcgccgaggagcggcatctgtcccgtttcccgattgggtctgtcgtctctctccgcctagcgacagattccttctattaagggattggctcgctgagttctaagctctaaatgggtcaactcctttgttttccgcctagcgacaagggatttgctcgcacggcattggctccatcccctagtcgctggacagctctttttttgattggctcaaatcctgtaaagggcttgaccagtctctacatagtcaccgtccgcttttcctgagttctccctcccaattggctccagcttcctgggggcgtggccaagccctcctcttcccagaattggcccggggccttcaatttacgttctttacactacggggactggggtcgtctttgcccacgtcccgacaacttgttccctgaccccctcagggatggccccaaactgtccctgcctctggcaccccctttcattggttccatccatccccacaacagcctgccaatcgaagcccgtccctgcatccaggatggtaccagctcccgcccctcgccccccacctccacaggtgccttaaagggccctcgtccacccaaggtggggggcaggggccctcactctccggccctggtgtgggggagagagtgaggggttgggggatcggcagttgggaggggcgctctgagattaaagagttttacctctgagataaa

SEQ ID NO: 106149 - DNA, 623 bp, Homo sapiens
  Payload ID: 811
  Gene Symbol: AKT1S1
  Gene Name: AKT1 substrate 1 (proline-rich)
  ENST ID: ENST00000391830
  CDS Start-End: 298-623
aaaccacattcccaaaactttccgttgcaaatttccaaactttcccagtttctaccctcagcctttcaaagtcccgcccctcattccagttcccacacccagccttcttcaggtcccactgctgaccgccagaccaaactcctacagctgccgcctgcatcccagaccgcctgcatcccgctcggagcgggtccgagccctgctccctcccagcgcaccttttccacgacacggatgacaccagcgatgagagagtctcggtcctgatacttcttagcgctggtgtgcagggcgcggatggcgtcggggcgccccgaggagctgtgggaggccgtggtgggggccgctgagcgcttccgggcccggactggcacggagctggtgctgctgaccgcggccccgccgccaccaccccgcccgggcccctgtgcctatgctgcccatggtcgaggagccctggcggaggcagcgcgccgttgcctccacgacatcgcactggcccacagggctgccactgctgctcggcctcctgcgcccccaccagcaccacagccacccagtcccacacccagcccaccccggcctaccctggccagagaggacaacgaggaggacgaggatga

SEQ ID NO: 106150 - DNA, 2025 bp, Homo sapiens
  Payload ID: 811
  Gene Symbol: AKT1S1
  Gene Name: AKT1 substrate 1 (proline-rich)
  Uniprot ID: Q96B36
  ENST ID: ENST00000391831
  CDS Start-End: 384-1154
atttcctgttttcttcctagaccagtgggtcctccctggaccccgggcgaggttgggaggtctcggggcagctgagcgtggccccaggcgctcaccccatggctaccgcgttcatgctcaggttcctcacatcttggggtgtggggtactaaaatttcgacaggaggggtggttccacccctctcctccttagctcttttccctcctccctgcatccaaagaggacagccacatcgtgctccccctcctgtggggaacacgtctcactttcctctaatctctccctgatcttacacgaaactcgtctatcggggcgggttcttcctccatctctcagctccttggaggaaacaggacctcctctagaagctgaaggggcgcggatggcgtcggggcgccccgaggagctgtgggaggccgtggtgggggccgctgagcgcttccgggcccggactggcacggagctggtgctgctgaccgcggccccgccgccaccaccccgcccgggcccctgtgcctatgctgcccatggtcgaggagccctggcggaggcagcgcgccgttgcctccacgacatcgcactggcccacagggctgccactgctgctcggcctcctgcgcccccaccagcaccacagccacccagtcccacacccagcccaccccggcctaccctggccagagaggacaacgaggaggacgaggatgagcccacagagacagagacctccggggagcagctgggcattagtgataatggagggctctttgtgatggatgaggacgccaccctccaggaccttccccccttctgtgagtcagaccccgagagtacagatgatggcagcctgagcgaggagacccccgccggcccccccacctgctcagtgcccccagcctcagccctacccacacagcagtacgccaagtccctgcctgtgtctgtgcccgtctggggcttcaaggagaagaggacagaggcgcggtcatcagatgaggagaatgggccgccctcttcgcccgacctggaccgcatcgcggcgagcatgcgcgcgctggtgctgcgagaggccgaggacacccaggtcttcggggacctgccacggccgcggcttaacaccagcgacttccagaagctgaagcggaaatattgaagtccagggagggagcgccccgggccgcgtccgccccgtcccacactacgcccccgccccactcccggggcctgctaatctgaggccgatccgggaccggcctccttgcgtctcccattcccaagattgtcccgcctctgccaatccccgccgtccttccagcccacgacctgccgcgccgaggagcggcatctgtcccgtttcccgattgggtctgtcgtctctctccgcctagcgacagattccttctattaagggattggctcgctgagttctaagctctaaatgggtcaactcctttgttttccgcctagcgacaagggatttgctcgcacggcattggctccatcccctagtcgctggacagctctttttttgattggctcaaatcctgtaaagggcttgaccagtctctacatagtcaccgtccgcttttcctgagttctccctcccaattggctccagcttcctgggggcgtggccaagccctcctcttcccagaattggcccggggccttcaatttacgttctttacactacggggactggggtcgtctttgcccacgtcccgacaacttgttccctgaccccctcagggatggccccaaactgtccctgcctctggcaccccctttcattggttccatccatccccacaacagcctgccaatcgaagcccgtccctgcatccaggatggtaccagctcccgcccctcgccccccacctccacaggtgccttaaagggccctcgtccacccaaggtggggggcaggggccctcactctccggccctggtgtgggggagagagtgaggggttgggggatcggcagttgggaggggcgctctgagattaaagagttttacctctg

SEQ ID NO: 106151 - DNA, 1911 bp, Homo sapiens
  Payload ID: 811
  Gene Symbol: AKT1S1
  Gene Name: AKT1 substrate 1 (proline-rich)
  Uniprot ID: Q96B36
  ENST ID: ENST00000391832
  CDS Start-End: 263-1033
gggcgcgacagctggaagagccgaacggataagagaagaggaggtgagaggagctgtacaccacaagaggcactgagggactcaggataacgggatgaagccgtcagtgcccccagaaacgaagcggccccggacgaatttctgagtcaccgtcgcgagaaagcgggctgagccgccattttgaagcctggcaaaccgaagcaagaaatgctgccgtgttggatctttgccagccttcgtgccgaatgggagcagggcgcggatggcgtcggggcgccccgaggagctgtgggaggccgtggtgggggccgctgagcgcttccgggcccggactggcacggagctggtgctgctgaccgcggccccgccgccaccaccccgcccgggcccctgtgcctatgctgcccatggtcgaggagccctggcggaggcagcgcgccgttgcctccacgacatcgcactggcccacagggctgccactgctgctcggcctcctgcgcccccaccagcaccacagccacccagtcccacacccagcccaccccggcctaccctggccagagaggacaacgaggaggacgaggatgagcccacagagacagagacctccggggagcagctgggcattagtgataatggagggctctttgtgatggatgaggacgccaccctccaggaccttccccccttctgtgagtcagaccccgagagtacagatgatggcagcctgagcgaggagacccccgccggcccccccacctgctcagtgcccccagcctcagccctacccacacagcagtacgccaagtccctgcctgtgtctgtgcccgtctggggcttcaaggagaagaggacagaggcgcggtcatcagatgaggagaatgggccgccctcttcgcccgacctggaccgcatcgcggcgagcatgcgcgcgctggtgctgcgagaggccgaggacacccaggtcttcggggacctgccacggccgcggcttaacaccagcgacttccagaagctgaagcggaaatattgaagtccagggagggagcgccccgggccgcgtccgccccgtcccacactacgcccccgccccactcccggggcctgctaatctgaggccgatccgggaccggcctccttgcgtctcccattcccaagattgtcccgcctctgccaatccccgccgtccttccagcccacgacctgccgcgccgaggagcggcatctgtcccgtttcccgattgggtctgtcgtctctctccgcctagcgacagattccttctattaagggattggctcgctgagttctaagctctaaatgggtcaactcctttgttttccgcctagcgacaagggatttgctcgcacggcattggctccatcccctagtcgctggacagctctttttttgattggctcaaatcctgtaaagggcttgaccagtctctacatagtcaccgtccgcttttcctgagttctccctcccaattggctccagcttcctgggggcgtggccaagccctcctcttcccagaattggcccggggccttcaatttacgttctttacactacggggactggggtcgtctttgcccacgtcccgacaacttgttccctgaccccctcagggatggccccaaactgtccctgcctctggcaccccctttcattggttccatccatccccacaacagcctgccaatcgaagcccgtccctgcatccaggatggtaccagctcccgcccctcgccccccacctccacaggtgccttaaagggccctcgtccacccaaggtggggggcaggggccctcactctccggccctggtgtgggggagagagtgaggggttgggggatcggcagttgggaggggcgctctgagattaaagagttttacctctgagataaa

SEQ ID NO: 106152 - DNA, 3640 bp, Homo sapiens
  Payload ID: 811
  Gene Symbol: AKT1S1
  Gene Name: AKT1 substrate 1 (proline-rich)
  Uniprot ID: Q96B36
  ENST ID: ENST00000391833
  CDS Start-End: 1991-2761
ctggattagaatatctgccctcctaaaggcaggcaggatggcggtcaggatttagaacaggccccggatctagactttctgagtccaggtcccagccctgcctcttccagttgtggcccttcaagatgctgactgcccctgggcctgagtttgcaactgtaaaatggggtgaactgtaactaaagctcctgtctcatagtgtaggtgaaagggtgggatgagaaggttgatcccatcttgggtccttgcgtggcttctgggaggtggtggataaacctcttccttcccttggggctttgaactccctgagtgagtcagataggtgagatgccaggtgtggaatcccagcactgaataggtgctcagcaaacaccaacatcaatgatcgtgagtcataaaaggcctgcaaatttcattcagactccagactccctgctcccttcaccctggtgggctggaccacagctgtgcctgaatccgtgcagtggcggtgtgcttactgcctcccggaagagcgtcttccgcagcccagcagctctggctcaaccacgctggttaatggggaagaaaatgaggcacagagagggccagtgagccatctaaggtcacacagcaggtttgagacagagtcagggcaaggacccagcccccctgccctcgctcttctcacccagtaaggagacgcaccctgcattgtctgcttagggccgacctgtcctgcaaacacaaatccctgaccttgggggaattcacagtctgatgcaggaggcagccaggttacagctgtcacaagctcaggtgacatgaatgctcatggaggaagcccagggcatcggatgggctcctgaagtcatctgatgcaccctgggggatcagggacaacagaggacctgccagaacagtcttgtaggaaaagccgtgtggatttcccagcacagagagcagcgccagcaccatttcagccccgactctctgaggcctcagtcatagaaccagccagttccctctggaaggaagtgtgctgggaaggtggccactcagacagtgtgggaccccctatggagcagactggctggatctatgggcgagggaaagtttcttccaccctaggatgagtgaaaggttggtggggaatggagcacaagtcatcaaggtcagggaccacgttttctgaaggcctcgggcctcagaggctctggaaggccgtggaggcaggatggcccaggagctggggatggccagaacacctagagcctccagggcctgccctgaggactatggcgaggagtagcatcagctccgggtgctgaaggaaccccctgggccttgtgcaggacactcttgacgggatggctgggcgacggagcagggtggcatcatccatcaaattcaacacaagccccacgtggaattctaaattttctagacaccatgttaaaagagtaaaaaaagcagatgaaattcctttttttttttttttttgcccaggctggcttcgaactcttgggctcggtgatccgcctgcctcggcctcccaaagtgctggggttgcaggcctgagccaccacgcccggctcgttcggctttattgtactcagtcttcagaacccagtgcaggttttattgttagaggcctctctgctaggactctctgctaggactccctgcctttccagtactccctgttcacatgtggctggcggctcccacagaggccagggcagggccaaaggggaaggagtacagtgacttggggcaggaggaatgggttggggcagaggacgtcgccagggtctgggcctgcgaggactggatggtgagaatcctggggagtagcaggtttggggaggacacacagcaccgctgggacaaggtgggtggagggtggtgagtgccatccaggggacgggcgggcactctgagtgggtggcgatgatgtaggccgccaagcctcagccccctctgtcctgctctggcccgcagggcgcggatggcgtcggggcgccccgaggagctgtgggaggccgtggtgggggccgctgagcgcttccgggcccggactggcacggagctggtgctgctgaccgcggccccgccgccaccaccccgcccgggcccctgtgcctatgctgcccatggtcgaggagccctggcggaggcagcgcgccgttgcctccacgacatcgcactggcccacagggctgccactgctgctcggcctcctgcgcccccaccagcaccacagccacccagtcccacacccagcccaccccggcctaccctggccagagaggacaacgaggaggacgaggatgagcccacagagacagagacctccggggagcagctgggcattagtgataatggagggctctttgtgatggatgaggacgccaccctccaggaccttccccccttctgtgagtcagaccccgagagtacagatgatggcagcctgagcgaggagacccccgccggcccccccacctgctcagtgcccccagcctcagccctacccacacagcagtacgccaagtccctgcctgtgtctgtgcccgtctggggcttcaaggagaagaggacagaggcgcggtcatcagatgaggagaatgggccgccctcttcgcccgacctggaccgcatcgcggcgagcatgcgcgcgctggtgctgcgagaggccgaggacacccaggtcttcggggacctgccacggccgcggcttaacaccagcgacttccagaagctgaagcggaaatattgaagtccagggagggagcgccccgggccgcgtccgccccgtcccacactacgcccccgccccactcccggggcctgctaatctgaggccgatccgggaccggcctccttgcgtctcccattcccaagattgtcccgcctctgccaatccccgccgtccttccagcccacgacctgccgcgccgaggagcggcatctgtcccgtttcccgattgggtctgtcgtctctctccgcctagcgacagattccttctattaagggattggctcgctgagttctaagctctaaatgggtcaactcctttgttttccgcctagcgacaagggatttgctcgcacggcattggctccatcccctagtcgctggacagctctttttttgattggctcaaatcctgtaaagggcttgaccagtctctacatagtcaccgtccgcttttcctgagttctccctcccaattggctccagcttcctgggggcgtggccaagccctcctcttcccagaattggcccggggccttcaatttacgttctttacactacggggactggggtcgtctttgcccacgtcccgacaacttgttccctgaccccctcagggatggccccaaactgtccctgcctctggcaccccctttcattggttccatccatccccacaacagcctgccaatcgaagcccgtccctgcatccaggatggtaccagctcccgcccctcgccccccacctccacaggtgccttaaagggccctcgtccacccaaggtggggggcaggggccctcactctccggccctggtgtgggggagagagtgaggggttgggggatcggcagttgggaggggcgctctgagattaaagagttttacctctgagataaat

SEQ ID NO: 106153 - DNA, 1849 bp, Homo sapiens
  Payload ID: 811
  Gene Symbol: AKT1S1
  Gene Name: AKT1 substrate 1 (proline-rich)
  Uniprot ID: Q96B36
  ENST ID: ENST00000391834
  CDS Start-End: 195-965
cttcttcaggtcccactgctgaccgccagaccaaactcctacagctgccgcctgcatcccagaccgcctgcatcccgctcggagcgggtccgagccctgctccctcccagcgcaccttttccacgacacggatgacaccagcgatgagagagtctcggtcctgatacttcttagcgctggtgtgcagggcgcggatggcgtcggggcgccccgaggagctgtgggaggccgtggtgggggccgctgagcgcttccgggcccggactggcacggagctggtgctgctgaccgcggccccgccgccaccaccccgcccgggcccctgtgcctatgctgcccatggtcgaggagccctggcggaggcagcgcgccgttgcctccacgacatcgcactggcccacagggctgccactgctgctcggcctcctgcgcccccaccagcaccacagccacccagtcccacacccagcccaccccggcctaccctggccagagaggacaacgaggaggacgaggatgagcccacagagacagagacctccggggagcagctgggcattagtgataatggagggctctttgtgatggatgaggacgccaccctccaggaccttccccccttctgtgagtcagaccccgagagtacagatgatggcagcctgagcgaggagacccccgccggcccccccacctgctcagtgcccccagcctcagccctacccacacagcagtacgccaagtccctgcctgtgtctgtgcccgtctggggcttcaaggagaagaggacagaggcgcggtcatcagatgaggagaatgggccgccctcttcgcccgacctggaccgcatcgcggcgagcatgcgcgcgctggtgctgcgagaggccgaggacacccaggtcttcggggacctgccacggccgcggcttaacaccagcgacttccagaagctgaagcggaaatattgaagtccagggagggagcgccccgggccgcgtccgccccgtcccacactacgcccccgccccactcccggggcctgctaatctgaggccgatccgggaccggcctccttgcgtctcccattcccaagattgtcccgcctctgccaatccccgccgtccttccagcccacgacctgccgcgccgaggagcggcatctgtcccgtttcccgattgggtctgtcgtctctctccgcctagcgacagattccttctattaagggattggctcgctgagttctaagctctaaatgggtcaactcctttgttttccgcctagcgacaagggatttgctcgcacggcattggctccatcccctagtcgctggacagctctttttttgattggctcaaatcctgtaaagggcttgaccagtctctacatagtcaccgtccgcttttcctgagttctccctcccaattggctccagcttcctgggggcgtggccaagccctcctcttcccagaattggcccggggccttcaatttacgttctttacactacggggactggggtcgtctttgcccacgtcccgacaacttgttccctgaccccctcagggatggccccaaactgtccctgcctctggcaccccctttcattggttccatccatccccacaacagcctgccaatcgaagcccgtccctgcatccaggatggtaccagctcccgcccctcgccccccacctccacaggtgccttaaagggccctcgtccacccaaggtggggggcaggggccctcactctccggccctggtgtgggggagagagtgaggggttgggggatcggcagttgggaggggcgctctgagattaaagagttttacctctgagataaatgtgaa

SEQ ID NO: 106154 - DNA, 3075 bp, Homo sapiens
  Payload ID: 811
  Gene Symbol: AKT1S1
  Gene Name: AKT1 substrate 1 (proline-rich)
  Uniprot ID: Q96B36
  ENST ID: ENST00000391835
  CDS Start-End: 1374-2204
attgccccgggaccaaggcggggagaatggtccagcccgcgttcggatgctgacgtgcgttccacagggggcagggctcaaggagtcgcctgagccgggggggcggggccatgggaggttcttccctggggcggtggacgggagggtgacggcgcgtttataagagatcggtgtttgccaaggccgtgccggattctcgagagccaaggcctgagagaagagctgatcactagacggggcgtttcgcatacactgaagcgagggaatgcgtcctcagtgcttaccctgtagccggctccttccatagtcgccgccgaaggccccactgccccgcctcctccttttcctagtcagcgtgttgtcacttccggagaaaacagttcccctccgggccggacagtggtagcggcccgacccgttctagagaaggagcgggtgaaaccatttttcagaagggggttattccactggaacctcgagggtggatcggagtcacgtggcgcagacgctgaaggtggatccggctacggagagtgcgcaggcgcagtgttcgccctctcgccacgaagtaaacaagtgggagggtctgagagctgcaccacctggggcaagcacgccttgaaacgcccacttccttctccatattgtatactggaattgaagccaaggaggtaccattttgctcgagggcatggcctaagccggtcagctaaggccatgttaatacggggctgtcccatctctctgcggggcgcgacagctggaagagccgaacggataagagaagaggaggtgagaggagctgtacaccacaagaggcactgagggactcaggataacgggatgaagccgtcagtgcccccagaaacgaagcggccccggacgaatttctgagtcaccgtcgcgagaaagcgggctgagccgccattttgaagcctggcaaaccgaagcaagaaatgctgccgtgttggatctttgccagccttcgtgccgaatgggagcaggttggagggagggagagccaatatacactatgggctgattaagcccggttggctgccatgttgttaacgagcaccgatttcctctacttttgtcgaagaagtttattgtgggtcagggacgtcaggtcgcttgccttcgtttactgtggtcatgattgagcatatgaggacggccattattgttgggggcaaatggaaatgctctaggcggggccatttttcttaggggcaagctgtcgtcacccttgtcaactggttcggatgaagcccctgtggccgccatcttgatctcgggcggccccgataagggaggcggagtgtgcggagaggaggcggggcaactgcgcggacgtgacgcaaggcgccgccatgtcttttgagggcggtgacggcgccgggccggccatgctggctacgggcacggcgcggatggcgtcggggcgccccgaggagctgtgggaggccgtggtgggggccgctgagcgcttccgggcccggactggcacggagctggtgctgctgaccgcggccccgccgccaccaccccgcccgggcccctgtgcctatgctgcccatggtcgaggagccctggcggaggcagcgcgccgttgcctccacgacatcgcactggcccacagggctgccactgctgctcggcctcctgcgcccccaccagcaccacagccacccagtcccacacccagcccaccccggcctaccctggccagagaggacaacgaggaggacgaggatgagcccacagagacagagacctccggggagcagctgggcattagtgataatggagggctctttgtgatggatgaggacgccaccctccaggaccttccccccttctgtgagtcagaccccgagagtacagatgatggcagcctgagcgaggagacccccgccggcccccccacctgctcagtgcccccagcctcagccctacccacacagcagtacgccaagtccctgcctgtgtctgtgcccgtctggggcttcaaggagaagaggacagaggcgcggtcatcagatgaggagaatgggccgccctcttcgcccgacctggaccgcatcgcggcgagcatgcgcgcgctggtgctgcgagaggccgaggacacccaggtcttcggggacctgccacggccgcggcttaacaccagcgacttccagaagctgaagcggaaatattgaagtccagggagggagcgccccgggccgcgtccgccccgtcccacactacgcccccgccccactcccggggcctgctaatctgaggccgatccgggaccggcctccttgcgtctcccattcccaagattgtcccgcctctgccaatccccgccgtccttccagcccacgacctgccgcgccgaggagcggcatctgtcccgtttcccgattgggtctgtcgtctctctccgcctagcgacagattccttctattaagggattggctcgctgagttctaagctctaaatgggtcaactcctttgttttccgcctagcgacaagggatttgctcgcacggcattggctccatcccctagtcgctggacagctctttttttgattggctcaaatcctgtaaagggcttgaccagtctctacatagtcaccgtccgcttttcctgagttctccctcccaattggctccagcttcctgggggcgtggccaagccctcctcttcccagaattggcccggggccttcaatttacgttctttacactacggggactggggtcgtctttgcccacgtcccgacaacttgttccctgaccccctcagggatggccccaaactgtccctgcctctggcaccccctttcattggttccatccatccccacaacagcctgccaatcgaagcccgtccctgcatccaggatggtaccagctcccgcccctcgccccccacctccacaggtgccttaaagggccctcgtccacccaaggtggggggcaggggccctcactctccggccctggtgtgggggagagagtgaggggttgggggatcggcagttgggaggggcgctctgagattaaagagttttacctctg

SEQ ID NO: 106155 - DNA, 438 bp, Homo sapiens
  Payload ID: 811
  Gene Symbol: AKT1S1
  Gene Name: AKT1 substrate 1 (proline-rich)
  ENST ID: ENST00000599525
  CDS Start-End: 339-438
caggctggcttcgaactcttgggctcggtgatccgcctgcctcggcctcccaaagtgctggggttgcaggcctgagccaccacgcccggctcgttcggctttattgtactcagtcttcagaacccagtgcaggttttattgttagaggcctctctgctaggactctctgctaggactccctgcctttccagtactccctgttcacatgtggctggcggctcccacagaggccagggcagggccaaaggggaaggagtacagtgacttggggcaggaggaatgggttggggcagaggacgtcgccagggtctgggcctgcgaggactggatgggcgcggatggcgtcggggcgccccgaggagctgtgggaggccgtggtgggggccgctgagcgcttccgggcccggactggcacggagctggtgctgctgaccgcgg

SEQ ID NO: 106156 - DNA, 359 bp, Homo sapiens
  Payload ID: 812
  Gene Symbol:
  Gene Name: AL008723.1
  ENST ID: ENST00000623133
  CDS Start-End: 9-347
gtggtcagctggatcctccctttgcggtgaacagattctctgcagactcccaggtcccattctgtgcttgttcccacgtccacctcccagcagtggcggccacaggtaaagcgaggggagcccaggatgcaaacggacacgtcaaatctctcggcaaggtcttgccgattctgtctgatgcgcccacttcggacgctcctgaggtcgtcagaaatgaggaggaagttgttggctgtgttggcatccaaggtcatatccactgtgaaaaggaaaaaaagttgctcagcaaatggacagaaaccaaccctatgcctctcttctacttcaaaggcccaaatatctcttgactttagtttctt

SEQ ID NO: 106157 - DNA, 552 bp, Homo sapiens
  Payload ID: 813
  Gene Symbol:
  Gene Name: AL021546.6
  ENST ID: ENST00000551806
  CDS Start-End: 1-505
gtcgagtggcgcccatggcgaagagggctcagctcgcatgtggaagactctcaccttcttcgtcgcgctccccggggtggcagtcagcatgctgaatgtgtacctgaagtcgcaccacggagagcacgagagacccgagttcatcgcctacccccatctccgcatcaggaccaagggcagtggccggatcacggctgcggtgatcgagcacctggagcgtctagcgcttgtggacttcggcagccgcgaggcagtggcgcgactggagaaagctatcgccttcgccgaccggctacgcgccgtggacacagacggggtggagcccatggaatcggtcctggaggacagatgtctatacctgagatccgacaatgtggtagaaggcaactgtgctgatgaattactacaaaactcccatcgcgtcgtggaggagtactttgtggcccccccaggtaatatctctttgccaaagctggatgaacaagagccattcccacacagctgagtagctcattctggaaagggggtactctgtgaacatgtggaagcata

SEQ ID NO: 106158 - DNA, 841 bp, Homo sapiens
  Payload ID: 814
  Gene Symbol:
  Gene Name: AL022578.1
  ENST ID: ENST00000624399
  CDS Start-End: 11-742
aggagtcaacatggagaagttacggaagtgggtgctttgggacgttcggtacccctcggcggcgtggtcaggtggggaacatggccgcgcccacgtcgcgcttccccatgggatacaccatgttggaggagtgtccatccgtattgaggatgaggacacctctgaactcacagagcaggctgtgagtttagagctgtctgctctaaactcaggtggagctgtcccgctggtggcagggagcacgggtggggacgtttctctgggcgggctaactggaggagggggtctttggacctgtagtctatggatctgtgtgataccgctccgagaaactgaagggcctcttggaaagaatcaggggcggccgcggctatctcctggcagataccacaggatgagaagcggggagatgtcaggctggttacaggcttctcctaggacataccacaaggggaggaggaggaggagaaatcatggttatgcaagccctcctaggatatgccatgaggtgggaaaaagggagaactcagagtgctgggttcccctcctgctgtgcctgtggggcttggatgcgaggtttgaatgctgcagcaatttaccttatctcccactccatctaccccagctaaaaagggactacgtagtaccaatactaataatttttaatgtgtccttagtccaatgcaatatgtcaataaaaatctttaggaaactttattatttttatttcctcatgaagtaaaatatatgtggtcatggtgcccttactttggaaatgtagctttaatacaaggctctgcttctacccttcaaccagtttgctgctccatatcacctccaa

SEQ ID NO: 106159 - DNA, 2073 bp, Homo sapiens
  Payload ID: 815
  Gene Symbol:
  Gene Name: AL023806.1
  ENST ID: ENST00000625058
  CDS Start-End: 150-755
ccagtagagtgagatgctgctgaaaagatacccaaaaatgtgtaagcgactttggaactgggtagcaggcagaagttggaaaagtttggagggctcagaagaagacaggaaaatgtgggaaagtttggaacttcctagaaacttgaagaatggctttgaccaaaatgctgataatgatatggacaatgaaatccaggctgagctggtctcagatggagatgaggaacttgttgggaattggagctaaagtgactcgttatgttttagcaaagagactggtggcattttgcccctgccctaaagatttgtggaactttgaacttgagagagatgatttagggtatctggtggaagaagtttctaagcagcaaagcattcaagaggtgacttgggtgctgttaaaggcattcagttttataagggaagcagagcataaaaggttggaaaatttgcagcctgataatgtgatagaaaagaaaatcctattttctgaggagaaatttaagctggctgcaaaaatttggataagtaatgaggagctgaatattaatccccaagacaatggggaaaatgtctgcagggcatgtcagaggtcttcacagcagctcctcctgtcacagacctggaggcctagaaggaaaaaatggtttcatggtctgggcccaaggcccccttgctctgtgcagcctaaggacttggtgccttgcgtcccagccactccagccatggctaaaaggggccaaggtacagtttgagccattgcttcagagagtgcaagccccaaggcttggcagcttccatgtggtgctgagcctgcaggtgcacagaagttgagaattgaggtttggaacctctgcctagatttcagaggatgtacggaaatgcctggatatgcccaggcagaagaagtttgctgcagggacaaaggcctcatggagaacctctgccagggcagtgcagaagggaaatgtggggtcagagcccccacacagagtccctaccgaagcactgcctagtggagctgtgagaagagggtcaccgtcctccagaccccagaatggtgaatccactgacagcttgcactgtgcacctggaaaagccgtagacaatgccagcccatgaaagcagccaggagaggggctattccctgcaaagccacatgggtggagctgcccaagaccatgggaacccacttcttgcattggcatgacctggatgtgagtcatggagtcaaaggagatcattttggaactttaagacttgactgccccaatgattttggacttgcatgggcctttagccctttgttttggtcagtttctcccatttgcaatgagtgtgtttatccaatgtctgtgcccccatttcatctagaaagtaattaacttgcttttgattttactggttcataggtggaagggacttgccttatctcagatgaggctttggactttggccttttgagttaaggctgaaatgagctaagactttgtgggatggttgggaaggcatgattggttttgaaatatgaggacatgagatttgggagggaccaggagtggaatgatatggattggctttgtcctcactcaaatctcatctttaattgtaactcccacaattcccacatgttgtgggagggacccagtgggaggtaaacgaatcatgagggtgggtctttcccatgctattctcatgatagtgaatatgtctcatgagatctggtgcttttaaaaatgggagtttcctctcacaagttctctctcttttcctgttgccatccatgtaagatatgacttgtcctgcttgccttctgtcatgattgtgaggtttccccagccacgtggaactgtaattccattaaacctatttttcttcccagtctcgggtatgtctttatcggcagcatgaaaacagactaatacagaaggcattcagtagaggtttgttaatctaataatgaaaaatgattgaatagtgtcgtgtcagttagcttttgctgcataacatgaaatcctaaaagtttgttgtttaagcaacaatataattagctcatgattggttggctcagca

SEQ ID NO: 106160 - DNA, 375 bp, Homo sapiens
  Payload ID: 816
  Gene Symbol:
  Gene Name: AL023875.1
  ENST ID: ENST00000625088
  CDS Start-End: 1-375
atgactcttaacgagcatgctgccttcaagcatctgtttaacaaagcacatcttgcaccacccttaatccatttaaccctgagtggacacagcacatgtttcagagagcacagggttgggggtaaggtcacagatcaacaggatcccaaggcagaagaatttttcttagtaccgaacaaaatgaaaagtctcccatgtctacctctttctacacagacacggcaaccatccgatttctcaatcttttccccacctttcccccctttctattccacaaaaccgccattgtcatcatggcccgttctcaatgagctgttgggtacacctcccagatggggtggtggcctggcagaggggctcctcacttcccagtag

SEQ ID NO: 106161 - DNA, 1864 bp, Homo sapiens
  Payload ID: 817
  Gene Symbol:
  Gene Name: AL049794.1
  ENST ID: ENST00000623513
  CDS Start-End: 1275-1634
gggtggatcacttgaggtcaggagttcgagaccagcctgaccaacacgatgaaaccctgtctctactgaaaatacaaaaattagctgggtgtagtggcaggcacctgtaatcccagctactcaggaggctgaggcaggagaattgcttgaacccagaaggttgcagggagccaagatcacaccactgcactctgtcttaaaaaaaaataataaattaaaatagaaagttaaaacataggaatatataagcacatatttccttagctatcagaaatgtgagtgtgaaaaagacaaataatatgctggtgtcataatgaaaataattttaaccttgcagagccccccaagacctttaaaaacctctgggctgcgtgtcaggatacagtggtctccaagctaggcacagttcttgcctttgttgtactggatgctgtggtgctgtggaagcccatggtggggggttgggtctaacagacttgtggcatcaggaagggtacttggagagacagacctgaagtggagactagcctgggacaacaggtgtagtggtggatggagcagcatgtgggaggcccagaggcctcacctgaaaacctcaacgaagctcataatggctgcgtgttaatattgcatatgctgggatgataccagcagtttgagttctctggcttcagcgtgatatgattttatccacttgtttattttcagaggcacatgtagctgttctcaattcccttctctgtatgacttataggaagctaaaggcttccttgtgttagggagcttcctatttcaagtgctgagctgggtttgtcaagctttgaaaatgcagacagagccatgaaacctaagggggactcagaggaagtgtccatgtgcaggagagacaaggctgaattaaaaggcatgattaatcacaaaagagtggaagagtgatgcttgagagttgaggacgtgagtaaaacagaagtagaactgctcatttgatgtcatcacgttatctcaagatgagccctcttggcctcagacagtgggtagcattacattatatgttagctccgcgcccccacgcccaccctccttctttgaaatgatgtctaaattagaggtgtaactgtcccaccaggtgcaacttgagccttcctttgccctcctgtagctgtcgtgggaggggggcctgctttcttgggcacagactgtttggtcagctgagccacagaaatgaggccaggcctgtgttgctctctgtctatgcttgattgcaaggaacactgatgatatcagagggctttcttacctcaagcccttctggcttaaggacaaggttatttctttcatttctgtctgcaaactgtggtagtgtattcgatttcaaggattctgggatgaattcttcaatgataagaacctgctattattgtccctgctttacagctccagggattggcagcctcattcttcaaaagttgcacacctttagggccttgggaggtacaggcaccagcaaggagtcagaaggaatgaaagctggagagatgcggcccacactggaaagacaggaggaaaggagagagaaagcgcctcggccaggcacagtggctcatgcctgtaatcccagcactttgggaggctgaggcgggagatcacctgaggtcaggagactgagaccagcttgaccaacatggtgaaaccccatctctactaaaaatacaaaactagccgggcatggtggcgagtgcctgtaatctccgctacttaggaggctgaggcaggagaattgcttgaaccaggaggcggaggttgcagtgagctgagatcgtgccattgcactccagcctaggcaacaagagcaaaactgcatctc

SEQ ID NO: 106162 - DNA, 63 bp, Homo sapiens
  Payload ID: 818
  Gene Symbol:
  Gene Name: AL049872.1
  ENST ID: ENST00000624063
  CDS Start-End: 1-63
tcaagtatttttcattttccaggtggtccccctgctgctgctgctgctgctgctgttgctgct

SEQ ID NO: 106163 - DNA, 171 bp, Homo sapiens
  Payload ID: 819
  Gene Symbol:
  Gene Name: AL109927.1
  ENST ID: ENST00000624809
  CDS Start-End: 1-171
atgatcctagaaagtgggagaaagaaaggaggtagtggaaggcctaggaaagagccagggcagtctattgaaaaggatataagaagcctttctctacaatgcaagtgttgtgaagacaggtctttatgggctatttcaaccccacccccaattgtcatattacatggttag

SEQ ID NO: 106164 - DNA, 375 bp, Homo sapiens; identical to SEQ ID NO: 103504
  Payload ID: 820
  Gene Symbol:
  Gene Name: AL133335.1
  ENST ID: ENST00000624441
  CDS Start-End: 1-375

SEQ ID NO: 106165 - DNA, 99 bp, Homo sapiens
  Payload ID: 821
  Gene Symbol:
  Gene Name: AL133475.1
  ENST ID: ENST00000629867
  CDS Start-End: 1-99
gaatgtaaactccataatacaggaatttttgtctactttgttcattacagcatcaacagtgcctggtacattttattgaggtcattgttacacaagctc

SEQ ID NO: 106166 - DNA, 375 bp, Homo sapiens; identical to SEQ ID NO: 103451
  Payload ID: 822
  Gene Symbol:
  Gene Name: AL135745.1
  ENST ID: ENST00000623865
  CDS Start-End: 1-375

SEQ ID NO: 106167 - DNA, 93 bp, Homo sapiens
  Payload ID: 823
  Gene Symbol:
  Gene Name: AL135842.1
  ENST ID: ENST00000624892
  CDS Start-End: 1-93
agacagtctttgcaaagaagggtccagagcccccagagctgtggcagcagctggagcccccagactgctggccactgccactgccacagcagc

SEQ ID NO: 106168 - DNA, 375 bp, Homo sapiens
  Payload ID: 824
  Gene Symbol:
  Gene Name: AL136097.1
  ENST ID: ENST00000623714
  CDS Start-End: 1-375
atgactcttaacgagcatgctgccttcaagcatctgtttaacaaagcacatcttgcaccgcccttaatccattcaaccctgagtggacacagcacatgtttcagagagcacagggttgggggtaaggtcacagatcaacaggatcccaaggcagaagaatttttcttagtacagaacaaaatgaaaagtctcccatgtctacctctttctacacagacacggcaaccatccgatttctcaatcttttccccacctttcccccctttctattccacaaaaccgccattgtcatcatggcccgttctcaatgagctgttgggtacacctcccagacggggtggtggccgggcagaggtgctcctcacttcccagtag

SEQ ID NO: 106169 - DNA, 69 bp, Homo sapiens
  Payload ID: 825
  Gene Symbol:
  Gene Name: AL137164.1
  ENST ID: ENST00000626267
  CDS Start-End: 1-69
gagtatcaaaaatatatcattatgtcagatatcccagtatgtagtaaacaaaaaactcaaatacatttt

SEQ ID NO: 106170 - DNA, 375 bp, Homo sapiens
  Payload ID: 826
  Gene Symbol:
  Gene Name: AL137860.1
  ENST ID: ENST00000624078
  CDS Start-End: 1-375
atgactcttaacgagcatgctgccttcaagcatctgtttaacaaagcacatcttgcaccgcccttaatccatttaaccctgagtggacacagcacatgtttcagagagcacagggttggggataaggtcacagatcaacaggatcccaaggcagaagaatttttcttagtacagaacaaaatgaaaagtctcccatgtctacttctatccacacagacccggcaaccatccgatttctcaatcttttccccacccttcccgcctttctattccacaaaaccgccattgtcatcatggcccatccccaatgagccgctgggcacacctcccagacggggttgtggccgggcagaggggctcctcacttcccagtag

SEQ ID NO: 106171 - DNA, 57 bp, Homo sapiens
  Payload ID: 827
  Gene Symbol:
  Gene Name: AL138706.2
  ENST ID: ENST00000623337
  CDS Start-End: 1-57
ctggtacaactagtagttacatgtaaatatctattacatttttcttcaagtgaaact

SEQ ID NO: 106172 - DNA, 33 bp, Homo sapiens
  Payload ID: 828
  Gene Symbol:
  Gene Name: AL138751.1
  ENST ID: ENST00000626763
  CDS Start-End: 1-33
atctctactaaaaagggcaaggttacaagaagt

SEQ ID NO: 106173 - DNA, 54 bp, Homo sapiens
  Payload ID: 829
  Gene Symbol:
  Gene Name: AL139333.1
  ENST ID: ENST00000628460
  CDS Start-End: 1-54
agtacagtacttgctttaaaagacagactctcactcttttgcccaggctggagt

SEQ ID NO: 106174 - DNA, 57 bp, Homo sapiens
  Payload ID: 830
  Gene Symbol:
  Gene Name: AL158839.1
  ENST ID: ENST00000624855
  CDS Start-End: 1-57
ttagaagagatttattctcagccaaattttacagaagacctcctgagggctgtcctc

SEQ ID NO: 106175 - DNA, 54 bp, Homo sapiens
  Payload ID: 831
  Gene Symbol:
  Gene Name: AL162426.1
  ENST ID: ENST00000625046
  CDS Start-End: 1-54
agcaggtctaggcgtagctgccggccatgggggaggctactcgggaggttgggg

SEQ ID NO: 106176 - DNA, 3027 bp, Homo sapiens
  Payload ID: 832
  Gene Symbol:
  Gene Name: AL354822.1
  ENST ID: ENST00000612565
  CDS Start-End: 680-1411
ctgggacctcccctctccttgcggcatgctgggctttcccttagaaaaccccatgtcatttccttcaatggaacatgaatcagcttcacccacagtgtctgcatgtctctgtccatagcaaacgtttttattaccttaaaatatagatctttaccttaactagccaagacctaggaccctttttccaagctcttttagatgaagtaataaatgcaaatattagagatgtgtatatgtgtataaatatatggagaaaagatgttgcctagttgtacaaattagctttaatacaactcctgatttaaattatttaattgtgagaagggcgattctaactcaacacaccaacgaaataaaagccttatccctctgctccgccaaaatatcccatttagagcctgcgtgtgtgtgtacacacacgtgtgcactcatccccacctgaccgtatcaaattattatttaaactagatatttttactttgttgcatagtagtaatggtttctggaatgaaaaaataaaaaacaggagaataaaactgtttaaatgtatctccgggtgaacgctgtggccactgcacggaccccgtcgatggcgcccagtacctgcgtctcaggaagaggttctggcggggcctccgcctgaggccgcgcccctgggacctgtcccgcgtccacgtgaatgcggagcgcagcattcaccatcccctccctgaaacagcggtccccgaggtgctccacaggcagggccgagctgggcaagggggagcccagcccctgcacgggccgccctgagcagcggggacgcaggaagagctcgctggctccaccagcccctaccccagatgcgggacctcagaccagcaaggacctggagcccccaccccacggttgccaggaggcggacaggggcggctcctggggggctaccacctcgaggccgttccgccagaacttgagcgacttgggaaggcacagtgtcctgcccttgaagaggaacctgtgtcctggaggcagcagcctgggagctcctcctctgaggacaccgcagaggcgagtgactctggcggcgcagcgctggctttcccgtccgcagaggagagctgtggggctgggtgagctggaccagggagcacagctggctgctctcggcctccgatggggagtggacagcttagggggttgcccccgtgccagccagcctgctggccactctgggcttcatcacaccctcacctgcctgcgcaggcacctagcactgcaggctggagcttctggccatgctggtcaacttccccaacgagcctctgctgcctgggaacagcaaggccagagctacaccgccctgcacttggcagccatgtaccttggagatggtgaagctgctagtgggaacataggacgccgatgttgacatcagggactacactgggaaaagggcctcccagcatgtgagtcagagcatcacagaagagattgagaccctgatgggagtcctggacaaggacgatggggagagcaccgccagcagcgggggtgagtactggaagatttaaaagctgccccctccatctcaccacctacaaactctcacacgtcctggaagatggggggaccctctccaccatcaccacttggctgaaggtggtccagacgtgaagccaaggattccaaggcgcacagcctcgggcaggactaatggacttaaaaaacacaggctcaacaaaatccacttcacaacccagatggttcatatcacaccctctttcaaggacccagagcagccactggaagagaaggagtaggaacgctctcttaaagtccacttatcctattccttcaaattaagaccaaagtccaatgtatttaggtaaaaaataatttcttttagaaaatgctaaggtttgtcttctgaaatttaataacagaaacaaaaaaagaacactagatgtaatgaagtgagaccagaaaagacaaactaaactatccttactaggttggaatggatggggtggagttcctatcaggctagcattctggggaaagctgtattttttttttttggcggtggggggaaggtgtctcactctgtcgcccaggctggaatgcagtggcgccatctccgctcactgcaagctcagcccctcgggtttatgccattctccagccccagcctcccagtagctgggactacaggcgtccgccaccacacacggctaatttttttgtatttttagttgagacggtgtttcaccgtgttctccaggatggtctcgattcctgaattcgtgatccgcccgcctctgcctcccaaagtgctgggattacaggcgtgagccactgcgcctggccggatttctttttaagagattcatcataccttgacctgtgccccatttccctcctccacctgtctgacctggcattcctatttcgggagaccagaagtggggggaagagaagggatgactgtttctttgctttcaccattcctgcatgccatgcaaaggaaggaatattgcgcttttaaatatccgttttattaagtaagtggttactctttcaaagacaaaaaaaatgcaaattgttacaaaactggcagtatttgtaagtgcaagcactacacgctgccttgttcttttaccaattgcatttgcattttaaggtactacttgtacagccatggtggagaacagtttggaggttcctctaaacactgaaaatagaggtgccacatgatccagcaatcccactgttggatatataccccagaaataagaaatgagtatatcgaagaaattatctgcactcccatgttggttgcaccactgttgacaatagctaagatttggaagcaacctaagtgtccatcaacagattaatgtattaaagaaaatgtggtagatacacacagtggagtattattcagccctaaaaaagaatgagattcagtcatttgcaacaacatggaaggaactggatatcattatgttaagggaaataagccaagcacggaaaggcagacattgc

SEQ ID NO: 106177 - DNA, 1212 bp, Homo sapiens
  Payload ID: 833
  Gene Symbol:
  Gene Name: AL354828.1
  ENST ID: ENST00000623728
  CDS Start-End: 1-1212
atatttctaagagtttcctccagtgacaagcaactggactttctactccaggcaaaaataaataaatcacagagatttcccagaaggcaaaatgttccaattctgtggcaccgctgttcactacctacacatatacgaacccaaagatggaatgttcttatttcaaatctactctgtatatcatatcagaccatggggtttttttccctttcttttctttttttatgtttccttcgagaccttttaaaaacagaagtcttattaaaatctaatgaaaatcataatggcaatttaaaagttccagatgttagagtcatgctggagtgcagtggcgcgatctcggctcactgcaagctccgcctcccgggttcacgccattctcctgcctcagcctcccgagtagctgggactacaggcgcccaccaccacgcccggctaattttttgtatttttagtagaggcagagtttcaccgtgttatcacaaggtcagaagatcgagagcattctggctaacacgagaaaaccatccaaagaaatacaaaacaaaattagctgggcgtggtggtgggcgcctaccagctactcgggaggctgaggcaggagaatggcgtgaacctaggaggcagagcttgcagcggagatcaggccactgcactccagcctgggcaacagggagagactccatctcaaaaaaggtaggtcaacactgccgaaagcaacgggcgacagattgcttaaaagtggatgtgggccaggcgcagtggctcatgcctgtaatcccagcacttttgggaggccaaggcagccagatcacgagagaccagtctggcaaacatagtgaaaccccgtctctactaaaaatacaaaaaattagccgggtctggcagtgtgcacctgtaatcccagctactcgggaggctgaggcgggagaatcacgtgaacccaggaggcggaggttgcagccaagatcacaacactgcactccagcccaggtgacaactatgcacggtagcagaatatacatggccaaggaaggagaggtgggtatgggatggggggaagataaaatactgctccccgttacacacattacaccaccaccaccattactgtcaagcacatcatcattgcctacccccaccaataccatcaccgctatcatcaccaccattaccatcaacaccaaaactgaaaccaccaccactacaacc

SEQ ID NO: 106178 - DNA, 681 bp, Homo sapiens
  Payload ID: 834
  Gene Symbol:
  Gene Name: AL354828.2
  ENST ID: ENST00000624023
  CDS Start-End: 1-681
aggctggagtgcagtggcctgatctccgctcactgcaagctctgcctcctaggttcacgccattctcctgcctcagcctcccgagtagctgggactataggcgcccaccaccacgcccagctaattttttgtatttttagtagagacggggtttcaccgtgttatcacgaggtcagcagatcgagaccatcctggctaacacggtgtacatatatacgtaaatacaaaaaattagccgggcgtggtggtgggcgcctgccagctactcgggaggctgaggcaggagaatggcgtgaacccgggaggcggagcttgcagccgagatcgcgccactgcactccagcctgggcgacagagcgagactccgtctccataaaaaaaaaggatcatggaagactccaaaacaaagaagacacattgaaactctgttcaggaaaagttcgctggagcatgcctgtgatttctttgaacacgggagggaaagctacagcattgaggatgtctggagcaggctctgcactacacggtgaaaccccgtctctactaaaaatacaaaaaattagctgggcgtggtggcaggcgcctgtagtcccagctgctggggaggctgaggcaggagaatggcgtgaacccaggaggcggagcttgcatgagcggagattgcgtcactgcactccagcc

SEQ ID NO: 106179 - DNA, 510 bp, Homo sapiens
  Payload ID: 835
  Gene Symbol:
  Gene Name: AL356131.3
  ENST ID: ENST00000635558
  CDS Start-End: 1-510
atgggcaaagacatcatgaataaaacaccaaaagcaatggcaacaaaagccagaattgacaaatgggatctaattaaactaaagagcttctgcacagcaaaagaaactatcatcagaacgaacaggcaacctacagaatgggagaaatttttggcaatctatccatctgacaaagggctaatatccagaatctacatggataaaaacagaaactataaaaagttaaaaagcagggtgacaaagcaaagagtacaaccaatgaaggttgatttaaaatgggataaaaagggccgggagcggctgctcaggcctgtaatcccagcactttgggaggctgaggcaggcagatcacctgaggccaggagttggagaccaccctggccaacatggcaaaacccggtctctactaaaaatacaaaaattagctgggtgtggtggcagctgcctgtaatcgcagctactcgggaggctaaggcgggagaatggattgaacctgggaggcagaggttg

SEQ ID NO: 106180 - DNA, 33 bp, Homo sapiens
  Payload ID: 836
  Gene Symbol:
  Gene Name: AL356135.1
  ENST ID: ENST00000624857
  CDS Start-End: 1-33
atggcaaggagaaaattatcatgctttctcatt

SEQ ID NO: 106181 - DNA, 2640 bp, Homo sapiens
  Payload ID: 837
  Gene Symbol:
  Gene Name: AL356289.1
  ENST ID: ENST00000622918
  CDS Start-End: 1567-2139
ctttttttttttttttttttttttttgagacggagtcttgcactgttgcccaggctggagacagtggtgtgatcttggctcactgcagtctccacctctcagattcaagtgattctcctgcctcagcctcccaagtagctgggattataggtgcccgccaccctgcctggctaatttttgtatttttagtaaagatggggttttgtaacattggccaggctggtctcaaactcctgacctcaactgaactgcccccatcgggcttccaaagtgttgggattagaggtctgagctactgggcccgggcaaacttggaaacatttttttccttcctagtgcctcagttttctcaaatgtaaaatgggaataaaatatctaccttgtaagacttttgtgagggtctaataactgttatatacattatctcatttaatcttcacaacaacctttaaaatagggatacgatcattctcaatttacagttgagtgaaagtgaggcagttcagatggcttgactaaggttacctggcatttgagtggcagagccaagatttaaacccagctctgtctgatgctagaccctttgcttcaaccatattctgtaatgtctcatttctaggaatgaatgaaggaatgttcacacatgtatcatccagcctctgaggtgcctctgacaaccataattgcctcctcatgaaaccgagcccagttcctcctgtggctcttcctgctgcagccgtgggccttgctctcctggctggaagcgctgttttcatcttatctggggattctcattgctgacggtgctggaggctgtggggcacagtggtttcaagcacaggctttggagtcaggcaaacctgggtttcaatatggctcaggaagctgttgggcaggaggacttttggtgagcaggcactgtctgataatggtgtttcccaggatcccaggtttcttgggggcacacaagtaggccaaagatgatctgggaacctcccagagaattgcctcatactgtactctccccaagaggctgcagccaagagaataggggccacgtcacgggggctcatgatggagtctgggctttgtgggaaaggaagtggggagggtctcagaaatgtttttacaatgtaaaatcttccagttagaactttatatgcaggatttaatcagaaggaaatttggacaggactcatttttctcattgctgctctaagtggctgctctaagcagtctggactgtctcccctgtggctttgttgagttcagtaaacatttattgtgcacatactgtgtgcaggcactttgctggggatacagggatgaaatagggacagtgcccatgcctgagggcattgccctgaagctggatgctaaggccatctgtgtgtgtgtctgtgtgtctgcatgtatctctgtgtctgcgtgtgtctctgtgtctgtgcttctgtgtctatgtgtatgtctgtgtgagtgtctgtgggtctctttttttgtgtttgtgtgtgtatctgtgtgtgtgttctctgtgtgcctgtatgtgtctttgatgtgtgtttctgtatgtgtctctgtgtgtgtctatatgtgtgtatctgtgtctatgtatgtgtgtgtcattttgtttgtttctgggtgtgtctacctctgcgtgtctctgtatacctgtatctccgtgtgtgtgtctgtgtgtgtgtatttgtgtgtctctgtatgtgcgtccgtgggtgtgtgtctgtgtgtgtgtgtgtgtgtattgagagggagggagaaagaaagggagcgacagatgggtcagcatggaaggtgtatcctcattcacagccctgggaggaatcagtcaatccacctactggtcaagaccaactctggtggtgcctggctgacagtgggaatgtgacttttcatttaagaatgggtttgcatttcctaggaaaagaatgtaggagttggagtctcaaggagtgttttttttttccttttgtgattgagagagcacagccttgtgtgcattggctgacagttaccaatctgcgtgttggggatagccacagagaagagacagagggaaccgcagacagtgagcaggagtctggtggaaccagtctgcctttaggcccaaacccccaactatgaatacctcaccttagggagctcagtcttttgtttgttcataaaaaaccaatctgggaaccagaggtggacaggaaagaggaggctgacctgctgctcccaggttaatgtgatcttggctggtgttgacaagtgtattatggttcatagcatagcacaaacccttagagattccccttgccctcaccggggtcaccacaccaaaccaggtatcttcaggagtgaggaccacaaaaaattggagatctcaccagggtgggcagagatttctttgttaaagtctgaaggagagaagactcaggggcatctctctggctccaaatctctgaagggccaaaggcagaagtgctgggggagtgtcaagttttcatttacaacagggacagcctgacagtggctgccttatgtggcagtgagtttcagtcaacagtcaacagaggcccaacgactactcaccaatgggaccaggtggccatagagggctggggagggcagagcaaggac

SEQ ID NO: 106182 - DNA, 900 bp, Homo sapiens
  Payload ID: 838
  Gene Symbol:
  Gene Name: AL356585.2
  ENST ID: ENST00000624447
  CDS Start-End: 1-900
agccagaccctggcctcagcacaagctccagtgcagaccccagcacccactctgcctggtcctgctcttccagggcccttccctggtggccgtgtggtcaggctgcacccagtccttttggcctccactgtggacagctatgagagacgcaacaagggtgctgcccgagttatcgggaccctgttgggaactgtcaacaaacactctgtggaggtcaccaattgcttttcagtgtcatacaatgagtcagatgaagtggttgttgacatggaatttgctaagaacatgtatgaactgcataaaaaagtttctccaaatgagctcatcttggggtggtacgctgccggccatgacatcacagagcactctgtgctgatccatgagtactacagccgagaggcccccaaccccatccacctcactgtggacacaagtctccagaacggccatatgagcatcaaagcctatgtcagcactttaatgggtgtccctgggaggaccgtgggagtgttcacacctttgacagtgaaatatgcatactatgacactgaatgcatcagagttgacctgatcatgaagacctgctttagccccaacagagtggttggactctcaagtgacctgcagcaagtaggaggggcatcagctcacatccaggatgccctgagcatagtgttgcaatatgcagaggatatactatctgcaaaggtgtcagctgacaatacaatcaggaaggtgggccacttcctgatgagcctggttaaccaagtaccgaaaatagttcccgatgactttgagaccatgctccacagcaacatcaatgacctgttgatggtggcctacctggccaacctcacacagtcacagattgccctcaatgaaaaacgtgtaaacctgtga

SEQ ID NO: 106183 - DNA, 900 bp, Homo sapiens; identical to SEQ ID NO: 106182
  Payload ID: 839
  Gene Symbol:
  Gene Name: AL356585.3
  ENST ID: ENST00000629000
  CDS Start-End: 1-900

SEQ ID NO: 106184 - DNA, 649 bp, Homo sapiens
  Payload ID: 840
  Gene Symbol:
  Gene Name: AL357140.1
  ENST ID: ENST00000623863
  CDS Start-End: 25-408
ccaaaaggaaggaagtggacagaaatggatttgcaccattctgtccaaccagagtccttgctcctaagcacagcatcattttccttctcgttaattatcccttttaacagcaacgaaatgacctggccggcacacgagaacacagagatgaggccacaccttgtaatttctggggttctgagggggaccctggtggtggttctgggtgctgcggttctttcagtaaagaacttccaggagtttctaatcagctgctttcatcaagattctcataaccttctcctgctgccgctttcaagtgggtttgttcccgagcacattattaggaaagcggctataataactgcttacctgcctccggctccgctccacaaacacccgccaagcccacactgtgcaaaacagtagtaacacgcccgcctgagaatggctccgcggctccgcattgctgcctaagagctttcctgcatgtgatctcatttcatcctcaccgcaactccgggccggggaactcatgtccccggtgaggaagtccaggcttgagatcggcctcaacagtcggaggtggcaaagccagggcttgctcgaagccccaccttctcactgttggggagcaggctgactccaagctgtggaatcctgtgcaggg

SEQ ID NO: 106185 - DNA, 1268 bp, Homo sapiens
  Payload ID: 841
  Gene Symbol:
  Gene Name: AL358852.1
  ENST ID: ENST00000623174
  CDS Start-End: 71-619
ctggggctcttcctgcagcaccgggcgcggccaaccctcgcttccccagggcagggctcagctcgggtcaatgcaaccagccaagtcaggcccggagcgggccggctctgcccgccagtccaaacctctggaccctcgccagcggggatgggcgtgggccccggcggccaccgccccgccaactcgagcactggaggagcgcacccgctacgccagccccggacctacctggaggggagagcagagctcctggacagcggccacgggcctgagggcggacgctgaggcggccagagtccgtcccagcaaccccaagtatccctggtggggcagagcggggagacgaacgggggggctgccgcgggccagcgcggcccgtcccaggggtcgtgaggacctggctctccccttaacaccaggccaccgccgccgccgccgccattttgccttccactcagtgtcgccgccgccgcactccgctgcaggtttcccggatgtgggcatttcccggcgtcgcttgcgcgggggccgaggactgggggcttttgcccgcccggctgctgcgagggagcgcgcagcctgcggcctccgggcttcgttgcgtcgcccgcagctctgatcgttcgtgagcgtcgccccacgtcgctcccgcctgcccctgcccatacgactcgcccgcgcccgtgggttaaggctgtctcccgcccagcctacttggttgattcaatccttttccccattgatctatttctctggaccgagtagggatgtgcatttcacggagctacgttctcagaagggaacaactgagttgctctgggaaacctccctgtggacctcagaattccagatttttggcgctttgaaataaaattttattcttgcttagcgttctttccccgaacaagccggtgagcttccagcatctgtattttctgaatccggcagataagaaatgcttgagccaggaccgattgattagcagcggtttagagatcttatctgtcaaccgcatccgtagaaggagatcgttattgccataattggaataccggtgacggtgtgacaagaggttttacttctggttaagctgaatgtaaagtgtgggatgggatcgttgggtttgatgtataaggtacggtccaccctttgtgaagatcgcctttgccagtttttcctctaggaaatatacagttagtgttttcaagtaccttctttcgtaatttttctactacagagtacaaaaaaattaaagacatctttttctg

SEQ ID NO: 106186 - DNA, 2436 bp, Homo sapiens
  Payload ID: 842
  Gene Symbol:
  Gene Name: AL360294.1
  ENST ID: ENST00000624397
  CDS Start-End: 205-753
ggcgtctggacacccttcatcttttagccgttgccctgttcttggtgaactgcttgttaggaccaaaagtggcccacccctttctctgggacagtgcagagcaccggggccagaggctcaaagcacctccaagctgagatcagagactttggatatcgttgatccagaggcttccaaacttttcctggtgattgaattcttaccatgaaatccagtgaggagctccaatgcctcaagcagatggaagaggaactgctcttcttgaaggcagggcagggctctcagagggcaagactcaccccacccctgccacgggctctccagggtaactttggagccccagcactctgtggaatatggttcgcagaacacttgcatcctgctgttgggatgcccccaaactataatagcagcatgctcagtctttcaccagaaagaaccatcttatctggaggatggtcaggaaaacaaactcaacagccagtgcctcccctcagaactctgctcctgaggtctcctttcagtctgcataagtcctcccaacctgggagccccaaagcttctcagcggatccatcccctcttccattctatcccaaggtctcagctgcattctgttctgcttggtcttcctctcctcttcatacagactagaccttcaccccctgcccagtatggcgcgcaaatgccattgagatacatttgttttggtcccaatatcttttggggctccaaaaagccccagaaagagtaatgccttcagccatggcccatgtgatgacttttcccagagacagccccatgggtcagtgatcgccggtgggaggtctccccagcctcccttcaagccttcaagtctgtgtagaggcgccttctcttctctgggcattccccgctttgttgcagagaaattattttctactcagcggctttcaggtagagagagaaagtgcatgcggtatgaaggatgtgaagatggagggcttgacgtcgtgggtcatgttttgtggttaattcccccacataacaaaacagtgagcaaatgtttataaacaggaactcagtgtttcagtgatgaaagcctctggcctcgccacactgattgctggtgtgcgcgcacacacacactcacacaccctgtttttcttacacacacacagcttcatggagcagagagctggaaagggtgtccagaatggtggatcaggcttattattattactttttttatctccaccaaactctctccttaagccccagcagcccaacccccccccgcaccagacagcatatcgaaggagtaagctgcaggtcagcctatattttaggcagaaaattaggcaaccttgggagagaccggtttccagcagacacgcacggacgcgatggtgaggttgggctgagacggtccttcctggatgcagtcaccctccccatcccgagttttactccctggggggattgtggtgggtgcctggcctcctctcccaccagcgcactgccccaagcttgcctaggtagtatcagcactggggtgagggatgcaatgcgggtttatagttggctgtggggacttctgatttctccaccccatagatgataaacgaccgcggggcttcctctcccaggtctttcctcactctccttcgtctttccctctttctccatgggaaaggtagaatgagacttgccaccagggacatccaggcacattcctcttcccaatcagcctctacccattctctttctgtctcgtgtgtatcagtggcattttcttgtgtagcttcccagatttgcaaacccgctccacatcctggacgcagacccccttcgctggctctatgaaggcttcacgttcctggggcattcgagacttgactttccagagcaactttggatccaccctgttacccttttttttgttttgttttgttttgagagggagtctcgctgtgttgtccaggctggagtgcagtggtgtgatctcggcttactgcaacctccgcctactgggttcaagtgattctcttgcctcaatctccccagtacctgggattacaggtagacaccatcacgcctggctaatttttgtatttttagtaaagacagggtttcatcatgttggcctggctggtctcaaactcctgacctcaggcgatccgcccgcctcagcctcccaaagttctgggattacaagtgtgaaccaccgtgcccaacctcccctcgtttttgacctttgtccccaaatgtctttcatccagttactaggacttgtagcctttttgcaaataggtatctgtaagcatagaagaatagggtgatttgtgaagtgacccttagtggcatctgtggcggtcctactaatcagatttgcagaagaaacacggaaacaaggaaactcctctcttatattaaaataaataaggtttttaatttc

SEQ ID NO: 106187 - DNA, 2094 bp, Homo sapiens
  Payload ID: 843
  Gene Symbol:
  Gene Name: AL365181.2
  ENST ID: ENST00000624731
  CDS Start-End: 1165-1584
gctaatggttaggctaaagtagtggtcctggagaaaagtgaagagatgaggctggagatggcaggaacaggcatgcagagccatataagccagtccgataaatctggattgtgtcatcctaggtcaaacaagacccagtgacatgatgacatttatgttttagagagaacactggatgctttgtggagaagtccatcctccacaaaggttggggtggggagtgagactacaggtgttcttaggaggctgctggagaaagaaattaggcaagagatgatgatggcccgaagtggggtagtagatggtaacagagatgtagagaaatgggaaagatttgctaggtaacatgtatagcccttagcacataatgaccattacatgttagcttcctcctattggtacagtagaaagtggaggcctgaagtcctgggttccagtcctgtttgccattactagccagctgtgggctcttcagcaaaccacttttcacccttttagccacatctgcaaagcagggatggtccagataatctctcaggtctcctctggcttctaagtcctttgaattagatgtcccctggcccccccaaaatttggcagctcctgacttaagagactgtaccctacctcccacgccctattgctgctcccttaacagatggcaggatccacggaacctgaagatctcaattcctgctgagggtctgggcagtctaagtaagcaacagcaaggctggtcacaggatcccactatgttaggaaagttctgagaattgataaggcatacaaggcaactgttcaggccccagggaaaccagggaagagaaaaaggatggactctgttacccacagcctctaataccttcacaaacttctgatacagcaagttgggcttgggatgattataacgggtggtctccttagaaaggctccttatctgtactccatcctgtagagaattatcagtaccagtgaatgggtgacatatcatgactgcctacgccacaggtcccaggccctctgtttcatgtgcccatctatcaagagctcatacctgcccagtttccactaccaagttggccgcagtcttgttgaagagctcattccaccagtggtttgtgaactccttggcagggtcatgtcctacctgccaggggaataaatatgagctctgagtgcctgcctcacctgccctcaagggtcccctctcccacacatgctaaccttcctcacaaggcaccccccacacaggcctcttgccattccacacacctgacattggggtatactctgtacctctcagaagacctcctagcgcacttctttctagtaccactccatatagtcccctgcctttgtgtgagcctgaactatctcttccttcaaattcttttggtagagagcccatatctctttttccctcccctagtcctcccaaccaccacttcttcattatccactgtcaaatttcttcctttcttcccttttctgggaaagttagaaattttcttctgcaaatttccctttaaactagcttttcctcctttaattaaatggactacatgggggggtaatccaggatgatggctttcccctgggcagatggtaggcagggagctgggggatgtggaagaggccccatggggatcaccttgagtccatccatgctttagcagctgctcctcagcaaacttcatcccacgactcttgacctctggggtgacattcatggtgagaaaaaagtctctatcctcagactctcaccagagaagaagaggtgatatcatccttttaagaagaaagtagaaagtgcccaaacagccatcagttccatcctgactgcttgttaagaattctctgctagttgggtgcagtggcacacacctgtagtcccagctacatgggaggctgaggcgggattgcttgagtccagcctgggcagtatagcaagaccctctctcataaaaagaataaagcggccaggcacagtggttcacatttgtaatcccagcactttggaaggccaaggtagaagaatcacttgagcccaggagttccagaccagtgtgggcaacgtagtgaaaccctgcctct

SEQ ID NO: 106188 - DNA, 294 bp, Homo sapiens
  Payload ID: 844
  Gene Symbol:
  Gene Name: AL365202.1
  ENST ID: ENST00000624522
  CDS Start-End: 1-294
ttatttataaaaaagagtcttgctttgttgcccaggctggagtacagtggcaccatcttggctcactgcaacctctgccttctgggttcaagtaattctcatgcctcagcctcccaagtagctgggattacgggcatgtgccaccatgtctggctaatttttgtatttttagtagagacagggtttcaccatgttgcccaagctggacttgaactcctagtgtcaagcagttctcctgccttggcctcccaaagcactgagattacaggcatgagccaatgtgcctggccatta

SEQ ID NO: 106189 - DNA, 48 bp, Homo sapiens
  Payload ID: 845
  Gene Symbol:
  Gene Name: AL445183.1
  ENST ID: ENST00000623045
  CDS Start-End: 1-48
ttaggaaaaccctctgccaccagtacattctccacacaccagctacag

SEQ ID NO: 106190 - DNA, 2508 bp, Homo sapiens
  Payload ID: 846
  Gene Symbol:
  Gene Name: AL513412.1
  ENST ID: ENST00000535193
  CDS Start-End: 1-2508
atgaagcactatgggctgccctggaagaggactgaagaagcagctgcagacactgccctaaccatcatggaggtggccgaggtggaaagtcctctgaaccccagctgtaagataatgaccttcagaccctccatggaggagttccgggagttcaacaaataccttgcatacatggagtctaaaggagcccatcgtgcgggtcttgcaaaggtgattcctcctaaggagtggaagccaagacagtgctatgatgacattgataatttgctcattccagcaccaattcagcagatggtcacagggcagtcaggactgttcactcagtacaacatccagaaaaaagcgatgactgtgaaggagttcaggcagctggccaacagtggcaaatattgtactccaagatacttggattacgaagatttggagcgcaagtactggaagaacttaacttttgtggcacctatctatggtgcagatattaatgggagcatatatgatgagggtgtggatgaatggaacatagctcgcctcaatacagtcttggatgtggttgaagaagagtgtggcatttctattgagggtgtaaataccccatatctctattttggcatgtggaagaccacgtttgcatggcacaccgaagacatggacctctatagcattaattatctccactttggagagcccaagtcttggtatgctatacctccggagcatggaaaacgacttgaaagactagctcaaggttttttcccaagcagctcccaagggtgtgatgcatttcttcgccacaagatgacattgatttctccatcagtattgaagaaatatggtattccctttgacaagataacccaggaggctggagaattcatgatcactttcccatatggctaccatgctggttttaatcatggtttcaactgtgcagaatctacaaattttgctactgtcagatggattgactatggaaaagttgccaaattgtgcacttgcaggaaagacatggtgaagatttcaatggatatctttgtgaggaaatttcagccagacagatatcagctttggaaacaaggaaaggatatatacaccattgatcacacgaagcctactccagcatccacccctgaagtaaaagcatggctgcagaggaggaggaaagtaagaaaagcatcccgaagcttccagtgtgctaggtctacctctaaaaggcctaaggctgatgaggaagaggaagtgtcagatgaagtcgatggggcagaggtccctaaccccgactcagtcacagatgacctcaaggtcagtgaaaagtcagaagcagcagtgaagctgaggaacacagaagcatcttcagaagaagagtcatctgctagcaggatgcaggtggagcagaatttatcagatcatatcaaactctcaggaaacagctgcttaagtacatctgtaacagaagacataaaaactgaggatgacaaagcttatgcatatagaagtgtaccttctatatccagtgaggctgatgattccattccattgtctagtggctatgagaagcccgagaaatcagacccatccgagctttcatggccaaagtcacctgagtcatgctcatcagtggcagagagtaatggtgtgttaacagagggagaagagagtgatgtggagagccatgggaatggccttgaacctggggaaatcccagcggtccccagtggagagagaaatagcttcaaagtccccagtatagcagagggagagaacaaaacctctaagagttggcgccatccacttagcaggcctccagcaagatctccgatgactcttgtgaagcagcaggcgccaagtgatgaagaattgcctgaggttctgtccattgaggaggaagtggaagaaacagagtcttgggcgaaacctctcatccacctttggcagacgaagtcccctaacttcgcagctgagcaagagtataatgcaacagtggccaggatgaagccacactgtgccatctgcactctgctcatgccgtaccacaagccagatagcagcaatgaagaaaatgatgctagatgggagacaaaattagatgaagtcgttacatcggagggaaagactaagcccctcataccagagatgtgttttatttatagtgaagaaaatatagaatattctccacccaatgccttccttgaagaggatggaacaagtctccttatttcctgtgcaaagtgctgcgtacgggttcatgcaagttgttatggtattccttctcatgagatctgtgatggatggctgtgtgcccggtgcaaaagaaatgcgtggacagcagaatgctgtctctgcaatttgagaggaggtgctcttaagcaaacgaagaacaataagtgggcccatgtcatgtgcgccgttgcggtcccagaagttcgattcactaatgtcccagaaaggacacaaatagatgtaggcagaatacctttacagaggttaaaattgggaaggctgggaatctag

SEQ ID NO: 106191 - DNA, 1186 bp, Homo sapiens
  Payload ID: 847
  Gene Symbol:
  Gene Name: AL513523.1
  ENST ID: ENST00000599578
  CDS Start-End: 468-890
gacattctggcttgttttattgtcatttaaaaacaacttttaagacacgattatctctgccaaaaaaaaaacaaaaaaaaacaaaaaaaaaaacagactcaaggaaatgggatcatttgacaattctgtgaaacttgcctctgggactccctgggctctggtgtagattgaggtgccaacctcagaccaacctaagcctccagggcacaccacgtggggctgtggccaccctttcagactcctttctgaatgcttgtggcatctgccccatgattaggaatggacaccctgaccacgtcatagatgcccatttcacactggcatgtggatagtgactataaaacgtcccttcagaacaaaccaagacctgaaggggaagcaggaagggacacccacacactgagtctctgctctcatcctagcttatctggccagctgcccctttgtcatttcccttctctgttgaaatggctctttgggagactgggggaggagattgcggaaggggccagggggctgaggacttccactatggtctgattttacagagcctctggcttcagtcagatcccaaatatcactgggaacagcagtgtgaggggctggaggccccaggaggagggaaggggctaggggctgcatggcagcttctcaaactcagccagaggagaaagctcctccttccaccgggggagcttggggatgcagcaagggtgtttcccctgcaatctcctcagcctctattaacctttgaatcaccaagaaggagagggcagtccagccgggggtgggatggggaatgcagggcctcagtcactgtcagagcccactgcagaggacccttttcgtttccgcttggtaggcttcggtttcgtgtcttcctcttctgaagcactgctggagcccgactcttcttcggcattggggggctgtgtggcattctttcgacttcgagggctggacagagctgcttttcgccggctcttgggtggcttggtggaagagtcctcatattcctccgccagggagaagagatcactgaatttcatcttgtgggcttcgtcacagctcgcttggacatgctgcagcgcctggagaattggcgtctggctaaaaacttctgcttggtgttggtcaggttgagccgcagattgtccaagtgctccaggatctgctccagagtcag

SEQ ID NO: 106192 - DNA, 1186 bp, Homo sapiens; identical to SEQ ID NO: 106191
  Payload ID: 848
  Gene Symbol:
  Gene Name: AL513523.2
  ENST ID: ENST00000623024
  CDS Start-End: 468-890

SEQ ID NO: 106193 - DNA, 2748 bp, Homo sapiens
  Payload ID: 849
  Gene Symbol:
  Gene Name: AL589743.1
  ENST ID: ENST00000624585
  CDS Start-End: 362-994
cagcgatcagcttggctgcccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcccgggccggctcccacccgaagcccgccatcccgggacgcggtggggagaagctggcactgctccttgccatgcttggcggccgctgctgcccggctgggggtcccgagtcgcacacgccccgcaagccctggccaccgatccggagggaacgccctgggctgcggtccccgaagccaagagaagaagcaggtcccagggccgactccaaagccgcatctccagctttgttcatgggtccgggaagcagaggccgccgccggccaccgtcgtgggcgagaagaagggcacgaggcggccggggctcctgcccggaaccacatgtgcgcgccgggccccgcttcttcatcgcacttgcggccccggctgcccggggcctgcgagtttccagccagggcccgggactctggcgcggtccggccgcgaggaaggaaggcgtggcccgggtgggggtagcggcaggcctgcggctccggccacggggcaggggcagaaaaacgaccccggcgctgtccgggcatccagctcggttcccgctgcagccaggagactcccgggagcgctctaggaaccacagagccctggaactcacctggcagcctcgcggcgctaaagccggcggagcctgagacagcgcgcggcgaggcggtcacgctccacccccgcgtggcggcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacgtcccggttgctgagcggagtcaggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaggcgcgagacccggaaaacaaggaagaagcgagctcagcctcaatccccgtccccaccccactttcgggaccgctaagctggagaattgaagggggcggaccccggattaaagccgctcccttcccagcctcgccccgctttcctaatgtccgtgatgatttcgttattggcagggaagagccagactccctgcgctcccaagacggggcgattgggagggggttctggagctcatgcctggggtcggcccggcgggggtgaccccgcgccctcgccggtgcaaggagaacagctggttcccgccggggcagggaagcgtggacggtgtgggctcaggcgcctggcaggcacacggggcctctaaagcttggtcactgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcggggcgcaggaggtgggctcagggttctccagagaatccccatgagctgacccgcagggcggccgggccagtaggcaccgggcccccgcggtgacctgcggccccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttcc

SEQ ID NO: 106194 - DNA, 375 bp, Homo sapiens
  Payload ID: 850
  Gene Symbol:
  Gene Name: AL590235.1
  ENST ID: ENST00000623890
  CDS Start-End: 1-375
atgactcttaacgagcatgctgccttcaagcatctgtttaacaaagcacatcttgcaccacccttaatccattcaaccctgaggggacacagcacatgtttcagagagcacagggttgggggtaaggtcacagatcaacaggatcccaaggcagaagaatttttcttagtgcagaacaaaatgaaaagtctcccatgtctacctctttctacacagacatggcaaccatccgatttctcaatcttttccccacctttcccccctttctattccacaaaaccgccattgtcatcatggcccgttctcaatgagctgttgagtacacctcccagacggggtggtggccgggcagatgggctcctcacttcccagtag

SEQ ID NO: 106195 - DNA, 150 bp, Homo sapiens
  Payload ID: 851
  Gene Symbol:
  Gene Name: AL591806.1
  ENST ID: ENST00000624422
  CDS Start-End: 1-150
ccccttatttatttatttatttatttatttatttatttatttatagagacggaatctcaccatgttggccaggctggcctcaaactcctgacctcaagtgatccacccgccttggcctcccaaagtgctgggattacaggcgtgagccac

SEQ ID NO: 106196 - DNA, 372 bp, Homo sapiens
  Payload ID: 852
  Gene Symbol:
  Gene Name: AL592183.1
  ENST ID: ENST00000612919
  CDS Start-End: 1-372
atggctttgttggcctcaaatggctgctttattagatgcaatgaagcaggggacatagaagcaaaaagtaaaacagcaggagaagaagaaatgatcaagattagatcctgtgctgaaagagaaaccaagaaaaaagatgacattccagaagaagacaaaggaaatgtaaaacaatgtgaaatcaattatgtaaagaaatttcagagcttccaagagcacaaacttaaaataagtaaagaagacagtaaaattcttaaaaaggctcagaaagatggatttttgcaagagacgcttctggacagtttaggctatgagcatagatggaagaggtggctgttgtattggatcaaggatatgagcagagatggatga

SEQ ID NO: 106197 - DNA, 135 bp, Homo sapiens
  Payload ID: 853
  Gene Symbol:
  Gene Name: AL596220.1
  ENST ID: ENST00000623025
  CDS Start-End: 1-135
atgtgtgtatatacatatatctatctatctatctatctatctatctatctatctataatactatacacacacatattaaagaaaagaggtatttttttggttggttgctacaattttatactactaataaaataa

SEQ ID NO: 106198 - DNA, 276 bp, Homo sapiens
  Payload ID: 854
  Gene Symbol:
  Gene Name: AL645728.1
  ENST ID: ENST00000624594
  CDS Start-End: 1-276
ggtgtgatctcggctcactgcaacctccacctcccaggttcaagcgattctcctgcctcagcctctcgagtggctggaattacaggcacacaccaccacgcctggctaatttttgtatttttagtagagacggggtttcaccatgttggccaggatgggctcgatctcttgacttctgatccacccacctcagcctcccacagtgctgggattacagacgtgagccaccatgcctggccatggatattaattttttttttttttgagatggagtct

SEQ ID NO: 106199 - DNA, 69 bp, Homo sapiens
  Payload ID: 855
  Gene Symbol:
  Gene Name: AL645922.1
  ENST ID: ENST00000623068
  CDS Start-End: 1-69
cccaccttgtgctgcctcagctgcttctcctcgttgtggccgaggtgggaggatcacttgagaccagga

SEQ ID NO: 106200 - DNA, 414 bp, Homo sapiens
  Payload ID: 856
  Gene Symbol:
  Gene Name: AL662852.1
  ENST ID: ENST00000616686
  CDS Start-End: 1-414
atggagggtgcacttgctgatatgaagttttattttatacaaatcctggagaagctaagtgaggccatgtcagtgttgccagaagacatgagaatcatgccagatctctgtggcttaacattggaacatagtgttctggaggctgggaagttcaagatcaaggtaccagcaaatttcattacctggtgccccataatggcacacagctttactcagcaacccctgccagcttccaagccccaggatactgacctgcaccagcacatggggcagcattacctccccaacagtgtggagaagagaacatttcaccactgggtgatgagagtagacagtgactcttggcttctcaatgctagacatgattggagacctttcattgttctattagaaaagtccatgaagaagctgtga

SEQ ID NO: 106201 - DNA, 414 bp, Homo sapiens; identical to SEQ ID NO: 106200
  Payload ID: 857
  Gene Symbol:
  Gene Name: AL929561.1
  ENST ID: ENST00000622022
  CDS Start-End: 1-414

SEQ ID NO: 106202 - DNA, 2299 bp, Homo sapiens
  Payload ID: 858
  Gene Symbol: AARD
  Gene Name: alanine and arginine rich domain containing protein
  Uniprot ID: Q4LEZ3
  ENST ID: ENST00000378279
  CDS Start-End: 46-513
catctttcagcagcagcggtagagcagtgaccaggcgtctccgcgatgggccccggggacttccgccgctgcagagagagaatttcccaggggctccagggactcccaggtagagcggagctttggttcccacctcgtcccgcgtgcgacttcttcggggacggcaggagcacggacatccaggaggaggccctcgccgccagcccgctgctggaggacctcagacgacggctgacgcgcgccttccagtgggcggtgcagcgcgcgatctcgaggcgcgtgcaggaggcggcggcggcggcggcggcgcgggaggagcagagctggacgggcgttgaggccaccctggccaggctgcgggcggagctggtggaaatgcatttccaaaaccaccagctggctagaactttactggacctaaacatgaaagtgcagcaattgaaaaaggagtatgaactggaaattacatcagactcccaaagcccaaaagatgatgctgcgaatccggaataaagaaatgcacacgcaagggctgggcgcggtggctcacgcctgtaatcccagcactttgggaggccgaggcgggcggatcaagacgtcaggagattgagaccatcctggctaacactgtgaaaccctgcctctactaaaaatacaaaaaattagccagacgtggtggcaggcacctgtagtccctgctactcaggagtctgaggcaggagaatggcgtgaacccaggagacagagcttgcagtgagccgaaatcctgccactgcactccagcctgggtgacagagcaagactccatctcaaaaaaaaaaaaaaaaaaaaaagcacacgcgaagctctggatcctaaaactaacgcatacaaccctgaaacaattctgatgaacacattatgctttgcataagttttgaggggcaatttatagacccaaaacaaatgacaggggaaggtgacagaaaaacatctaagagaggggagagaaaaatgatgtattaccaagttttaaagttatttatttgttatttttactgggacatagaagtaaaatataactatagataaatctctctctgtctctctcactcaaagaatgctttaatgccaactttcggtattcaaccttgtgtcacctgacctttctggcattgcctgagctttcagagtttgtgcttgttttgttttacttgattattctcagtttgtctgtccagcagcctgccctgcttcttgtggagaattgtttctacttggattctaaccatgccctttaggtggtctgtgactaagggtattccatcttcctggatatagtcatgcagctcaaggcaggcagatgggtttgtccttaggatttttgaatgggcactaaaagagtagatgactatttctgccagtagaagctgtggatcaggggcttggaagctgctggtggtcaccatgtgagaaagcccacaccctaatggaggtgactgaaacggaaccactaaaagcacaaaaggggagggagggagggagggtgcttcgcttccttgttcctggggtcaagctgtataagactccaggccttgctcttgtttatgtacatgaaatattctgatatccttctcataaaatctctttttgcctaagtaaattcaagctggagtttcatgacttgtatctagtgttcataactaatacagttgttcagttttaggagttaaaatggttcttactgttgaattggactatctaactgtacccgaaaagtgctgtctttttaatgcaaacagtaaagttaataaaaaatagttgcagatctaagtgatatttataatggttattgtctgcaaaatacaaattaatttataacaagctatgtaattttaatatttaataaactataaaaatcagttcttgaagacaaaggagaacagaagagacacagtctttctcttgttaaaagaaatacaaggacaagcatggtggatcacgcttgtaattccagcactttgggaggctgaggtgggcagattgtttgagctcaggagtttgagaccagcctggtcaacatggcaaaaccccatctctactaaaaatacaaaaattagccaggcgtggtggtgctcgcctatagtaccagctactcaggaggctgaggcataagaatcacttgaacctgggagatggaggttgcagtgagccgagatcatgcccctgcactccagcctgggtgacagagggggacttggcctcgaaaaaataaataaataataaaaataaaataaatgcaagttgttttatgtgtgtg

SEQ ID NO: 106203 - DNA, 1865 bp, Homo sapiens
  Payload ID: 859
  Gene Symbol: AGXT
  Gene Name: alanine-glyoxylate aminotransferase
  Uniprot ID: P21549
  ENST ID: ENST00000307503
  CDS Start-End: 388-1566
gcctgccaagcctcaattatctgtgctccgaccctttaagaaacacttctctcacccctgagctaagcagaataagaggggctggacgtgcaggactcagagtgggagcgaggagggctggggtgaggacagctttgtcacactctgtttttctgtcactcagccctgggggctccctctgcctgagggcttcgtcccctgctgcctggccgtgacccgcagcacaagcacagataagcctcagggaacaaaaggcagggctgccacggaagcccatccaccaatcctcacctctcacctctgtgtccgccctgctgggaaatattccaggctttggccaaggccagtgcagccccaggttcccgagcggcaggttgggtgcggaccatggcctctcacaagctgctggtgaccccccccaaggccctgctcaagcccctctccatccccaaccagctcctgctggggcctggtccttccaacctgcctcctcgcatcatggcagccggggggctgcagatgatcgggtccatgagcaaggatatgtaccagatcatggacgagatcaaggaaggcatccagtacgtgttccagaccaggaacccactcacactggtcatctctggctcgggacactgtgccctggaggccgccctggtcaatgtgctggagcctggggactccttcctggttggggccaatggcatttgggggcagcgagccgtggacatcggggagcgcataggagcccgagtgcacccgatgaccaaggaccctggaggccactacacactgcaggaggtggaggagggcctggcccagcacaagccagtgctgctgttcttaacccacggggagtcgtccaccggcgtgctgcagccccttgatggcttcggggaactctgccacaggtacaagtgcctgctcctggtggattcggtggcatccctgggcgggacccccctttacatggaccggcaaggcatcgacatcctgtactcgggctcccagaaggccctgaacgcccctccagggacctcgctcatctccttcagtgacaaggccaaaaagaagatgtactcccgcaagacgaagcccttctccttctacctggacatcaagtggctggccaacttctggggctgtgacgaccagcccaggatgtaccatcacacaatccccgtcatcagcctgtacagcctgagagagagcctggccctcattgcggaacagggcctggagaacagctggcgccagcaccgcgaggccgcggcgtatctgcatgggcgcctgcaggcactggggctgcagctcttcgtgaaggacccggcgctccggcttcccacagtcaccactgtggctgtacccgctggctatgactggagagacatcgtcagctacgtcatagaccacttcgacattgagatcatgggtggccttgggccctccacggggaaggtgctgcggatcggcctgctgggctgcaatgccacccgcgagaatgtggaccgcgtgacggaggccctgagggcggccctgcagcactgccccaagaagaagctgtgacctgcccactggcacacagctggcactggcacacacctgtcccatgcccaccctgagggatcaggagcaaacagaccctgcaaggtcctccaggcctggggacaggaaagccactgacccagcccgggaggcagaaccaggcagcctccctggccccaggcagcccttttccctccagtggcacctcctggaaacagtccacttgggcgcaaaacccagtgccttccaaatgagctgcagtccccaggccatgagcctcccgggaatgtttaataaagggcctggccaactctcctcac

SEQ ID NO: 106204 - DNA, 2364 bp, Homo sapiens
  Payload ID: 860
  Gene Symbol: AGXT2
  Gene Name: alanine--glyoxylate aminotransferase 2
  Uniprot ID: Q9BYV1
  ENST ID: ENST00000231420
  CDS Start-End: 202-1746
ctctttttctcccccttgaaggcactgttactagaaatagagagctctggggcttgcctgaagccatgggcagtcaccactccaggattccccttttagcgcctcctccccatcttaatctcaaagtccagcaggatagtgagcagttagagcccggcctccaatctgcttccatgggggttggctttctgagtgggagaaatgactctaatctggagacatttgctgagacccttgtgcctggtcacttccgctcccaggatccttgagatgcatcctttcctgagcctaggtacttcccggacatcagtaaccaagctcagtcttcatacaaagcccagaatgcctccatgtgacttcatgcctgaaagataccagtcccttggctacaaccgtgtcctggaaatccacaaggaacatctttctcctgtggtgacggcatatttccagaaacccctgctgctccaccaggggcacatggagtggctctttgatgctgaaggaagcagatacctggatttcttttccgggattgttactgtcagtgttggccattgccacccaaaggtgaatgcagtggcacaaaagcagctcggccgcctgtggcatacaagcaccgtcttcttccaccctccaatgcatgaatatgcagagaagcttgccgcacttcttcctgagcctcttaaggtcattttcttggtgaacagtggctcagaagccaatgagctggccatgctgatggccagggcgcactcaaacaacatagacatcatttctttcagaggagcctaccatggatgcagtccttacacacttggcttgacaaacgtagggacctacaagatggaactccctggtgggacaggttgccaaccaacaatgtgtccagatgtttttcgtggcccttggggaggaagccactgtcgagattctccagtgcaaacaatcaggaagtgcagctgtgcaccagactgctgccaagctaaagatcagtatattgagcaattcaaagatacgctgagcacatctgtggccaagtcaattgctggatttttcgcagaacctattcaaggtgtgaatggagttgtccagtacccaaaggggtttctaaaggaagcctttgagctggtgcgagcaaggggaggcgtgtgcattgcagatgaagtgcagacaggatttggaaggttgggctctcacttctggggcttccaaacccacgatgtcctgcctgacattgtcaccatggctaaagggattgggaatggctttcccatggcagcagtcataaccactccagagattgccaaatctttggcgaaatgcctgcagcacttcaacacctttggagggaaccccatggcctgtgccattggatctgctgtgcttgaggtgattaaagaagaaaatctacaggaaaacagtcaagaagttgggacctacatgttactaaagtttgctaagctgcgggatgaatttgaaattgttggagacgtccgaggcaaaggtctcatgataggcatagaaatggtgcaggataagataagctgtcggcctcttccccgtgaagaagtaaatcagatccatgaggactgcaagcacatgggactcctcgttggcagaggcagcattttttctcagacatttcgcattgcgccctcaatgtgcatcactaaaccagaagttgattttgcagtagaagtatttcgttctgccttaacccaacacatggaaagaagagctaagtaacattgtcagaaataaataaaaccacaagtctcaagaatttgccacgtatgttcaagggtgaatttgaagaatttcagaaccactggtatccagagaaagcctgcagctctccacaggagctgtaaaagtcatggttgactgcctaccaaccatatttgttagcagagcccctcttatcttgagaactccattcttcagggaaaggatctccctagctcagagaataaatcctaattagtttatgttaggtatggtaatttgattcccctttgcagtgattggtttatgcatgaatatgtgatgtatttttgtccagtgaatcttgaagaaaaatcttttggtggaggtgccttcagggaaagttttcttcaccctcactcttcagttcaagaagagatgtcttcttgttgcgctgagaacaccatatgttcatgacgagattcctggcaccatgtcagccggcttgtagtcatgaggacaaccctttttggtgaggttggaagatggatggaagccaagtgcttagtgatgtcaaagaagcactcacttaagcattcctggagccaccctacctcagggcctcttgatatttgaggtaataaattcattgttctgtat

SEQ ID NO: 106205 - DNA, 1561 bp, Homo sapiens
  Payload ID: 860
  Gene Symbol: AGXT2
  Gene Name: alanine--glyoxylate aminotransferase 2
  Uniprot ID: Q9BYV1
  ENST ID: ENST00000510428
  CDS Start-End: 44-1363
ctccaatctgcttccatgggggttggctttctgagtgggagaaatgactctaatctggagacatttgctgagacccttgtgcctggtcacttccgctcccaggatccttgagatgcatcctttcctgagcctaggtacttcccggacatcagtaaccaagctcagtcttcatacaaagcccagaatgcctccatgtgacttcatgcctgaaagataccagtcccttggctacaaccgtgtcctggaaatccacaaggaacatctttctcctgtggtgacggcatatttccagaaacccctgctgctccaccaggggcacatggagtggctctttgatgctgaaggaagcagatacctggatttcttttccgggattgttactgtcagtgttggccattgccacccaaaggtgaatgcagtggcacaaaagcagctcggccgcctgtggcatacaagcaccgtcttcttccaccctccaatgcatgaatatgcagagaagcttgccgcacttcttcctgagcctcttaaggtcattttcttggtgaacagtggctcagaagccaatgagctggccatgctgatggccagggcgcactcaaacaacatagacatcatttctttcagaggagcctaccatggatgcagtccttacacacttggcttgacaaacgtagggacctacaagatggaactccctggtgggacaggttgccaaccaacaatgtgtccagatgtttttcgtggcccttggggaggaagccactgtcgagattctccagtgcaaacaatcaggaagtgcagctgtgcaccagactgctgccaagctaaagatcagtatattgagcaattcaaagatacgctgagcacatctgtggccaagtcaattgctggatttttcgcagaacctattcaaggtgtgaatggagttgtccagtacccaaaggggtttctaaaggaagcctttgagctggtgcgagcaaggggaggcgtgtgcattgcagatgaagtgattaaagaagaaaatctacaggaaaacagtcaagaagttgggacctacatgttactaaagtttgctaagctgcgggatgaatttgaaattgttggagacgtccgaggcaaaggtctcatgataggcatagaaatggtgcaggataagataagctgtcggcctcttccccgtgaagaagtaaatcagatccatgaggactgcaagcacatgggactcctcgttggcagaggcagcattttttctcagacatttcgcattgcgccctcaatgtgcatcactaaaccagaagttgattttgcagtagaagtatttcgttctgccttaacccaacacatggaaagaagagctaagtaacattgtcagaaataaataaaaccacaagtctcaagaatttgccactgaatcttgaagaaaaatcttttggtggaggtgccttcagggaaagttttcttcaccctcactcttcagttcaagaagagatgtcttcttgttgcgctgagaacaccatatgttcatgacgagattcctggcaccatgtcagccggcttgtag

SEQ ID NO: 106206 - DNA, 2181 bp, Homo sapiens
  Payload ID: 860
  Gene Symbol: AGXT2
  Gene Name: alanine--glyoxylate aminotransferase 2
  Uniprot ID: Q9BYV1
  ENST ID: ENST00000618015
  CDS Start-End: 244-1563
ctctctctccttcctattttcattctatctcttttcctcactctctttttctcccccttgaaggcactgttactagaaatagagagctctggggcttgcctgaagccatgggcagtcaccactccaggattccccttttagcgcctcctccccatcttaatctcaaagtccagcaggatagtgagcagttagagcccggcctccaatctgcttccatgggggttggctttctgagtgggagaaatgactctaatctggagacatttgctgagacccttgtgcctggtcacttccgctcccaggatccttgagatgcatcctttcctgagcctaggtacttcccggacatcagtaaccaagctcagtcttcatacaaagcccagaatgcctccatgtgacttcatgcctgaaagataccagtcccttggctacaaccgtgtcctggaaatccacaaggaacatctttctcctgtggtgacggcatatttccagaaacccctgctgctccaccaggggcacatggagtggctctttgatgctgaaggaagcagatacctggatttcttttccgggattgttactgtcagtgttggccattgccacccaaaggtgaatgcagtggcacaaaagcagctcggccgcctgtggcatacaagcaccgtcttcttccaccctccaatgcatgaatatgcagagaagcttgccgcacttcttcctgagcctcttaaggtcattttcttggtgaacagtggctcagaagccaatgagctggccatgctgatggccagggcgcactcaaacaacatagacatcatttctttcagaggagcctaccatggatgcagtccttacacacttggcttgacaaacgtagggacctacaagatggaactccctggtgggacaggttgccaaccaacaatgtgtccagatgtttttcgtggcccttggggaggaagccactgtcgagattctccagtgcaaacaatcaggaagtgcagctgtgcaccagactgctgccaagctaaagatcagtatattgagcaattcaaagatacgctgagcacatctgtggccaagtcaattgctggatttttcgcagaacctattcaaggtgtgaatggagttgtccagtacccaaaggggtttctaaaggaagcctttgagctggtgcgagcaaggggaggcgtgtgcattgcagatgaagtgattaaagaagaaaatctacaggaaaacagtcaagaagttgggacctacatgttactaaagtttgctaagctgcgggatgaatttgaaattgttggagacgtccgaggcaaaggtctcatgataggcatagaaatggtgcaggataagataagctgtcggcctcttccccgtgaagaagtaaatcagatccatgaggactgcaagcacatgggactcctcgttggcagaggcagcattttttctcagacatttcgcattgcgccctcaatgtgcatcactaaaccagaagttgattttgcagtagaagtatttcgttctgccttaacccaacacatggaaagaagagctaagtaacattgtcagaaataaataaaaccacaagtctcaagaatttgccacgtatgttcaagggtgaatttgaagaatttcagaaccactggtatccagagaaagcctgcagctctccacaggagctgtaaaagtcatggttgactgcctaccaaccatatttgttagcagagcccctcttatcttgagaactccattcttcagggaaaggatctccctagctcagagaataaatcctaattagtttatgttaggtatggtaatttgattcccctttgcagtgattggtttatgcatgaatatgtgatgtatttttgtccagtgaatcttgaagaaaaatcttttggtggaggtgccttcagggaaagttttcttcaccctcactcttcagttcaagaagagatgtcttcttgttgcgctgagaacaccatatgttcatgacgagattcctggcaccatgtcagccggcttgtagtcatgaggacaaccctttttggtgaggttggaagatggatggaagccaagtgcttagtgatgtcaaagaagcactcacttaagcattcctggagccaccctacctcagggcctcttgatatttgaggtaataaattcattgttctgtat

SEQ ID NO: 106207 - DNA, 3678 bp, Homo sapiens
  Payload ID: 861
  Gene Symbol: ANPEP
  Gene Name: alanyl (membrane) aminopeptidase
  Uniprot ID: P15144
  ENST ID: ENST00000300060
  CDS Start-End: 315-3218
ggagtccagtgctggaggggcagggacggcggcggcgcagctcggaacccgccagggtccagggtccaggttccagcgcccggcggcccaggcaccccccgagcccagctccacacaccgttcctggatctcctctccccaggcggagcgtgcccctgcccagtccagtgaccttcgcctgttggagccctggttaatttttgcccagtctgcctgttgtggggctcctcccctttggggatataagcccggcctggggctgctccgttctctgcctggcctgaggctccctgagccgcctccccaccatcaccatggccaagggcttctatatttccaagtccctgggcatcctggggatcctcctgggcgtggcagccgtgtgcacaatcatcgcactgtcagtggtgtactcccaggagaagaacaagaacgccaacagctcccccgtggcctccaccaccccgtccgcctcagccaccaccaaccccgcctcggccaccaccttggaccaaagtaaagcgtggaatcgttaccgcctccccaacacgctgaaacccgattcctaccgggtgacgctgagaccgtacctcacccccaatgacaggggcctgtacgtttttaagggctccagcaccgtccgtttcacctgcaaggaggccactgacgtcatcatcatccacagcaagaagctcaactacaccctcagccaggggcacagggtggtcctgcgtggtgtgggaggctcccagccccccgacattgacaagactgagctggtggagcccaccgagtacctggtggtgcacctcaagggctccctggtgaaggacagccagtatgagatggacagcgagttcgagggggagttggcagatgacctggcgggcttctaccgcagcgagtacatggagggcaatgtcagaaaggtggtggccactacacagatgcaggctgcagatgcccggaagtccttcccatgcttcgatgagccggccatgaaggccgagttcaacatcacgcttatccaccccaaggacctgacagccctgtccaacatgcttcccaaaggtcccagcaccccacttccagaagaccccaactggaatgtcactgagttccacaccacgcccaagatgtccacgtacttgctggccttcattgtcagtgagttcgactacgtggagaagcaggcatccaatggtgtcttgatccggatctgggcccggcccagtgccattgcggcgggccacggcgattatgccctgaacgtgacgggccccatccttaacttctttgctggtcattatgacacaccctacccactcccaaaatcagaccagattggcctgccagacttcaacgccggcgccatggagaactggggactggtgacctaccgggagaactccctgctgttcgaccccctgtcctcctccagcagcaacaaggagcgggtggtcactgtgattgctcatgagctggcccaccagtggttcgggaacctggtgaccatagagtggtggaatgacctgtggctgaacgagggcttcgcctcctacgtggagtacctgggtgctgactatgcggagcccacctggaacttgaaagacctcatggtgctgaatgatgtgtaccgcgtgatggcagtggatgcactggcctcctcccacccgctgtccacacccgcctcggagatcaacacgccggcccagatcagtgagctgtttgacgccatctcctacagcaagggcgcctcagtcctcaggatgctctccagcttcctgtccgaggacgtattcaagcagggcctggcgtcctacctccacacctttgcctaccagaacaccatctacctgaacctgtgggaccacctgcaggaggctgtgaacaaccggtccatccaactccccaccaccgtgcgggacatcatgaaccgctggaccctgcagatgggcttcccggtcatcacggtggataccagcacggggaccctttcccaggagcacttcctccttgaccccgattccaatgttacccgcccctcagaattcaactacgtgtggattgtgcccatcacatccatcagagatggcagacagcagcaggactactggctgatagatgtaagagcccagaacgatctcttcagcacatcaggcaatgagtgggtcctgctgaacctcaatgtgacgggctattaccgggtgaactacgacgaagagaactggaggaagattcagactcagctgcagagagaccactcggccatccctgtcatcaatcgggcacagatcattaatgacgccttcaacctggccagtgcccataaggtccctgtcactctggcgctgaacaacaccctcttcctgattgaagagagacagtacatgccctgggaggccgccctgagcagcctgagctacttcaagctcatgtttgaccgctccgaggtctatggccccatgaagaactacctgaagaagcaggtcacacccctcttcattcacttcagaaataataccaacaactggagggagatcccagaaaacctgatggaccagtacagcgaggttaatgccatcagcaccgcctgctccaacggagttccagagtgtgaggagatggtctctggccttttcaagcagtggatggagaaccccaataataacccgatccaccccaacctgcggtccaccgtctactgcaacgctatcgcccagggcggggaggaggagtgggacttcgcctgggagcagttccgaaatgccacactggtcaatgaggctgacaagctccgggcagccctggcctgcagcaaagagttgtggatcctgaacaggtacctgagctacaccctgaacccggacttaatccggaagcaggacgccacctctaccatcatcagcattaccaacaacgtcattgggcaaggtctggtctgggactttgtccagagcaactggaagaagctttttaacgattatggtggtggctcgttctccttctccaacctcatccaggcagtgacacgacgattctccaccgagtatgagctgcagcagctggagcagttcaagaaggacaacgaggaaacaggcttcggctcaggcacccgggccctggagcaagccctggagaagacgaaagccaacatcaagtgggtgaaggagaacaaggaggtggtgctccagtggttcacagaaaacagcaaatagtccccagcccttgaagtcacccggcccccatgcaaggtgcccacatgtgtccatcccagcggctggtgcagggcctccattcctggagcccgaggcaccagtgtcctcccctcaaggacaaagtctccagcccacgttctctctgcctgtgagccagtctagttcctgatgacccaggctgcctgagcacctcccagcccctgcccctcatgccaaccccgccctaggcctggcatggcacctgtcgcccagtgccctggggctgatctcagggaagcccagctccagggccagatgagcagaagctctcgatggacaatgaacggccttgctgggggccgccctgtaccctctttcacctttccctaaagaccctaaatctgaggaatcaacagggcagcagatctgtatatttttttctaagagaaaatgtaaataaaggatttctagatgagtgaga

SEQ ID NO: 106208 - DNA, 663 bp, Homo sapiens
  Payload ID: 861
  Gene Symbol: ANPEP
  Gene Name: alanyl (membrane) aminopeptidase
  ENST ID: ENST00000559874
  CDS Start-End: 353-663
gagcgacagagcgagactctgtctcaaaaacaaataaaggaaaaagaaaaaaatgagaagcgcgtgttcccgactccggtgctttttcgcaaggtcgtgctactgcgccttctgaactacgagtcccaggcaccccccgagcccagctccacacaccgttcctggatctcctctccccaggcggagcgtgcccctgcccagtccagtgaccttcgcctgttggagccctggttaatttttgcccagtctgcctgttgtggggctcctcccctttggggatataagcccggcctggggctgctccgttctctgcctggcctgaggctccctgagccgcctccccaccatcaccatggccaagggcttctatatttccaagtccctgggcatcctggggatcctcctgggcgtggcagccgtgtgcacaatcatcgcactgtcagtggtgtactcccaggagaagaacaagaacgccaacagctcccccgtggcctccaccaccccgtccgcctcagccaccaccaaccccgcctcggccaccaccttggaccaaagtaaagcgtggaatcgttaccgcctccccaacacgctgaaacccgattcctaccgggtgacgctgagaccgtacctcacccccaatgacaggggcctgtacgtttttaa

SEQ ID NO: 106209 - DNA, 582 bp, Homo sapiens
  Payload ID: 861
  Gene Symbol: ANPEP
  Gene Name: alanyl (membrane) aminopeptidase
  ENST ID: ENST00000560028
  CDS Start-End: 1-198
acgcttatccaccccaaggacctgacagccctgtccaacatgcttcccaaaggtcccagcaccccacttccagaagaccccaactggaatgtcactgagttccacaccacgcccaagatgtccacgtacttgctggccttcattgtcagtgagttcgactacgtggagaagcaggcatccaatggtgtcttggtatgaggctgggcccatctctccttcacgtgggctggccccggcttgaggggtcttcccgttctcttcatccctgtgccagtttctgaattgttaggccagggttggaatcccacctctgagtgatttcagatccggatctgggcccggcccagtgccattgcggcgggccacggcgattatgccctgaacgtgacgggccccatccttaacttctttgctggtcattatgacacaccctacccactcccaaaatcagaccagattggcctgccagacttcaacgccggcgccatggagaactggggactggtgacctaccgggagaactccctgctgttcgaccccctgtcctcctccagcagcaacaaggagcgggtggtcactgtg

SEQ ID NO: 106210 - DNA, 638 bp, Homo sapiens
  Payload ID: 861
  Gene Symbol: ANPEP
  Gene Name: alanyl (membrane) aminopeptidase
  ENST ID: ENST00000560137
  CDS Start-End: 456-638
gaggagtccagtgctggaggggcagggacggcggcggcgcagctcggaacccgccagggtccagggtccaggttccagcgcccggcggcccagctctcaagcagatcaatgcaatgccacctggccgcttgctttgcccactgggcctacagccggaagcctgcccttcagccctcgggcctgatcccaggccgcctgcagcctgtaaccagacactgtttgcttccagcaggcaccccccgagcccagctccacacaccgttcctggatctcctctccccaggcggagcgtgcccctgcccagtccagtgaccttcgcctgttggagccctggttaatttttgcccagtctgcctgttgtggggctcctcccctttggggatataagcccggcctggggctgctccgttctctgcctggcctgaggctccctgagccgcctccccaccatcaccatggccaagggcttctatatttccaagtccctgggcatcctggggatcctcctgggcgtggcagccgtgtgcacaatcatcgcactgtcagtggtgtactcccaggagaagaacaagaacgccaacagctcccccgtggcctccaccaccccgtccgcctcagccaccaccaaccccgcctcg

SEQ ID NO: 106211 - DNA, 896 bp, Homo sapiens
  Payload ID: 861
  Gene Symbol: ANPEP
  Gene Name: alanyl (membrane) aminopeptidase
  ENST ID: ENST00000560030
  CDS Start-End: 1-369
aatgacctgtggctgaacgagggcttcgcctcctacgtggagtacctgggtgctgactatgcggagcccacctggaacttgaaagacctcatggtgctgaatgatgtgtaccgcgtgatggcagtggatgcactggcctcctcccacccgctgtccacacccgcctcggagatcaacacgccggcccagatcagtgagctgtttgacgccatctcctacagcaaggtgcagcccgctcctcgtggggcacggggaaggagggcgcctcagtcctcaggatgctctccagcttcctgtccgaggacgtattcaagcagggcctggcgtcctacctccacacctttgcctaccagaacaccatctacctgaacctgtgggaccacctgcaggaggctgtgaacaaccggtccatccaactccccaccaccgtgcgggacatcatgaaccgctggaccctgcagatgggcttcccggtcatcacggtggataccagcacggggaccctttcccaggagcacttcctccttgaccccgattccaatgttacccgcccctcagaattcaactacgtgtggattgtgcccatcacatccatcagagatggcagacagcagcaggactactggctgatagatgtaagagcccagaacgatctcttcagcacatcaggcaatgagtgggtcctgctgaacctcaatgtgacgggctattaccgggtgaactacgacgaagagaactggaggaagattcagactcagctgcagagagaccactcggccatccctgtcatcaatcgggcacagatcattaatgacgccttcaacctggccagtgcccataaggtccctgtcactctggcgctgaacaacaccctcttcctgattgaagagagacag

SEQ ID NO: 106212 - DNA, 3477 bp, Homo sapiens
  Payload ID: 862
  Gene Symbol: AARS
  Gene Name: alanyl-tRNA synthetase
  Uniprot ID: P49588
  ENST ID: ENST00000261772
  CDS Start-End: 145-3051
cgtggcgggttgtggtaggtcgtggtctgaggccggtacagctgcgcgtctgcgggaataggtgcagcgggcccttggcgggggactctgagggaggagctggggacggcgaccctaggagagttctttggggtgactttcaagatggactctactctaacagcaagtgaaatccggcagcgatttatagatttcttcaagaggaacgagcatacgtatgttcactcgtctgccaccatcccattggatgaccccactttgctctttgccaatgcaggcatgaaccagtttaaacccattttcctgaacacaattgacccatctcaccccatggcaaagctgagcagagctgccaatacccagaagtgcatccgggctgggggcaaacataatgacctggacgatgtgggcaaggatgtctatcatcacaccttcttcgagatgctgggctcttggtcttttggagattactttaaggaattggcatgtaagatggctctggaactcctcacccaagagtttggcattcccattgaaagactttatgttacttactttggcggggatgaagcagctggcttagaagcagatctggaatgcaaacagatctggcaaaatttggggctggatgacaccaaaatcctcccaggcaacatgaaggataacttctgggagatgggtgacacgggcccctgtggtccttgcagtgagatccactacgaccggattggtggtcgggacgccgcacatcttgtcaaccaggacgaccctaatgtgctggagatctggaaccttgtgttcatccagtataacagggaagctgatggcattctgaaacctcttcccaagaaaagcattgacacagggatgggcctggaacgactggtatctgtgctgcagaataagatgtccaactatgacactgacctttttgtcccttactttgaagccattcagaagggcacaggtgcccgaccatacactgggaaagttggtgctgaggatgccgatgggattgacatggcctaccgggtgctggctgaccacgctcggaccatcactgtggcactggctgatggtggccggcctgacaacacagggcgtggatatgtgttgagacggattctccgccgagctgtccgatacgcccatgaaaagctcaatgccagcaggggcttctttgctacgttagtggatgttgtcgtccagtccctgggagatgcatttcctgagctgaagaaggacccagacatggtgaaggacatcattaatgaagaagaggtgcagtttctcaagactctcagcagagggcgtcgcatcctggacaggaaaattcagagcctgggagacagcaagaccattcccggagacactgcttggctcctctatgacacctatgggtttccagtggatctgactggactgattgctgaagagaagggcctggtggtagacatggatggctttgaagaggagaggaaactggcccagctgaaatcacagggcaagggagctggtggggaagacctcattatgctggacatttacgctatcgaagagctccgggcacggggtctggaggtcacagatgattccccaaagtacaattaccatttggactccagtggtagctatgtatttgagaacacagtggctacggtgatggctctgcgcagggagaagatgttcgtggaagaggtgtccacaggccaggagtgtggagtggtgctggacaagacctgtttctatgctgagcaaggaggccagatctatgacgaaggctacctggtgaaggtggatgacagcagtgaagataaaacagagtttacagtgaagaatgctcaggtccgaggagggtatgtgctacacattggaaccatctacggtgacctgaaagtgggggatcaggtctggctgtttattgatgagccccgacgaagacccatcatgagcaaccacacagctacgcacattctgaacttcgccctgcgctcagtgcttggggaagctgaccagaaaggctcattggttgctcctgaccgcctcagatttgactttactgccaagggagccatgtccacccaacagatcaagaaggctgaagagattgctaatgagatgattgaggcagccaaggccgtctatacccaggattgccccctggcagcagcgaaagccatccagggcctacgggctgtgtttgatgagacctatcctgaccctgtgcgagtcgtctccattggggtcccggtgtccgagttgctggatgacccctctgggcctgctggctccctgacttctgttgagttctgtgggggaacgcacctgcggaactcgagtcatgcaggagcttttgtgatcgtgacggaagaagccattgccaagggtatccggaggattgtggctgtcacaggtgccgaggcccagaaggccctcaggaaagcagagagcttgaagaaatgtctctctgtcatggaagccaaagtgaaggctcagactgctccaaacaaggatgtgcagagggagatcgctgaccttggagaggccctggccactgcagtcatcccccagtggcagaaggatgaattgcgggagactctcaaatccctaaagaaggtcatggatgacttggaccgagccagcaaagccgatgtccagaaacgagtgttagagaagacgaagcagttcatcgacagcaaccccaaccagcctcttgtcatcctggagatggagagcggcgcctcagccaaggccctgaatgaagccttgaagctcttcaagatgcactcccctcagacttctgccatgctcttcacggtggacaatgaggctggcaagatcacgtgcctgtgtcaagttccccagaatgcagccaatcggggcttaaaagccagcgagtgggtgcagcaggtgtcaggcttgatggacggtaaaggtggtggcaaggatgtgtctgcacaggccacaggcaagaacgttggctgcctgcaggaggcgctgcagctggccacttccttcgcccagctgcgcctcggggatgtaaagaactgagtggggaaggaggaggctcccactggatccatccgtccagccaagagctcttcatctgctacaagaacatttgaatcttgggacctttaaagagcccctcctaacccagcagtaactggaacacacttgggagcagtcctatgtctcagtgccccttaaatttctgccctgagccctccacgtcagtgccatcggtctagaaccactaaccccgcattgctgttgatcgtcacgctcgcatctatagataacggctctccagacctgagctttccgcgtcagcaagtaggaatcgtttttgctgcagagaataaaaggaccacgtgcaatacttaatgccgcatgatctctatccctcttcccaataggggctggctcttttgacagcctttggcgtctgtagaataaatgctgtggctcctgctg

SEQ ID NO: 106213 - DNA, 839 bp, Homo sapiens
  Payload ID: 862
  Gene Symbol: AARS
  Gene Name: alanyl-tRNA synthetase
  ENST ID: ENST00000565361
  CDS Start-End: 1-839
tgacagcagtgaagataaaacagagtttacagtgaagaatgctcaggtccgaggagggtatgtgctacacattggaaccatctacggtgacctgaaagtgggggatcaggtctggctgtttattgatgagccccgacgaagacccatcatgagcaaccacacagctacgcacattctgaacttcgccctgcgctcagtgcttggggaagctgaccagaaaggctcattggttgctcctgaccgcctcagatttgactttactgccaagggagccatgtccacccaacagatcaagaaggctgaagagattgctaatgagatgattgaggcagccaaggccgtctatacccaggattgccccctggcagcagcgaaagccatccagggcctacgggctgtgtttgatgagacctatcctgaccctgtgcgagtcgtctccattggggtcccggtgtccgagttgctggatgacccctctgggcctgctggctccctgacttctgttgagttctgtgggggaacgcacctgcggaactcgagtcatgcaggagcttttgtgatcgtgacggaagaagccattgccaagggtatccggaggattgtggctgtcacaggtgccgaggcccagaaggccctcaggaaagcagagagcttgaagaaatgtctctctgtcatggaagccaaagtgaaggctcagactgctccaaacaaggatgtgcagagggagatcgctgaccttggagagccttgtagcagggaccccatggatcctgtccttggaccctggacattccctgctgctcccagtgctgctagcaggagagctcttcccaagcatg

SEQ ID NO: 106214 - DNA, 3854 bp, Homo sapiens
  Payload ID: 863
  Gene Symbol: AARS2
  Gene Name: alanyl-tRNA synthetase 2, mitochondrial
  Uniprot ID: Q5JTZ9
  ENST ID: ENST00000244571
  CDS Start-End: 4-2961
acgatggcagcgtcagtggcagctgcagcccggaggctgcggcgggccattcgaaggtcgcccgcatggcggggcctcagccatcggccgctctcatcggagccccctgcagccaaggcctcggccgtgagggccgcctttctgaacttctttcgggaccgccatggccaccggctggtgccctccgcttccgtgcggccccgcggcgaccccagtttgctttttgtcaatgcgggcatgaaccagttcaagccaatctttctgggcaccgtggatccacgaagcgagatggcaggcttccgacgtgtggccaacagccagaaatgtgtgagagctggaggacaccataacgacctggaagatgtgggtcgagacctttcccatcataccttctttgaaatgcttggcaattgggcctttgggggtgaatattttaaggaggaggcttgtaacatggcctgggaactgctgactcaggtctatgggatccctgaggaaaggctctggatctcctactttgatggtgaccccaaggcagggctggacccagacctggagaccagggacatctggctgagcttaggggtgcctgctagccgtgtgctttcctttggaccacaagagaacttctgggagatgggggatactggcccttgtgggccctgtactgagatccactacgaccttgctggtggggtgggagccccccagctggtagagctttggaacctggtcttcatgcaacacaacagagaggcagatggaagcctgcagcccctgccccagcggcatgtggacacaggaatgggcctggaaaggctggtggctgtgctgcaaggcaaacactccacctatgacactgacctcttttccccgctgctcaacgccatacagcagggctgcagggcacccccttacttgggccgagtaggggtggcagacgaggggcgcacagacacagcgtaccgcgtggtggctgaccacatccgcacactcagtgtctgcatctctgatggcatcttccctgggatgtcaggtcccccgctggttcttcgtcggatcctgcgtcgagctgtgcgtttctccatggagatcttaaaggcaccacctggcttcctaggcagcctggtacctgtagtggtggagacactgggagatgcttatccagaactgcaaaggaactcagcccagatcgccaacctggtgtcagaggacgaggcagccttcctggcctccctggagcggggtaggcggatcattgatcggactctgaggaccctggggccttcagatatgttccctgctgaagtggcctggtccttgtcactgtgtggagacctgggactccccttggacatggtagagctgatgctggaggagaaaggggtccagctagactccgctggactggagcggttggcccaagaggaggcccagcaccgggcacggcaggctgagccagttcagaagcagggattgtggcttgatgtccatgcgcttggggagctgcagcgccaaggagtgcccccaactgacgacagccccaagtacaactactccctgcgacccagcggaagttatgagttcggcacctgtgaggcccaggtgttgcaactgtatacagaggacgggacagcagtggcctccgtggggaaaggccagcgctgtggcctcctcttggacaggaccaacttctacgcagaacaggggggccaggcttcagaccgtggctacctggtgcgggcagggcaagaggacgtgctgttcccagtagcccgggcccaggtctgtggaggtttcatcctgcatgaggcagtagcccctgagtgcctgcggttaggggaccaggtgcagctgcatgtggatgaggcctggcgtctaggctgcatggcgaagcatacggccacccacctgctgaactgggcactgaggcagaccctgggccctggcacagagcagcagggctcccatctcaatcctgagcagctgcgcttggatgtgaccacccagaccccattgaccccagagcagctccgggcagtggagaacactgtgcaggaggccgtggggcaggatgaggctgtgtacatggaggaggtgcccctggcgctcactgcccaggtccctggcctgcgctctctggatgaggtttacccagaccctgtgcgggtggtatcagtgggggtgcccgtggcccatgcattggacccagcctcccaagccgcactgcagacctctgtggagctatgctgtgggacgcacctgttacgtactggggctgtaggggacctggttatcatcggggaccgccagctttccaagggcactacccgcctgctggccgtcactggggagcaggcccagcaggcccgagagctaggccagagcctggcccaggaagtgaaagcggccactgagcggctgagtctggggagccgggatgtggcggaggcactgaggctgtccaaggacataggacgactcattgaagctgtggaaactgctgtgatgccccagtggcagcggcgggagctgctggccacagtgaagatgctgcagcggcgtgccaacactgccatccgtaagctgcaaatgggacaggctgcaaagaaaactcaggagctgctggagcggcactcgaaggggcctctgattgtggacacagtctctgctgagtctctctcagtgctggtgaaggtggtacggcagctgtgtgagcaggcccccagcacgtctgtgctcctactcagcccccagcccatggggaaggtgctgtgtgcctgtcaggtggcccagggtgccatgcccaccttcacagcagaggcctgggcactggcagtgtgcagccacatggggggcaaggcgtggggctcacgagtggtggcccaaggcaccggaagcactactgacctggaagctgccctcagtatagcccaaacctatgccctcagccagctctgacccaggtccgcccagggacccacatggactaaaggcaatgccaggagccctgaaggagccagcagaaccttcccacatgctgaagcgaggactagaggctggaggccaagcagctgagccaaagaagatcacctgggccagggcctacgtgacacaaggagacatgggctagggaaggcagaactgggcccaaagacacacacccccttggtgaaagagaagacatggacaattatggctgtgactgcacattagaaattatttcactggccgggtgtggtggttcacacctgtaatccaagcactttgggaggccgaggcaggtagatcatgaggtcaggagatcaaaaccatcctggctaacatggtgaaaccccatctctactaaaaatacaaaaaattagccgggtgtggtggcacacgcctgtagtcccagctactcgggaggctgaggcagaagaatcgcttgaacctgggaggtggaggttgcagtgggccaagatcgcaccactgcactccagcctgggtgacagagcgagactctgtctcaaataattatttcacagaggatagcaagctccagaaggttctattacctttaaaaaagagtagttttgcccctcccagcaacctaagaccagtctgaactcacactgtctgaaaggccacccaggatccaaatcgggccatcttcattgccatgagtgttcggacaggctctgcgtgccaggcaacagtgggcagacaaagggctccctggctactgggaagatacagaaccatcctgtgaaaatcatttcagcactggagaccttctttgctattacttctttcattaacaatgacctctaatttaaattgggccctgctggtttgttgatgaattgagcaac

SEQ ID NO: 106215 - DNA, 783 bp, Homo sapiens
  Payload ID: 864
  Gene Symbol: AARSD1
  Gene Name: alanyl-tRNA synthetase domain containing 1
  ENST ID: ENST00000450475
  CDS Start-End: 317-571
ccaggcttctctgcgcgtgcgcctcctcacacgcctgcagttcaccaccaccgtggtctcctgctgtcccgcggagctgcagactgaagggagcaacggcaagaaagaagtgctgagcggtttccaagtggtgctggaagacacagtgcttttccctgagggcgggggacagcctgatgaccgtggtacaatcaatgacatctctgtgctgagagtgactcgccgtggggaacaggctgatcatttcacccagacacccctggatccaggaagccaggttctggtccgggtagattgggagcggaggtttgaccacatgcagcagcattcagggcagcatctcatcacggcagttgctgaccatctatttaagctgaagacaacatcatgggagttagggagatttcggagtgcgattgagctggacaccccctctatgactgcagagcaagtagctgccattgagcagagcgtcaatgaaaaaatcagagatcggctgcctgtgaatgtccgagaactgagcctggatgatcctgaggtggagcaggtaaggtggccggggtttgcctgatgatcatgctgggcccattcgggttgttaacatcgagggcgttgattccaacatgtgctgtgggacccatgtgagcaatctcagtgaccttcaggtcattaagattctgggcactgagaaggggaaaaagaacagaaccaacctgatatttctgtctgggaaccgggtgctgaagtggatggagagaagtcatggaactgaaaaagcactga

SEQ ID NO: 106216 - DNA, 752 bp, Homo sapiens
  Payload ID: 864
  Gene Symbol: AARSD1
  Gene Name: alanyl-tRNA synthetase domain containing 1
  ENST ID: ENST00000430739
  CDS Start-End: 333-752
cgctctccgttcgctcccaggcttctctgcgcgtgcgcctcctcacacgcctgcagttcaccaccaccgtggtctcctgctgtcccgcggagctgcagactgaagggagcaacggcaagaaagaagtgctgagcggtttccaagtggtgctggaagacacagtgcttttccctgagggcgggggacagcctgatgaccgtggtacaatcaatgacatctctgtgctgagagtgactcgccgtggggaacaggctgatcatttcacccagacacccctggatccaggaagccaggttctggtccgggtagattgggagcggaggtttgaccacatgcagcagcattcagggcagcatctcatcacggcagttgctgaccatctatttaagctgaagacaacatcatgggagttagggagatttcggagtgcgattgagctggacaccccctctatgactgcagagcaagtagctgccattgagcagagcgtcaatgaaaaaatcagagatcggctgcctgtgaatgtccgagaactgagcctggatgatcctgaggtggagcaggtgagtggccggggtttgcctgatgatcatgctgggcccattcgggttgttaacatcgagggcgttgattccaacatgtgctgtgggacccatgtgagcaatctcagtgaccttcaggtcattaagattctgggcactgagaaggggaaaaagaacagaaccaacctgatatttctgtctgggaaccgg

SEQ ID NO: 106217 - DNA, 1322 bp, Homo sapiens
  Payload ID: 864
  Gene Symbol: AARSD1
  Gene Name: alanyl-tRNA synthetase domain containing 1
  Uniprot ID: Q9BTE6
  ENST ID: ENST00000427569
  CDS Start-End: 37-1275
ttctctgcgcgtgcgcctcctcacacgcctgcaggtatggcgttctggtgtcagcgtgacagttatgcccgagagttcaccaccaccgtggtctcctgctgtcccgcggagctgcagactgaagggagcaacggcaagaaagaagtgctgagcggtttccaagtggtgctggaagacacagtgcttttccctgagggcgggggacagcctgatgaccgtggtacaatcaatgacatctctgtgctgagagtgactcgccgtggggaacaggctgatcatttcacccagacacccctggatccaggaagccaggttctggtccgggtagattgggagcggaggtttgaccacatgcagcagcattcagggcagcatctcatcacggcagttgctgaccatctatttaagctgaagacaacatcatgggagttagggagatttcggagtgcgattgagctggacaccccctctatgactgcagagcaagtagctgccattgagcagagcgtcaatgaaaaaatcagagatcggctgcctgtgaatgtccgagaactgagcctggatgatcctgaggtggagcaggtgagtggccggggtttgcctgatgatcatgctgggcccattcgggttgttaacatcgagggcgttgattccaacatgtgctgtgggacccatgtgagcaatctcagtgaccttcaggtcattaagattctgggcactgagaaggggaaaaagaacagaaccaacctgatatttctgtctgggaaccgggtgctgaagtggatggagagaagtcatggaactgaaaaagcactgactgctctgcttaagtgtggagcagaggatcatgtggaagcagtgaaaaagctccagaactccaccaagatcctgcagaagaataacctgaatctgctcagagacctggctgtgcacattgcccatagcctcaggaacagtccagactggggaggtgtggtcatattacacaggaaggagggtgattcagagttcatgaatatcattgccaatgagattgggtcagaggagaccctcctgttcttaactgtgggcgatgagaaaggtggtggactcttcttactggcagggccacctgcgtctgtggagaccctggggcccagggtggctgaggtcctggaaggcaaaggagcagggaagaaaggccgttttcagggcaaggccaccaagatgagccggcggatggaggcgcaggcgcttctccaggactacatcagcacgcagagtgctaaggagtgagggcttagggcactcacctcctgtttccacaggaatcttttggtcaa

SEQ ID NO: 106218 - DNA, 680 bp, Homo sapiens
  Payload ID: 864
  Gene Symbol: AARSD1
  Gene Name: alanyl-tRNA synthetase domain containing 1
  ENST ID: ENST00000436545
  CDS Start-End: 15-311
acacgcctgcaggtatggcgttctggtgtcagcgtgacagttatgcccgagagttcaccaccaccgtggtctcctgctgtcccgcggagctgcagactgaagggagcaacggcaagaaagaagtgctgagcggtttccaagtggtgctggaagacacagtgcttttccctgagggcgggggacagatggtgtcttgctctgttgccaggctggagcgcagcggcgtgatctcggcttactgcaatctccgtctgccaggttcaagcaattcccctgcctcagtctcccgagtagctaggactacagcctgatgaccgtggtacaatcaatgacatctctgtgctgagagtgactcgccgtggggaacaggctgatcatttcacccagacacccctggatccaggaagccaggttctggtccgggtagattgggagcggaggtttgaccacatgcagcagcattcagggcagcatctcatcacggcagttgctgaccatctatttaagctgaagacaacatcatgggagttagggagatttcggagtgcgattgagctggacaccccctctatgactgcagagcaagtagctgccattgagcagagcgtcaatgaaaaaatcagagatcggctgcctgtgaatgtccgagaactgagcctggatgatcctgaggtggagca

SEQ ID NO: 106219 - DNA, 726 bp, Homo sapiens
  Payload ID: 864
  Gene Symbol: AARSD1
  Gene Name: alanyl-tRNA synthetase domain containing 1
  ENST ID: ENST00000591910
  CDS Start-End: 1-239
acagttatgcccgagagttcaccaccaccgtggtctcctgctgtcccgcggagctgcagactgaagggagcaacggcaagaaagaagtgctgagcggtttccaagtggtgctggaagacacagtgcttttccctgagggcgggggacaggctggagcgcagcggcgtgatctcggcttactgcaatctccgtctgccaggttcaagcaattcccctgcctcagtctcccgagtagctaggactacagcctgatgaccgtggtacaatcaatgacatctctgtgctgagagtgactcgccgtggggaacaggctgatcatttcacccagacacccctggatccaggaagccaggttctggtccgggtagattgggagcggaggtttgaccacatgcagcagcattcagggcagcatctcatcacggcagttgctgaccatctatttaagctgaagacaacatcatgagcaagtagctgccattgagcagagcgtcaatgaaaaaatcagagatcggctgcctgtgaatgtccgagaactgagcctggatgatcctgaggtggagcaggtgagtggccggggtttgcctgatgatcatgctgggcccattcgggttgttaacatcgagggcgttgattccaacatgtgctgtgggacccatgtgagcaatctcagtgaccttcaggtcattaagattctgggcactgagaaggggaaaaagaacagaa

SEQ ID NO: 106220 - DNA, 562 bp, Homo sapiens
  Payload ID: 864
  Gene Symbol: AARSD1
  Gene Name: alanyl-tRNA synthetase domain containing 1
  ENST ID: ENST00000591096
  CDS Start-End: 1-283
ggggaaaaagaacagaaccaacctgatatttctgtctgggaaccgggtgctgaagtggatggagagaagtcatggaactgaaaaagcactgactgctctgcttaagtgtggagcagaggatcatgtggaagcagtgaaaaagctccagaactccaccaagatcctgcagaagaataacctgaatctgctcagagacctggctgtgcacattgcccatagcctcaggaacagtccagactggggaggtgtggtcatattacacaggagaccctcctgttcttaactgtgggcgatgagaaaggtggtggactcttcttactggcagggccacctgcgtctgtggagaccctggggcccagggtggctgaggtcctggaaggcaaaggagcagggaagaaaggccgttttcagggcaaggccaccaagatgagccggcggatggaggcgcaggcgcttctccaggactacatcagcacgcagagtgctaaggagtgagggcttagggcactcacctcctgtttccacaggaatcttttggtcaataaaatagattgactcagaa

SEQ ID NO: 106221 - DNA, 2263 bp, Homo sapiens
  Payload ID: 865
  Gene Symbol: ALB
  Gene Name: albumin
  Uniprot ID: P02768
  ENST ID: ENST00000295897
  CDS Start-End: 90-1919
aattattggttaaagaagtatattagtgctaatttccctccgtttgtcctagcttttctcttctgtcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttcttgtgggctaattaaataaatcattaatactcttctaa

SEQ ID NO: 106222 - DNA, 1659 bp, Homo sapiens
  Payload ID: 865
  Gene Symbol: ALB
  Gene Name: albumin
  ENST ID: ENST00000401494
  CDS Start-End: 21-1505
ccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctct

SEQ ID NO: 106223 - DNA, 591 bp, Homo sapiens
  Payload ID: 865
  Gene Symbol: ALB
  Gene Name: albumin
  ENST ID: ENST00000441319
  CDS Start-End: 1-591
ggatttgagtggggaggccaaagaagagccagccataacagcacattctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagct

SEQ ID NO: 106224 - DNA, 1483 bp, Homo sapiens
  Payload ID: 865
  Gene Symbol: ALB
  Gene Name: albumin
  ENST ID: ENST00000415165
  CDS Start-End: 42-1295
ctagcttttctcttctgtcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaa

SEQ ID NO: 106225 - DNA, 1741 bp, Homo sapiens
  Payload ID: 865
  Gene Symbol: ALB
  Gene Name: albumin
  ENST ID: ENST00000503124
  CDS Start-End: 208-1587
ctgtcaaccccacacgcctttggcacaatgaagtgggtaacctttatttcccttctttttctctttagctcggcttattccaggggtgtgtttcgtcgagatgcacggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctct

SEQ ID NO: 106226 - DNA, 1911 bp, Homo sapiens
  Payload ID: 865
  Gene Symbol: ALB
  Gene Name: albumin
  ENST ID: ENST00000509063
  CDS Start-End: 25-1839
tcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagcctaccatgagaataagagaaagaaaatgaagatcaaaagcttattcatctgtttttctttttcgttggtgtaaagccaacaccctgtctaaaaaacataaa

SEQ ID NO: 106227 - DNA, 1604 bp, Homo sapiens
  Payload ID: 865
  Gene Symbol: ALB
  Gene Name: albumin
  ENST ID: ENST00000476441
  CDS Start-End: 28-345
ctgtcaaccccacacgcctttggcacaatgaagtgggtaacctttatttcccttctttttctctttagctcggcttattccaggggtgtgtttcgtcgagatgcacatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctctttt

SEQ ID NO: 106228 - DNA, 1519 bp, Homo sapiens
  Payload ID: 865
  Gene Symbol: ALB
  Gene Name: albumin
  ENST ID: ENST00000511370
  CDS Start-End: 1-1363
tttttcaaaatttagatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgt

SEQ ID NO: 106229 - DNA, 1606 bp, Homo sapiens
  Payload ID: 865
  Gene Symbol: ALB
  Gene Name: albumin
  ENST ID: ENST00000621628
  CDS Start-End: 74-1264
agtatattagtgctaatttccctccgtttgtcctagcttttctcttctgtcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatatacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttcttgtgggctaattaaataaatcattaatactcttct

SEQ ID NO: 106230 - DNA, 1418 bp, Homo sapiens
  Payload ID: 865
  Gene Symbol: ALB
  Gene Name: albumin
  Uniprot ID: P02768
  ENST ID: ENST00000621085
  CDS Start-End: 42-1232
ctagcttttctcttctgtcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatct

SEQ ID NO: 106231 - DNA, 1499 bp, Homo sapiens
  Payload ID: 866
  Gene Symbol: ADH1A
  Gene Name: alcohol dehydrogenase 1A (class I), alpha polypeptide
  Uniprot ID: P07327
  ENST ID: ENST00000209668
  CDS Start-End: 115-1242
aagcaaaaaaaataaataaatacctatgcaatacacctgctttatgcacttgagcagggaagaaatccacaaggactcaccagtctcctggtctgcagagaagacagaatcaacatgagcacagcaggaaaagtaatcaaatgcaaagcagctgtgctatgggagttaaagaaacccttttccattgaggaggtggaggttgcacctcctaaggcccatgaagttcgtattaagatggtggctgtaggaatctgtggcacagatgaccacgtggttagtggtaccatggtgaccccacttcctgtgattttaggccatgaggcagccggcatcgtggagagtgttggagaaggggtgactacagtcaaaccaggtgataaagtcatcccactcgctattcctcagtgtggaaaatgcagaatttgtaaaaacccggagagcaactactgcttgaaaaacgatgtaagcaatcctcaggggaccctgcaggatggcaccagcaggttcacctgcaggaggaagcccatccaccacttccttggcatcagcaccttctcacagtacacagtggtggatgaaaatgcagtagccaaaattgatgcagcctcgcctctagagaaagtctgtctcattggctgtggattttcaactggttatgggtctgcagtcaatgttgccaaggtcaccccaggctctacctgtgctgtgtttggcctgggaggggtcggcctatctgctattatgggctgtaaagcagctggggcagccagaatcattgcggtggacatcaacaaggacaaatttgcaaaggccaaagagttgggtgccactgaatgcatcaaccctcaagactacaagaaacccatccaggaggtgctaaaggaaatgactgatggaggtgtggatttttcatttgaagtcatcggtcggcttgacaccatgatggcttccctgttatgttgtcatgaggcatgtggcacaagtgtcatcgtaggggtacctcctgattcccaaaacctctcaatgaaccctatgctgctactgactggacgtacctggaagggagctattcttggtggctttaaaagtaaagaatgtgtcccaaaacttgtggctgattttatggctaagaagttttcattggatgcattaataacccatgttttaccttttgaaaaaataaatgaaggatttgacctgcttcactctgggaaaagtatccgtaccattctgatgttttgagacaatacagatgttttcccttgtggcagtcttcagcctcctctaccctacatgatctggagcaacagctgggaaatatcattaattctgctcatcacagattttatcaataaattacatttgggggctttccaaagaaatggaaattgatgtaaaattatttttcaagcaaatgtttaaaatccaaatgagaactaaataaagtgttgaacatcagctggggaattgaagccaataaaccttccttcttaaccatt

SEQ ID NO: 106232 - DNA, 4072 bp, Homo sapiens
  Payload ID: 867
  Gene Symbol: ADH1B
  Gene Name: alcohol dehydrogenase 1B (class I), beta polypeptide
  Uniprot ID: P00325
  ENST ID: ENST00000305046
  CDS Start-End: 69-1196
gcactcaagcagagaagaaatccacaaagactcacagtctgctggtgggcagagaagacagaaacgacatgagcacagcaggaaaagtaatcaaatgcaaagcagctgtgctatgggaggtaaagaaacccttttccattgaggatgtggaggttgcacctcctaaggcttatgaagttcgcattaagatggtggctgtaggaatctgtcacacagatgaccacgtggttagtggcaacctggtgaccccccttcctgtgattttaggccatgaggcagccggcatcgtggagagtgttggagaaggggtgactacagtcaaaccaggtgataaagtcatcccgctctttactcctcagtgtggaaaatgcagagtttgtaaaaacccggagagcaactactgcttgaaaaatgatctaggcaatcctcgggggaccctgcaggatggcaccaggaggttcacctgcagggggaagcccattcaccacttccttggcaccagcaccttctcccagtacacggtggtggatgagaatgcagtggccaaaattgatgcagcctcgcccctggagaaagtctgcctcattggctgtggattctcgactggttatgggtctgcagttaacgttgccaaggtcaccccaggctctacctgtgctgtgtttggcctgggaggggtcggcctatctgctgttatgggctgtaaagcagctggagcagccagaatcattgcggtggacatcaacaaggacaaatttgcaaaggccaaagagttgggtgccactgaatgcatcaaccctcaagactacaagaaacccattcaggaagtgctaaaggaaatgactgatggaggtgtggatttttcgtttgaagtcatcggtcggcttgacaccatgatggcttccctgttatgttgtcatgaggcatgtggcacaagcgtcatcgtaggggtacctcctgcttcccagaacctctcaataaaccctatgctgctactgactggacgcacctggaagggggctgtttatggtggctttaagagtaaagaaggtatcccaaaacttgtggctgattttatggctaagaagttttcactggatgcgttaataacccatgttttaccttttgaaaaaataaatgaaggatttgacctgcttcactctgggaaaagtatccgtaccgtcctgacgttttgaggcaatagagatgccttcccctgtagcagtcttcagcctcctctaccctacaagatctggagcaacagctaggaaatatcattaattcagctcttcagagatgttatcaataaattacacatgggggctttccaaagaaatggaaattgatgggaaattatttttcaggaaaatttaaaattcaagtgagaagtaaataaagtgttgaacatcagctggggaattgaagccaacaaaccttccttcttaaccattctactgtgtcacctttgccattgaggaaaaatattcctgtgacttcttgcatttttggtatcttcataatctttagtcatcgaatcccagtggaggggacccttttacttgccctgaacatacacatgctgggccattgtgattgaagtcttctaactctgtctcagttttcactgtcgacattttcctttttctaataaaaatgtaccaaatccctggggtaaaagctagggtaaggtaaaggatagactcacatttacaagtagtgaaggtccaagagttctaaatacaggaaatttcttaggaactcaaataaaatgccccacattttactacagtaaatggcagtgtttttatgacttttatactatttctttatggtcgatatacaattgattttttaaaataatagcagatttcttgcttcatatgacaaagcctcaattactaattgtaaaaactgaactattcccagaatcatgttcaaaaaatctgtaatttttgctgatgaaagtgcttcattgactaaacagtattagtttgtggctataaatgattatttagatgatgactgaaaatgtgtataaagtaattaaaagtaatatggtggctttaagtgtagagatgggatggcaaatgctgtgaatgcagaatgtaaaattggtaactaagaaatggcacaaacaccttaagcaatatattttcctagtagatatatatatacacatacatatatacacatatacaaatgtatatttttgcaaaattgttttcaatctagaacttttctattaactaccatgtcttaaaatcaagtctataatcctagcattagtttaatattttgaatatgtaaagacctgtgttaatgctttgttaatgcttttcccactctcatttgttaatgctttcccactctcaggggaaggatttgcattttgagctttatctctaaatgtgacatgcaaagattattcctggtaaaggaggtagctgtctccaaaaatgctattgttgcaatatctacattctatttcatattatgaaagaccttagacataaagtaaaatagtttatcatttactgtgtgatcttcagtaagtctctcaggctctctgagcttgttcatcctttgttttgaaaaaattactcaaccaatccattacagcttaaccaagattaaatgggatgatgttaatgaaagagcttcgccaattaagaagggccatgtaaatgtgggtaacctgattgttttgtcaaaaatgctaaagcggggtggggggtggcgcagtggcttatccctgtaatcccagcactttgggaggtcaagacgggtggatgacctgaggtcaggagtttgagaccagcctggtcaacatggtgaaaccccatctctactaaaaatacaaaaatttgccaggcatggtggcaggtggctgtaatcccagctactcaggaggctgaggcaagagaatcgctggagcctgggaggcggaggttgcagtgagcagaaatcttgccactgcacagcagcctaggcgacaagagcaaaactctgtcaaaagaaaagaaaagaaaatgctgaaggagttactcagggtcaagaaagttttcagaatgtccgtaagataacatcatcatgggacactacctgttgctgggtgctctgcggcttttacactgatgctgattgtgtgagatccagaaaaagaaaatggagttctacatgcccatctcacagcagggtcatcaaatcctgctagtgacacagaagctgacatccagctcccacccgccttcctcccaggttcggggagcaggtagagtgggagccattaggtgggctctgccagtgttgtcatagagtggcaagtcctccatgggatgggagtggcatgtgggagccttctgcatcatgcactatgaaaaaagaaaatttactatggggcaagtggttcatatagttaagtgattgtatatatatatatatatatatatatatatatatatatatatatatatacactatggggcaagtggttcatatagttaagtgattgtatatatatatatatatatatatgtattccagtgtagaaagtattggctgggtctgtaatcaagtattccacagaagtgccttcataggtgctgaaacaggattatgagagtgacagacacaggactgaagacagggagaaaatgtgcatggctgtgagaatatattgctttgattctttgacttctcatgatatatgaaaacaaataaagtgggggggggtgacttcaataatatcacgaacatatttaaaatgaaattctgagcatggagaaaaatttcaaattctggtataaacaaataatctaaaaatatagataaggaaaaaatgttttcatttttttggtcatattgatttgggtcatatatgattgaccaaaaaaaaagatatttctaaaatcctggtgctttttcatttaaaaatagacaaccaaagaggaaaatgaacaatgatggaaattcgtggaagaggaaactaaaatggcaaaatagcatattaaatggcactgagccttggtgtgatcaaaaaaaaaaataaagcaaaatgagatattactgctta

SEQ ID NO: 106233 - DNA, 1667 bp, Homo sapiens
  Payload ID: 867
  Gene Symbol: ADH1B
  Gene Name: alcohol dehydrogenase 1B (class I), beta polypeptide
  ENST ID: ENST00000506651
  CDS Start-End: 313-1320
atgcactcaagcagagaagaaatccacaaagactcacagtctgctggtgggcagagaagacagaaacgacatgagcacagcaggaaaagaaagttgtctgacagaagtttgatgagaggaatttgactcagaagactgaaatatcctttaaccttactataaaatatcttacaaaatactcattgatttcacagcattagaatcatcaaggtaatcaaatgcaaagcagctgtgctatgggaggtaaagaaacccttttccattgaggatgtggaggttgcacctcctaaggcttatgaagttcgcattaagatggtggctgtaggaatctgtcacacagatgaccacgtggttagtggcaacctggtgaccccccttcctgtgattttaggccatgaggcagccggcatcgtggagagtgttggagaaggggtgactacagtcaaaccaggtgataaagtcatcccgctctttactcctcagtgtggaaaatgcagagtttgtaaaaacccggagagcaactactgcttgaaaaatgatctaggcaatcctcgggggaccctgcaggatggcaccaggaggttcacctgcagggggaagcccattcaccacttccttggcaccagcaccttctcccagtacacggtggtggatgagaatgcagtggccaaaattgatgcagcctcgcccctggagaaagtctgcctcattggctgtggattctcgactggttatgggtctgcagttaacgttgccaaggtcaccccaggctctacctgtgctgtgtttggcctgggaggggtcggcctatctgctgttatgggctgtaaagcagctggagcagccagaatcattgcggtggacatcaacaaggacaaatttgcaaaggccaaagagttgggtgccactgaatgcatcaaccctcaagactacaagaaacccattcaggaagtgctaaaggaaatgactgatggaggtgtggatttttcgtttgaagtcatcggtcggcttgacaccatgatggcttccctgttatgttgtcatgaggcatgtggcacaagcgtcatcgtaggggtacctcctgcttcccagaacctctcaataaaccctatgctgctactgactggacgcacctggaagggggctgtttatggtggctttaagagtaaagaaggtatcccaaaacttgtggctgattttatggctaagaagttttcactggatgcgttaataacccatgttttaccttttgaaaaaataaatgaaggatttgacctgcttcactctgggaaaagtatccgtaccgtcctgacgttttgaggcaatagagatgccttcccctgtagcagtcttcagcctcctctaccctacaagatctggagcaacagctaggaaatatcattaattcagctcttcagagatgttatcaataaattacacatgggggctttccaaagaaatggaaattgatgggaaattatttttcaggaaaatttaaaattcaagtgagaagtaaataaagtgttgaacatcagctggggaattgaagccaacaaaccttccttcttaaccattctactgtgtcacctttgccattgaggaaaaatattcctgtgacttcttgcatttttggtatcttcataatctttagtcatcgaatcccagtg

SEQ ID NO: 106234 - DNA, 4059 bp, Homo sapiens
  Payload ID: 867
  Gene Symbol: ADH1B
  Gene Name: alcohol dehydrogenase 1B (class I), beta polypeptide
  ENST ID: ENST00000625860
  CDS Start-End: 189-1196
gcactcaagcagagaagaaatccacaaagactcacagtctgctggtgggcagagaagacagaaacgacatgagcacagcaggaaaagtaatcaaatgcaaagcagctgtgctatgggaggtaaagaaacccttttccattgaggatgtggaggttgcacctcctaaggcttatgaagttcgcattaagatggtggctgtaggaatctgtcacacagatgaccacgtggttagtggcaacctggtgaccccccttcctgtgattttaggccatgaggcagccggcatcgtggagagtgttggagaaggggtgactacagtcaaaccaggtgataaagtcatcccgctctttactcctcagtgtggaaaatgcagagtttgtaaaaacccggagagcaactactgcttgaaaaatgatctaggcaatcctcgggggaccctgcaggatggcaccaggaggttcacctgcagggggaagcccattcaccacttccttggcaccagcaccttctcccagtacacggtggtggatgagaatgcagtggccaaaattgatgcagcctcgcccctggagaaagtctgcctcattggctgtggattctcgactggttatgggtctgcagttaacgttgccaaggtcaccccaggctctacctgtgctgtgtttggcctgggaggggtcggcctatctgctgttatgggctgtaaagcagctggagcagccagaatcattgcggtggacatcaacaaggacaaatttgcaaaggccaaagagttgggtgccactgaatgcatcaaccctcaagactacaagaaacccattcaggaagtgctaaaggaaatgactgatggaggtgtggatttttcgtttgaagtcatcggtcggcttgacaccatgatggcttccctgttatgttgtcatgaggcatgtggcacaagcgtcatcgtaggggtacctcctgcttcccagaacctctcaataaaccctatgctgctactgactggacgcacctggaagggggctgtttatggtggctttaagagtaaagaaggtatcccaaaacttgtggctgattttatggctaagaagttttcactggatgcgttaataacccatgttttaccttttgaaaaaataaatgaaggatttgacctgcttcactctgggaaaagtatccgtaccgtcctgacgttttgaggcaatagagatgccttcccctgtagcagtcttcagcctcctctaccctacaagatctggagcaacagctaggaaatatcattaattcagctcttcagagatgttatcaataaattacacatgggggctttccaaagaaatggaaattgatgggaaattatttttcaggaaaatttaaaattcaagtgagaagtaaataaagtgttgaacatcagctggggaattgaagccaacaaaccttccttcttaaccattctactgtgtcacctttgccattgaggaaaaatattcctgtgacttcttgcatttttggtatcttcataatctttagtcatcgaatcccagtggaggggacccttttacttgccctgaacatacacatgctgggccattgtgattgaagtcttctaactctgtctcagttttcactgtcgacattttcctttttctaataaaaatgtaccaaatccctggggtaaaagctagggtaaggtaaaggatagactcacatttacaagtagtgaaggtccaagagttctaaatacaggaaatttcttaggaactcaaataaaatgccccacattttactacagtaaatggcagtgtttttatgacttttatactatttctttatggtcgatatacaattgattttttaaaataatagcagatttcttgcttcatatgacaaagcctcaattactaattgtaaaaactgaactattcccagaatcatgttcaaaaaatctgtaatttttgctgatgaaagtgcttcattgactaaacagtattagtttgtggctataaatgattatttagatgatgactgaaaatgtgtataaagtaattaaaagtaatatggtggctttaagtgtagagatgggatggcaaatgctgtgaatgcagaatgtaaaattggtaactaagaaatggcacaaacaccttaagcaatatattttcctagtagatatatatatacacatacatatatacacatatacaaatgtatatttttgcaaaattgttttcaatctagaacttttctattaactaccatgtcttaaaatcaagtctataatcctagcattagtttaatattttgaatatgtaaagacctgtgttaatgctttgttaatgcttttcccactctcatttgttaatgctttcccactctcaggggaaggatttgcattttgagctttatctctaaatgtgacatgcaaagattattcctggtaaaggaggtagctgtctccaaaaatgctattgttgcaatatctacattctatttcatattatgaaagaccttagacataaagtaaaatagtttatcatttactgtgtgatcttcagtaagtctctcaggctctctgagcttgttcatcctttgttttgaaaaaattactcaaccaatccattacagcttaaccaagattaaatgggatgatgttaatgaaagagcttcgccaattaagaagggccatgtaaatgtgggtaacctgattgttttgtcaaaaatgctaaagcggggtggggggtggcgcagtggcttatccctgtaatcccagcactttgggaggtcaagacgggtggatgacctgaggtcaggagtttgagaccagcctggtcaacatggtgaaaccccatctctactaaaaatacaaaaatttgccaggcatggtggcaggtggctgtaatcccagctactcaggaggctgaggcaagagaatcgctggagcctgggaggcggaggttgcagtgagcagaaatcttgccactgcacagcagcctaggcgacaagagcaaaactctgtcaaaagaaaagaaaagaaaatgctgaaggagttactcagggtcaagaaagttttcagaatgtccgtaagataacatcatcatgggacactacctgttgctgggtgctctgcggcttttacactgatgctgattgtgtgagatccagaaaaagaaaatggagttctacatgcccatctcacagcagggtcatcaaatcctgctagtgacacagaagctgacatccagctcccacccgccttcctcccaggttcggggagcaggtagagtgggagccattaggtgggctctgccagtgttgtcatagagtggcaagtcctccatgggatgggagtggcatgtgggagccttctgcatcatgcactatgaaaaaagaaaatttactatggggcaagtggttcatatagttaagtgattgtatatatatatatatatatatatatatatatatatatatatatatatacactatggggcaagtggttcatatagttaagtgattgtatatatatatatatatatatatgtattccagtgtagaaagtattggctgggtctgtaatcaagtattccacagaagtgccttcataggtgctgaaacaggattatgagagtgacagacacaggactgaagacagggagaaaatgtgcatggctgtgagaatatattgctttgattctttgacttctcatgatatatgaaaacaaataaagtgggggggggtgacttcaataatatcacgaacatatttaaaatgaaattctgagcatggagaaaaatttcaaattctggtataaacaaataatctaaaaatatagataaggaaaaaatgttttcatttttttggtcatattgatttgggtcatatatgattgaccaaaaaaaaagatatttctaaaatcctggtgctttttcatttaaaaatagacaaccaaagaggaaaatgaacaatgatggaaattcgtggaagaggaaactaaaatggcaaaatagcatattaaatggcactgagccttggtgtgatcaaaaaaaaaaataaagcaaaatgag

SEQ ID NO: 106235 - DNA, 1740 bp, Homo sapiens
  Payload ID: 868
  Gene Symbol: ADH1C
  Gene Name: alcohol dehydrogenase 1C (class I), gamma polypeptide
  Uniprot ID: P00326
  ENST ID: ENST00000515683
  CDS Start-End: 353-1480
gtgggtttgagagaagagaagcaggaacttgagagaggaggaagagagaaagtaattaaaatgtatcgttttaacttaatatttaaccgaatgatagcaaaatcttatctgaaattggaaaagtcaaggttttgagtgctggttcggtgcccatttctttatgatttgatagtctgagaagaatacgacgggtgtggcttaaaaacctagatcacgtgtgtagttggaattgggtgttatatgagcaaacaaaataaatacctgtgcaacatacctgctttatgcactcaagcagagaagaaatccacaagtactcaccagcctcctggtctgcagagaagacagaatcaatatgagcacagcaggaaaagtaatcaaatgcaaagcagctgtgctatgggagttaaagaaacccttttccattgaggaggtagaggttgcacctcctaaggctcatgaagttcgcattaagatggtggctgcaggaatctgtcgttcagatgagcatgtggttagtggcaacctggtgaccccccttcctgtgattttaggccatgaggcagccggcatcgtggaaagtgttggagaaggggtgactacagtcaaaccaggtgataaagtcatcccgctctttactcctcagtgtggaaaatgcagaatttgtaaaaacccagaaagcaactactgcttgaaaaatgatctaggcaatcctcgggggaccctgcaggatggcaccaggaggttcacctgcagcgggaagcccatccaccacttcgtcggcgtcagcaccttctcccagtacacagtggtggatgagaatgcagtggccaaaattgatgcagcctcgcccctggagaaagtctgcctcattggctgtggattttcgactggttatgggtctgcagtcaaagttgccaaggtcaccccagggtctacctgtgctgtgtttggcctgggaggggtcggcctatctgttgttatgggctgtaaagcagctggagcagccagaatcattgctgtggacatcaacaaggacaaatttgcaaaggctaaagagttgggtgccactgaatgcatcaaccctcaagactacaagaaacccattcaggaagtgctaaaggaaatgactgatggaggtgtggatttttcgtttgaagtcatcggtcggcttgacaccatgatggcttccctgttatgttgtcatgaggcatgtggcacaagtgtcattgtaggggtacctcctgattcccagaacctctcaataaaccctatgctgctactgactggacgcacgtggaaaggagctatttttggaggctttaagagtaaagaatctgtccccaaacttgtggctgactttatggctaagaagttttcactggatgcattaataacaaatattttaccttttgaaaaaataaatgaaggatttgacctgcttcgctctggaaagagtatccgtaccgtcctgacgttttgaaacaatacagatgccttcccttgtagcagttttcagcctcctctaccctacatgatctggagcaacagctaggaaatatcattaattctgctcttcagagatgttaaaaataaattacacgtgggagctttccaaagaaatggaaattgatgggaaattatttgtcaagcaaatgtttaaaatccaaatgagaactaaataaagtgttgaacatcaactggggaattgaagccaataaaccttccttcttaaccattcaa

SEQ ID NO: 106236 - DNA, 872 bp, Homo sapiens
  Payload ID: 868
  Gene Symbol: ADH1C
  Gene Name: alcohol dehydrogenase 1C (class I), gamma polypeptide
  ENST ID: ENST00000510055
  CDS Start-End: 296-872
aagaaatccacaagtactcaccagcctcctggtctgcagagaagacagaatcaatatgagcacagcaggaaaaatggagtatctttctattgcccaggttggagtgcaatggtgatctcggctcactgcaacctctgcctcccgggttcaagtgattctcctgcctcagcctcacaagtagctgagtttacaggtaatcaaatgcaaagcagctgtgctatgggagttaaagaaacccttttccattgaggaggtagaggttgcacctcctaaggctcatgaagttcgcattaagatggtggctgcaggaatctgtcgttcagatgagcatgtggttagtggcaacctggtgaccccccttcctgtgattttaggccatgaggcagccggcatcgtggaaagtgttggagaaggggtgactacagtcaaaccaggtgataaagtcatcccgctctttactcctcagtgtggaaaatgcagaatttgtaaaaacccagaaagcaactactgcttgaaaaatgatctaggcaatcctcgggggaccctgcaggatggcaccaggaggttcacctgcagcgggaagcccatccaccacttcgtcggcgtcagcaccttctcccagtacacagtggtggatgagaatgcagtggccaaaattgatgcagcctcgcccctggagaaagtctgcctcattggctgtggattttcgactggttatgggtctgcagtcaaagttgccaaggtcaccccagggtctacctgtgctgtgtttggcctgggaggggtcggcctatctgttgttatgggctgtaaagcagctggagcagccagaatcattgctgtggacatcaacaaggacaaatttgcaaagg

SEQ ID NO: 106237 - DNA, 581 bp, Homo sapiens
  Payload ID: 868
  Gene Symbol: ADH1C
  Gene Name: alcohol dehydrogenase 1C (class I), gamma polypeptide
  ENST ID: ENST00000511397
  CDS Start-End: 72-581
atgcactcaagcagagaagaaatccacaagtactcaccagcctcctggtctgcagagaagacagaatcaatatgagcacagcaggaaaaatggtggctgcaggaatctgtcgttcagatgagcatgtggttagtggcaacctggtgaccccccttcctgtgattttaggccatgaggcagccggcatcgtggaaagtgttggagaaggggtgactacagtcaaaccaggtgataaagtcatcccgctctttactcctcagtgtggaaaatgcagaatttgtaaaaacccagaaagcaactactgcttgaaaaatgatctaggcaatcctcgggggaccctgcaggatggcaccaggaggttcacctgcagcgggaagcccatccaccacttcgtcggcgtcagcaccttctcccagtacacagtggtggatgagaatgcagtggccaaaattgatgcagcctcgcccctggagaaagtctgcctcattggctgtggattttcgactggttatgggtctgcagtcaaagttgccaaggtcaccccagggtctacctgtgctgtgtttggcctgggaggggtc

SEQ ID NO: 106238 - DNA, 1993 bp, Homo sapiens
  Payload ID: 869
  Gene Symbol: ADH4
  Gene Name: alcohol dehydrogenase 4 (class II), pi polypeptide
  Uniprot ID: P08319
  ENST ID: ENST00000265512
  CDS Start-End: 76-1218
acggaactccctgggtaggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctctctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaaccgatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactatttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagcgtccgaacaatcctcatcttttgaagatgccaggagcaattcagaatactatctgattgaatgtgaacctgcctggttaatttattacctgatttgatgaaccaaggaaagccatgagtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactggggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggagatg

SEQ ID NO: 106239 - DNA, 946 bp, Homo sapiens
  Payload ID: 869
  Gene Symbol: ADH4
  Gene Name: alcohol dehydrogenase 4 (class II), pi polypeptide
  ENST ID: ENST00000512499
  CDS Start-End: 174-946
agtttcccaaagaaaaatgggcaccaagggcaaaataaatttaataatgatgtaagcctcatttctcagacttttaatgaattctctggggatattgttcaaatgcagattttgatttagtggatttgaggcagggctttcatctctaacaaattcccaagtgatgtgaataaatgcttgtccgaggaccacacttcgagttgcagagatgtaaaacacatctattctccagcaattatctgactcaggttattaaatgcaaagcagccatcgcctgggaagcaggcaagcccctttgcattgaagaggttgaagtagctccccccaaggctcatgaagttcgcattcagatcattgctacctctctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaa

SEQ ID NO: 106240 - DNA, 575 bp, Homo sapiens
  Payload ID: 869
  Gene Symbol: ADH4
  Gene Name: alcohol dehydrogenase 4 (class II), pi polypeptide
  ENST ID: ENST00000509471
  CDS Start-End: 1-348
aatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaaccgatccaggaagttatcattgaattgaccaagggaggtgtggattttgcccttgactgtgcaggtggatctgaaaccatggttggaaaagtgtagattctatcccaaagctggtcactgactataagaataagaaattcaatctggatgcactggtgacccataccctgccttttgacaaaatcagtgaggcatttgacctaatgaaccaaggaaaaagcgtccgaacaatcctcatcttttgaagatgccaggagcaattcagaatactatctgattgaatgtgaacctgcctggttaatttattacctgatttgatgaac

SEQ ID NO: 106241 - DNA, 2151 bp, Homo sapiens
  Payload ID: 869
  Gene Symbol: ADH4
  Gene Name: alcohol dehydrogenase 4 (class II), pi polypeptide
  Uniprot ID: P08319
  ENST ID: ENST00000508393
  CDS Start-End: 167-1366
acggaactccctgggtaggagtttgaagctttcttaactcagaaagaaacttccaacacagtttcccaaagaaaaatgggcaccaagggcaaagtaagcaaattttgatttagtggatttgaggcagggctttcatctctaacaaattcccaagtgatgtgaataaatgcttgtccgaggaccacacttcgagttgcagagatgtaaaacacatctattctccagcaattatctgactcaggttattaaatgcaaagcagccatcgcctgggaagcaggcaagcccctttgcattgaagaggttgaagtagctccccccaaggctcatgaagttcgcattcagatcattgctacctctctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaaccgatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactatttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagcgtccgaacaatcctcatcttttgaagatgccaggagcaattcagaatactatctgattgaatgtgaacctgcctggttaatttattacctgatttgatgaaccaaggaaagccatgagtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactggggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggagatggacaccccat

SEQ ID NO: 106242 - DNA, 1400 bp, Homo sapiens
  Payload ID: 869
  Gene Symbol: ADH4
  Gene Name: alcohol dehydrogenase 4 (class II), pi polypeptide
  Uniprot ID: P08319
  ENST ID: ENST00000505590
  CDS Start-End: 138-1337
tttgaagctttcttaactcagaaagaaacttccaacacagtttcccaaagaaaaatgggcaccaagggcaaaattttgatttagtggatttgaggcagggctttcatctctaacaaattcccaagtgatgtgaataaatgcttgtccgaggaccacacttcgagttgcagagatgtaaaacacatctattctccagcaattatctgactcaggttattaaatgcaaagcagccatcgcctgggaagcaggcaagcccctttgcattgaagaggttgaagtagctccccccaaggctcatgaagttcgcattcagatcattgctacctctctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaaccgatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactatttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagcgtccgaacaatcctcatcttttgaagatgccaggagcaattcagaatactatctgattgaatgtgaacctgcctggttaatttatta

SEQ ID NO: 106243 - DNA, 1340 bp, Homo sapiens
  Payload ID: 869
  Gene Symbol: ADH4
  Gene Name: alcohol dehydrogenase 4 (class II), pi polypeptide
  ENST ID: ENST00000506705
  CDS Start-End: 138-248
tttgaagctttcttaactcagaaagaaacttccaacacagtttcccaaagaaaaatgggcaccaagggcaaaattttgatttagtggatttgaggcagggctttcatctctaacaaattcccaagtgatgtgaataaatgcttgtccgaggaccacacttcgagttgcagagatgtaaaacacatctattctccagcaattatctgactcagagggaaaaacttgagacattatatcaaggttattaaatgcaaagcagccatcgcctgggaagcaggcaagcccctttgcattgaagaggttgaagtagctccccccaaggctcatgaagttcgcattcagatcattgctacctctctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaaccgatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactatttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaag

SEQ ID NO: 106244 - DNA, 489 bp, Homo sapiens
  Payload ID: 869
  Gene Symbol: ADH4
  Gene Name: alcohol dehydrogenase 4 (class II), pi polypeptide
  ENST ID: ENST00000504894
  CDS Start-End: 137-247
acggaactccctgggtaggagtttgaagctttcttaactcagaaagaaacttccaacacagtttcccaaagaaaaatgggcaccaagggcaaagcagggctttcatctctaacaaattcccaagtgatgtgaataaatgcttgtccgaggaccacacttcgagttgcagagatgtaaaacacatctattctccagcaattatctgactcagagggaaaaacttgagacattatatcaaggttattaaatgcaaagcagccatcgcctgggaagcaggcaagcccctttgcattgaagaggttgaagtagctccccccaaggctcatgaagttcgcattcagatcattgctacctctctgtgccatactgatgccactgttatcgattctaaatttgagggcctagctttcccagtgatcgttggccatgaggctgcaggtattgtggaaagtattgggccaggagtgaccaacgtcaaaccaggtgaca

SEQ ID NO: 106245 - DNA, 665 bp, Homo sapiens
  Payload ID: 869
  Gene Symbol: ADH4
  Gene Name: alcohol dehydrogenase 4 (class II), pi polypeptide
  ENST ID: ENST00000504125
  CDS Start-End: 47-665
tttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctctctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcaggtttacctgcaaaggaaaaccagtttaccatttctttggaaccagtacattctctcagtacactgtggtgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaa

SEQ ID NO: 106246 - DNA, 1974 bp, Homo sapiens
  Payload ID: 869
  Gene Symbol: ADH4
  Gene Name: alcohol dehydrogenase 4 (class II), pi polypeptide
  ENST ID: ENST00000629236
  CDS Start-End: 60-1235
aggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctctctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaaccgatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactatttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagcgtccgaacaatcctcatctttagatgccaggagcaattcagaatactatctgattgaatgtgaacctgcctggttaatttattacctgatttgatgaaccaaggaaagccatgagtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactggggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggagatg

SEQ ID NO: 106247 - DNA, 2615 bp, Homo sapiens
  Payload ID: 870
  Gene Symbol: ADH5
  Gene Name: alcohol dehydrogenase 5 (class III), chi polypeptide
  Uniprot ID: P11766
  ENST ID: ENST00000296412
  CDS Start-End: 52-1176
gcgcggcccaccccggatgtcagccccccgcgccgaccagaatccgtgaacatggcgaacgaggttatcaagtgcaaggctgcagttgcttgggaggctggaaagcctctctccatagaggagatagaggtggcacccccaaaggctcatgaagttcgaatcaagatcattgccactgcggtttgccacaccgatgcctataccctgagtggagctgatcctgagggttgttttccagtgatcttgggacatgaaggtgctggaattgtggaaagtgttggtgagggagttactaagctgaaggcgggtgacactgtcatcccactttacatcccacagtgtggagaatgcaaattttgtctaaatcctaaaactaacctttgccagaagataagagtcactcaagggaaaggattaatgccagatggtaccagcagatttacttgcaaaggaaagacaattttgcattacatgggaaccagcacattttctgaatacacagttgtggctgatatctctgttgctaaaatagatcctttagcacctttggataaagtctgccttctaggttgtggcatttcaaccggttatggtgctgctgtgaacactgccaagttggagcctggctctgtttgtgccgtctttggtctgggaggagtcggattggcagttatcatgggctgtaaagtggctggtgcttcccggatcattggtgtggacatcaataaagataaatttgcaagggccaaagagtttggagccactgaatgtattaaccctcaggattttagtaaacccatccaggaagtgctcattgagatgaccgatggaggagtggactattcctttgaatgtattggtaatgtgaaggtcatgagagcagcacttgaggcatgtcacaagggctggggcgtcagcgtcgtggttggagtagctgcttcaggtgaagaaattgccactcgtccattccagctggtaacaggtcgcacatggaaaggcactgcctttggaggatggaagagtgtagaaagtgtcccaaagttggtgtctgaatatatgtccaaaaagataaaagttgatgaatttgtgactcacaatctgtcttttgatgaaatcaacaaagcctttgaactgatgcattctggaaagagcattcgaactgttgtaaagatttaattcaaaagagaaaaataatgtccatcctgtcgtgatgtgataggagcagcttaacaggcagggagaagcgcctccaacctcacagcctcgtagagcttcacagctactccagaaaatagggttatgtgtgtcattcatgaatctctataatcaaggacaaggataattcagtcatgaacctgttttctggatgctcctccacataaataattgctagtttattaaggaatattttaacataataaaagtaatttctacatttgtgtggaaattgtcttgttttatgctgtcatcattgtcacggtttgtctgcccattatcttcattctgcaagggaaagggaaaggaagcagggcagtggtgggtgtctgaaacctcagaaacataacgttgaacttttaagggtctcagtccccgttgattaaagaacagatcctagccatcagtgacaaagttaatcaggacccaagtctgcttctgtgatattatcttgaagggaggtactgtgccttgttcatacctgtaccccaaattcctaggatggcatctgcccttcagggggcactaaaatgtattattgaaacagcattctgggcttaaataggtgtatgtatgtgttggttgtgactgtactatttctagtatagtgaactacatactgaatatccaagttctcagcacctacttttgtcaaatcttaacattttgccacttcgagatcacattgccattcctcccctccagaggtaacaattatccacaatttgatgtttatcattcctgtgttgttgtactttcactgtgtataacctaaaccatctactctttagtactgttttatatatttttaagcctcatacttgctcattctacagcttttttcactcattattgtataattatatctgaagctctcgttcattaattttagtcctgtgtagcagaattcaattacgggaactaccataatttatctgttctccagttgaaggcatgaagttgttgccagtttctgtattataacactgtagtggaacattcttctgcattgggctcactgcgtgttacctaagacgtatcacagaataaacacatttagccttatagacattgccaaattgctcttcaaagtaaatgtgagtttttgtgaattacatgagtatggaatggtgttttattatgactttagtttgcattttcctcaattctcgttaaatccttcattctaatggacattttattgtgaagaacctgttcatatcctgtgctcaactttgtattgaattatttttctctgaataatttttaggagttcttttattctagacatcaatcatttgtcagttttatatgttgcaaatatcttctagtctatcttgtgacttttctttttactttatggtattttgttgaataaagttttaatgtagtcacataaa

SEQ ID NO: 106248 - DNA, 623 bp, Homo sapiens
  Payload ID: 870
  Gene Symbol: ADH5
  Gene Name: alcohol dehydrogenase 5 (class III), chi polypeptide
  ENST ID: ENST00000505652
  CDS Start-End: 37-384
gatgtcagccccccgcgccgaccagaatccgtgaacatggcgaacgaggttatcaagtgcaaggctgcagttgcttgggaggctggaaagcctctctccatagaggagatagaggtggcacccccaaaggctcatgaagttcgaatcaagatcattgccactgcggtttgccacaccgatgcctataccctgagtggagctgatcctgagggttgttttccagtgatcttgggacatgaaggtgctggaattgtggaaagtgttggtgagggagttactaagctgaaggcgggtgacactgtcatcccactttacatcccacagtgtggagaatgcaaattttgtctaaatcctaaaactaacctttgccagaagataagataaaagagaaactaaaggggtgtgcccagtatcaccagccgttaagatataaaacagaattttctgtacccattctcttcacataacagcaggctaaatttgccaaaccatgtagtaaggaaagacgtgcttctgagattaaacgaaatcatttttatgaaccactgcccaagtcactcaagggaaaggattaatgccagatggtaccagcagatttacttgcaaaggaaagacaattttgc

SEQ ID NO: 106249 - DNA, 697 bp, Homo sapiens
  Payload ID: 870
  Gene Symbol: ADH5
  Gene Name: alcohol dehydrogenase 5 (class III), chi polypeptide
  ENST ID: ENST00000502590
  CDS Start-End: 5-292
gaacatggcgaacgaggttatcaagtgcaaggctgcagttgcttgggaggctggaaagcctctctccatagaggagatagaggtggcacccccaaaggctcatgaagttcgaatcaagatcattgccactgcggtttgccacaccgatgcctataccctgagtggagctgatcctgagggttgttttccagtgatcttgggacatgaaggtgctggaattgtggaaagtgttggtgagggagttactaagctgaaggcggtgtggagaatgcaaattttgtctaaatcctaaaactaacctttgccagaagataagagtcactcaagggaaaggattaatgccagatggtaccagcagatttacttgcaaaggaaagacaattttgcattacatgggaaccagcacattttctgaatacacagttgtggctgatatctctgttgctaaaatagatcctttagcacctttggataaagtctgccttctaggttgtggcatttcaaccggttatggtgctgctgtgaacactgccaagttggagcctggctctgtttgtgccgtctttggtctgggaggagtcggattggcagttatcatgggctgtaaagtggctggtgcttcccggatcattggtgtggacatcaataaagataaatttgcaagggccaaagagtttggagccactgaatgtattaa

SEQ ID NO: 106250 - DNA, 822 bp, Homo sapiens
  Payload ID: 870
  Gene Symbol: ADH5
  Gene Name: alcohol dehydrogenase 5 (class III), chi polypeptide
  ENST ID: ENST00000512659
  CDS Start-End: 3-173
acatggcgaacgaggttatcaagtgcaaggctgcagttgcttgggaggctggaaagcctctctccatagaggagatagaggtggcacccccaaaggctcatgaagttcgaatcaaggtgacactgtcatcccactttacatcccacagtgtggagaatgcaaattttgtctaaatcctaaaactaacctttgccagaagataagagtcactcaagggaaaggattaatgccagatggtaccagcagatttacttgcaaaggaaagacaattttgcattacatgggaaccagcacattttctgaatacacagttgtggctgatatctctgttgctaaaatagatcctttagcacctttggataaagtctgccttctaggttgtggcatttcaaccggttatggtgctgctgtgaacactgccaagttggagcctggctctgtttgtgccgtctttggtctgggaggagtcggattggcagttatcatgggctgtaaagtggctggtgcttcccggatcattggtgtggacatcaataaagataaatttgcaagggccaaagagtttggagccactgaatgtattaaccctcaggattttagtaaacccatccaggaagtgctcattgagatgaccgatggaggagtggactattcctttgaatgtattggtaatgtgaaggtcatgagagcagcacttgaggcatgtcacaagggctggggcgtcagcgtcgtggttggagtagctgcttcaggtgaagaaattgccactcgtccattccagctggtaacaggtcgcacatggaaaggcactgcctttggagg

SEQ ID NO: 106251 - DNA, 545 bp, Homo sapiens
  Payload ID: 870
  Gene Symbol: ADH5
  Gene Name: alcohol dehydrogenase 5 (class III), chi polypeptide
  ENST ID: ENST00000502386
  CDS Start-End: 14-61
agaatccgtgaacatggcgaacgagttttgcaccaagccggtggtattcagaacagcctgagcaaaagaatttcttcaggcatatgttaagcatgcagatttcttggaccccatgccagacctgctgaatcagattctctcggaacttgtgttcttaacctgcttttgcatatgcactgtagaaggccattaaatatttgatgagtacaactttttaaccaaaagatacttttctatctgaccaggttatcaagtgcaaggctgcagttgcttgggaggctggaaagcctctctccatagaggagatagaggtggcacccccaaaggctcatgaagttcgaatcaagatcattgccactgcggtttgccacaccgatgcctataccctgagtggagctgatcctgagggttgttttccagtgatcttgggacatgaaggtgctggaattgtggaaagtgttggtgagggagttactaagctgaaggcgggtaaggagaatacttgaaccacttgtttaataattttggcttattcctatggggaa

SEQ ID NO: 106252 - DNA, 786 bp, Homo sapiens
  Payload ID: 870
  Gene Symbol: ADH5
  Gene Name: alcohol dehydrogenase 5 (class III), chi polypeptide
  ENST ID: ENST00000503130
  CDS Start-End: 1-786
gttatcaagtgcaaggctgcagttgcttgggaggctggaaagcctctctccatagaggagatagaggtggcacccccaaaggctcatgaagttcgaatcaagatcattgccactgcggtttgccacaccgatgcctataccctgagtggagctgatcctgagggttgttttccagtgatcttgggacatgaaggtgctggaattgtggaaagtgttggtgacactgtcatcccactttacatcccacagtgtggagaatgcaaattttgtctaaatcctaaaactaacctttgccagaagataagagtcactcaagggaaaggattaatgccagatggtaccagcagatttacttgcaaaggaaagacaattttgcattacatgggaaccagcacattttctgaatacacagttgtggctgatatctctgttgctaaaatagatcctttagcacctttggataaagtctgccttctaggttgtggcatttcaaccggttatggtgctgctgtgaacactgccaagttggagcctggctctgtttgtgccgtctttggtctgggaggagtcggattggcagttatcatgggctgtaaagtggctggtgcttcccggatcattggtgtggacatcaataaagataaatttgcaagggccaaagagtttggagccactgaatgtattaaccctcaggattttagtaaacccatccaggaagtgctcattgagatgaccgatggaggagtggactattcctttgaatgtattggtaatgtgaaggtcatg

SEQ ID NO: 106253 - DNA, 1299 bp, Homo sapiens
  Payload ID: 870
  Gene Symbol: ADH5
  Gene Name: alcohol dehydrogenase 5 (class III), chi polypeptide
  ENST ID: ENST00000626055
  CDS Start-End: 52-222
gcgcggcccaccccggatgtcagccccccgcgccgaccagaatccgtgaacatggcgaacgaggttatcaagtgcaaggctgcagttgcttgggaggctggaaagcctctctccatagaggagatagaggtggcacccccaaaggctcatgaagttcgaatcaaggtgacactgtcatcccactttacatcccacagtgtggagaatgcaaattttgtctaaatcctaaaactaacctttgccagaagataagagtcactcaagggaaaggattaatgccagatggtaccagcagatttacttgcaaaggaaagacaattttgcattacatgggaaccagcacattttctgaatacacagttgtggctgatatctctgttgctaaaatagatcctttagcacctttggataaagtctgccttctaggttgtggcatttcaaccggttatggtgctgctgtgaacactgccaagttggagcctggctctgtttgtgccgtctttggtctgggaggagtcggattggcagttatcatgggctgtaaagtggctggtgcttcccggatcattggtgtggacatcaataaagataaatttgcaagggccaaagagtttggagccactgaatgtattaaccctcaggattttagtaaacccatccaggaagtgctcattgagatgaccgatggaggagtggactattcctttgaatgtattggtaatgtgaaggtcatgagagcagcacttgaggcatgtcacaagggctggggcgtcagcgtcgtggttggagtagctgcttcaggtgaagaaattgccactcgtccattccagctggtaacaggtcgcacatggaaaggcactgcctttggaggatggaagagtgtagaaagtgtcccaaagttggtgtctgaatatatgtccaaaaagataaaagttgatgaatttgtgactcacaatctgtcttttgatgaaatcaacaaagcctttgaactgatgcattctggaaagagcattcgaactgttgtaaagatttaattcaaaagagaaaaataatgtccatcctgtcgtgatgtgataggagcagcttaacaggcagggagaagcgcctccaacctcacagcctcgtagagcttcacagctactccagaaaatagggttatgtgtgtcattcatgaatctctataatcaaggacaaggataattcagtcatgaacctgttttctggatgctcctccacataaataattgctagtttattaaggaatattttaacataataaaagtaatttctacatttgtg

SEQ ID NO: 106254 - DNA, 1691 bp, Homo sapiens
  Payload ID: 871
  Gene Symbol: ADH6
  Gene Name: alcohol dehydrogenase 6 (class V)
  Uniprot ID: P28332
  ENST ID: ENST00000237653
  CDS Start-End: 386-1492
tgtattttgaaaacaacagaaaagaaatacttttgtacactctgttagaaattttaagtttggacatttaaaagtccaaatttaaaactcaaaaaaatggataataagaggggacctgtttgattaagggagaaaaaaatagtttgcattttcaccttttgtgctctttcactgagatgagcctatttcagattacacttaggaacttccatcaagcagcgggagagcctacttttcctgtttaataattaccagactacagagaaagctcaggacccagccttctgatctaccagtcgcctgtgtacctttgtactttctacagtgaaagttgctacaggatctccctttctcaataaattcatctgcggtggagaaaatcagcatgagtactacaggccaagtcatcagatgcaaagcagccatactctggaagcctggtgcaccattttctattgaagaggtagaagtggccccaccaaaggcaaaggaagttcgcataaaggttgtggccaccggactgtgtggtacagagatgaaagtgttggggagtaaacacttggacctcttgtatcccaccatcttgggccatgaaggggctggaatcgttgagagtattggagaaggagtaagcacagtgaaaccaggtgacaaagttatcacactctttctgccacagtgtggagaatgtacctcttgcctgaattctgagggcaatttttgtatacaattcaaacagtcaaaaacccaactgatgtctgatggtaccagcaggtttacctgcaagggaaaatcaatatatcactttggtaataccagcaccttctgtgaatacacagtgataaaggaaatctcagttgccaagattgatgcagtcgctcctctagagaaagtatgcctaattagctgtggcttttccactgggtttggtgctgcaatcaatactgccaaggtgactccaggttctacctgtgctgtgtttggcctgggaggagtcggcttgtctgttgtcatgggttgtaaagcagcaggagcagccaggatcattggagtggatgtcaacaaggagaaatttaagaaggcacaggaattgggtgctactgagtgcctcaaccctcaggacttaaagaaacccattcaagaagttttatttgatatgacagatgctggtatagacttctgctttgaggccattggaaatctggacgttctggcagctgccctcgcctcctgcaatgagagctatggggtctgtgtggttgttggggtgttgcctgccagtgttcaactcaaaatcagtggccagttgttcttctcaggacgttctttgaagggttctgtttttggaggctggaagagcagacagcacatccctaaactggttgctgattatatggcagagaagttgaatctagatccactaattactcatactctgaatcttgataaaatcaatgaagcagttgaattaatgaaaactggaaaatggtaaactgcccacataaattttatgtctgtgtgtttgagaccaagagaaagggtgtattggcttgggagtagaagaagggtcgtccctgctgcagaagctgtatactgataattgaagaggctttcaggaatttgtaaagcatctccttcccctctgcattttgttttatttctagctaataaaatacataatcctgaaagta

SEQ ID NO: 106255 - DNA, 3337 bp, Homo sapiens
  Payload ID: 871
  Gene Symbol: ADH6
  Gene Name: alcohol dehydrogenase 6 (class V)
  ENST ID: ENST00000394897
  CDS Start-End: 84-971
gtgtacctttgtactttctacagtgaaagttgctacaggatctccctttctcaataaattcatctgcggtggagaaaatcagcatgagtactacaggccaagtcatcagatgcaaagcagccatactctggaagcctggtgcaccattttctattgaagaggtagaagtggccccaccaaaggcaaaggaagttcgcataaaggttgtggccaccggactgtgtggtacagagatgaaagtgttggggagtaaacacttggacctcttgtatcccaccatcttgggccatgaaggggctggaatcgttgagagtattggagaaggagtaagcacagtgaaaccaggtgacaaagttatcacactctttctgccacagtgtggagaatgtacctcttgcctgaattctgagggcaatttttgtatacaattcaaacagtcaaaaacccaactgatgtctgatggtaccagcaggtttacctgcaagggaaaatcaatatatcactttggtaataccagcaccttctgtgaatacacagtgataaaggaaatctcagttgccaagattgatgcagtcgctcctctagagaaagtatgcctaattagctgtggcttttccactgggtttggtgctgcaatcaatactgccaaggtgactccaggttctacctgtgctgtgtttggcctgggaggagtcggcttgtctgttgtcatgggttgtaaagcagcaggagcagccaggatcattggagtggatgtcaacaaggagaaatttaagaaggcacaggaattgggtgctactgagtgcctcaaccctcaggacttaaagaaacccattcaagaagttttatttgatatgacagatgctggtatagacttctgctttgaggccattggaaatctggacgttctggctggaagagcagacagcacatccctaaactggttgctgattatatggcagagaagttgaatctagatccactaattactcatactctgaatcttgataaaatcaatgaagcagttgaattaatgaaaactggaaaatggtaaactgcccacataaattttatgtctgtgtgtttgagaccaagagaaagggtgtattggcttgggagtagaagaagggtcgtccctgctgcagaagctgtatactgataattgaagaggctttcaggaatttgtaaagcatctccttcccctctgcattttgttttatttctagctaataaaatacataatcctgaaagtatttaagtgttcacctaccgttacttttgccattagcattgtatttccaatatggattttttttttacatgacatattaatggaagtcagcttataaaattgtagctcaagtttaaaaacataagaaggtagttcacaaataggccattgttgtatttgttgttctactttgggggagaagaggaattattcataggattcctaattctgaatcctatctttgacccaaaaaacagaaaccagccataacccagaaactggcattccccacacgagtataagcttgcttacctactttttacccttggagtttcatgtcattttaaaaaatcttcccatggcttatttaatcttctcatttttcacctaaagagaaaaaaaatctagtttactgctctacaaagtgagaatttgaaatccaaaacacaaatgttgctctaaaaatgttccaaccttttttctcttcttctttttttcagtatccgctgtatcctgttactttaagtacaatgtaatacatgcaagacccaaaggatatttcaccaactcaatggcatttgatgtaattttcatgatttagaagaattattcacccaatcccatttctatattctgacttctgattcactccgcagtggacctatatctggcttctgacctaaccatttcatcaaaattgttcttacgtaacccagtgtcaccaaggatcagcctccttttcagagctagattaaggttggcttgaatcactcaactccacatccttcagacataaaaggtcaatgcaagatgctcccattttcatagttcctctacctgtggacctttatattcttgtacactatatgtctctctcacaggcctagacatgaaactctgccattttactctaaagaaacaaaactccgcattaatgagtttattgaagattcaggttaacctgaatcaagttaacccagtctcaaatgctcacttatcctatctccttggcacaaatctctcctctcctggattgccaaagaaaattcaaattattcttcaattagtcaggatgatttgactatcagcagttcatagtacccatcttcataactaagccacctagggatccagcagaaaaaaaagggatgaggggagtcatcatacaggaggtggatcatttagcaggatccacacttcctacaaagcggttgtaatattaaataacaaaactgttttttattccaatcttcacataaaacaggaataattgtatactttcttactaatgtgttccatggagtttttcctccaagaagtggcttaggggaaaatgagccccagtaatgctttgtggcatccaatccttctaccccgaccctttgactttctgccccagcccctcttagttctcctagaattaggactaaggttaagtgccctcttgggatatgacttccttcccttcctcttgatacaaaaagagcctattaccaaccctcatacacacaagagttcccttcctagttgcagactcttctgctccagctggactcccctagctctggactcccactagatcacacaggggtccctgcatgtcagtaaactttggatgaccttgggagaccaaaaaatggaatatcattttttgatctaaacaaaatagtttcctgatttaacactggccaggaaggtgggctgcaccctcagtctctctctcccatcatggttttcacatgatatcaaaggactctcataacagtctgattcttatgagttgggcatcctgtgtttccctttaggggcctgcttccttcaaatagaggagatgggtgctatgaaacctattcactctggacttgggatggctcttctccatcttcccaagtctgagctggagcctccatgcccaactctgctctgctcttctatttcctgacagcagctaaggcatgttcctgttctgcccccaaattgaccttactaacagtgagaacttggaggagtcttcgggtcttgggaaatccaagttttcccggaaacgttttgttgtaaacagtgtccacactctttgctccaataaagctcggttccttaagccac

SEQ ID NO: 106256 - DNA, 2802 bp, Homo sapiens
  Payload ID: 871
  Gene Symbol: ADH6
  Gene Name: alcohol dehydrogenase 6 (class V)
  ENST ID: ENST00000394899
  CDS Start-End: 95-1222
accagtcgcctgtgtacctttgtactttctacagtgaaagttgctacaggatctccctttctcaataaattcatctgcggtggagaaaatcagcatgagtactacaggccaagtcatcagatgcaaagcagccatactctggaagcctggtgcaccattttctattgaagaggtagaagtggccccaccaaaggcaaaggaagttcgcataaaggttgtggccaccggactgtgtggtacagagatgaaagtgttggggagtaaacacttggacctcttgtatcccaccatcttgggccatgaaggggctggaatcgttgagagtattggagaaggagtaagcacagtgaaaccaggtgacaaagttatcacactctttctgccacagtgtggagaatgtacctcttgcctgaattctgagggcaatttttgtatacaattcaaacagtcaaaaacccaactgatgtctgatggtaccagcaggtttacctgcaagggaaaatcaatatatcactttggtaataccagcaccttctgtgaatacacagtgataaaggaaatctcagttgccaagattgatgcagtcgctcctctagagaaagtatgcctaattagctgtggcttttccactgggtttggtgctgcaatcaatactgccaaggtgactccaggttctacctgtgctgtgtttggcctgggaggagtcggcttgtctgttgtcatgggttgtaaagcagcaggagcagccaggatcattggagtggatgtcaacaaggagaaatttaagaaggcacaggaattgggtgctactgagtgcctcaaccctcaggacttaaagaaacccattcaagaagttttatttgatatgacagatgctggtatagacttctgctttgaggccattggaaatctggacgttctggcagctgccctcgcctcctgcaatgagagctatggggtctgtgtggttgttggggtgttgcctgccagtgttcaactcaaaatcagtggccagttgttcttctcaggacgttctttgaagggttctgtttttggaggctggaagagcagacagcacatccctaaactggttgctgattatatggcagagaagttgaatctagatccactaattactcatactctgaatcttgataaaatcaatgaagcagttgaattaatgaaaactggaaaatgtatccgctgtatcctgttactttaagtacaatgtaatacatgcaagacccaaaggatatttcaccaactcaatggcatttgatgtaattttcatgatttagaagaattattcacccaatcccatttctatattctgacttctgattcactccgcagtggacctatatctggcttctgacctaaccatttcatcaaaattgttcttacgtaacccagtgtcaccaaggatcagcctccttttcagagctagattaaggttggcttgaatcactcaactccacatccttcagacataaaaggtcaatgcaagatgctcccattttcatagttcctctacctgtggacctttatattcttgtacactatatgtctctctcacaggcctagacatgaaactctgccattttactctaaagaaacaaaactccgcattaatgagtttattgaagattcaggttaacctgaatcaagttaacccagtctcaaatgctcacttatcctatctccttggcacaaatctctcctctcctggattgccaaagaaaattcaaattattcttcaattagtcaggatgatttgactatcagcagttcatagtacccatcttcataactaagccacctagggatccagcagaaaaaaaagggatgaggggagtcatcatacaggaggtggatcatttagcaggatccacacttcctacaaagcggttgtaatattaaataacaaaactgttttttattccaatcttcacataaaacaggaataattgtatactttcttactaatgtgttccatggagtttttcctccaagaagtggcttaggggaaaatgagccccagtaatgctttgtggcatccaatccttctaccccgaccctttgactttctgccccagcccctcttagttctcctagaattaggactaaggttaagtgccctcttgggatatgacttccttcccttcctcttgatacaaaaagagcctattaccaaccctcatacacacaagagttcccttcctagttgcagactcttctgctccagctggactcccctagctctggactcccactagatcacacaggggtccctgcatgtcagtaaactttggatgaccttgggagaccaaaaaatggaatatcattttttgatctaaacaaaatagtttcctgatttaacactggccaggaaggtgggctgcaccctcagtctctctctcccatcatggttttcacatgatatcaaaggactctcataacagtctgattcttatgagttgggcatcctgtgtttccctttaggggcctgcttccttcaaatagaggagatgggtgctatgaaacctattcactctggacttgggatggctcttctccatcttcccaagtctgagctggagcctccatgcccaactctgctctgctcttctatttcctgacagcagctaaggcatgttcctgttctgcccccaaattgaccttactaacagtgagaacttggaggagtcttcgggtcttgggaaatccaagttttcccggaaacgttttgttgtaaacagtgtccacactctttgctccaataaagctcggttccttaagcca

SEQ ID NO: 106257 - DNA, 511 bp, Homo sapiens
  Payload ID: 871
  Gene Symbol: ADH6
  Gene Name: alcohol dehydrogenase 6 (class V)
  ENST ID: ENST00000512708
  CDS Start-End: 1-207
gagaaatttaagaaggcacaggaattgggtgctactgagtgcctcaaccctcaggacttaaagaaacccattcaagaagttttatttgatatgacagatgctggtatagacttctgctttgaggccattggaaatctggacgttctggctggaagagcagacagcacatccctaaactggttgctgattatatggcagagaagttgaatctagatccactaattactcatactctgaatcttgataaaatcaatgaagcagttgaattaatgaaaactggaaaatgtatccgctgtatcctgttactttaagtacaatgtaatacatgcaagacccaaaggatatttcaccaactcaatggcatttgatgtaattttcatgatttagaagaattattcacccaatcccatttctatattctgacttctgattcactccgcagtggacctatatctggcttctgacctaaccatttcatcaaaattgttcttacgtaacccagtgtcaccaa

SEQ ID NO: 106258 - DNA, 991 bp, Homo sapiens
  Payload ID: 871
  Gene Symbol: ADH6
  Gene Name: alcohol dehydrogenase 6 (class V)
  ENST ID: ENST00000507484
  CDS Start-End: 23-199
atctgcggtggagaaaatcagcatgagtactacaggccaagtcatcagatgcaaagcagccatactctggaagcctggtgcaccattttctattgaagaggtagaagtggccccaccaaaggcaaaggaagttcgcataaaggtgacaaagttatcacactctttctgccacagtgtggagaatgtacctcttgcctgaattctgagggcaatttttgtatacaattcaagtgactccaggttctacctgtgctgtgtttggcctgggaggagtcggcttgtctgttgtcatgggttgtaaagcagcaggagcagccaggatcattggagtggatgtcaacaaggagaaatttaagaaggcacaggaattgggtgctactgagtgcctcaaccctcaggacttaaagaaacccattcaagaagttttatttgatatgacagatgctggtatagacttctgctttgaggccattggaaatctggacgttctggcagctgccctcgcctcctgcaatgagagctatggggtctgtgtggttgttggggtgttgcctgccagtgttcaactcaaaatcagtggccagttgttcttctcaggacgttctttgaagggttctgtttttggaggctggaagagcagacagcacatccctaaactggttgctgattatatggcagagaagttgaatctagatccactaattactcatactctgaatcttgataaaatcaatgaagcagttgaattaatgaaaactggaaaatgtatccgctgtatcctgttactttaagtacaatgtaatacatgcaagacccaaaggatatttcaccaactcaatggcatttgatgtaattttcatgatttagaagaattattcacccaatcccatttctatattctgacttctgattcactccgcagtggacctatatctggcttctgacctaaccatttcatcaaaattgttcttacgtaacccagtgtcaccaa

SEQ ID NO: 106259 - DNA, 863 bp, Homo sapiens
  Payload ID: 871
  Gene Symbol: ADH6
  Gene Name: alcohol dehydrogenase 6 (class V)
  ENST ID: ENST00000508558
  CDS Start-End: 92-863
agtcgcctgtgtacctttgtactttctacagtgaaagttgctacaggatctccctttctcaataaattcatctgcggtggagaaaatcagcatgagtactacaggccaagtcatcagatgcaaagcagccatactctggaagcctggtgcaccattttctattgaagaggtagaagtggccccaccaaaggcaaaggaagttcgcataaaggttgtggccaccggactgtgtggtacagagatgaaagtgttggggagtaaacacttggacctcttgtatcccaccatcttgggccatgaaggggctggaatcgttgagagtattggagaaggagtaagcacagtgaaaccagtgataaaggaaatctcagttgccaagattgatgcagtcgctcctctagagaaagtatgcctaattagctgtggcttttccactgggtttggtgctgcaatcaatactgccaaggtgactccaggttctacctgtgctgtgtttggcctgggaggagtcggcttgtctgttgtcatgggttgtaaagcagcaggagcagccaggatcattggagtggatgtcaacaaggagaaatttaagaaggcacaggaattgggtgctactgagtgcctcaaccctcaggacttaaagaaacccattcaagaagttttatttgatatgacagatgctggtatagacttctgctttgaggccattggaaatctggacgttctggcagctgccctcgcctcctgcaatgagagctatggggtctgtgtggttgttggggtgttgcctgccagtgttcaactcaaaatcagtggccagttgttcttctcaggacgttctttgaagggttctgtttttggag

SEQ ID NO: 106260 - DNA, 2289 bp, Homo sapiens
  Payload ID: 872
  Gene Symbol: ADH7
  Gene Name: alcohol dehydrogenase 7 (class IV), mu or sigma polypeptide
  Uniprot ID: P40394
  ENST ID: ENST00000209665
  CDS Start-End: 242-1402
tttcaatagctttgattatcttgtttttgttagatccctcctcttggtttgatcatagtagttactgtatttctttttataagttggtctgcaaagggtagggcttgcagaccattgcaaagttgtgacggctgtgagtcatattgctgaaggtggaactctgaagccagactatctatgtgaaggcacaagctgctgttatatacaacagagtgaactgagcatcagtcagaaaaagtctatgtttgcagaaatacagatccaagacaaagacaggatgggcactgctggaaaagttattaaatgcaaagcagctgtgctttgggagcagaagcaacccttctccattgaggaaatagaagttgccccaccaaagactaaagaagttcgcattaagattttggccacaggaatctgtcgcacagatgaccatgtgataaaaggaacaatggtgtccaagtttccagtgattgtgggacatgaggcaactgggattgtagagagcattggagaaggagtgactacagtgaaaccaggtgacaaagtcatccctctctttctgccacaatgtagagaatgcaatgcttgtcgcaacccagatggcaacctttgcattaggagcgatattactggtcgtggagtactggctgatggcaccaccagatttacatgcaagggcaaaccagtccaccacttcatgaacaccagtacatttaccgagtacacagtggtggatgaatcttctgttgctaagattgatgatgcagctcctcctgagaaagtctgtttaattggctgtgggttttccactggatatggcgctgctgttaaaactggcaaggtcaaacctggttccacttgcgtcgtctttggcctgggaggagttggcctgtcagtcatcatgggctgtaagtcagctggtgcatctaggatcattgggattgacctcaacaaagacaaatttgagaaggccatggctgtaggtgccactgagtgtatcagtcccaaggactctaccaaacccatcagtgaggtgctgtcagaaatgacaggcaacaacgtgggatacacctttgaagttattgggcatcttgaaaccatgattgatgccctggcatcctgccacatgaactatgggaccagcgtggttgtaggagttcctccatcagccaagatgctcacctatgacccgatgttgctcttcactggacgcacatggaagggatgtgtctttggaggtttgaaaagcagagatgatgtcccaaaactagtgactgagttcctggcaaagaaatttgacctggaccagttgataactcatgttttaccatttaaaaaaatcagtgaaggatttgagctgctcaattcaggacaaagcattcgaacggtcctgacgttttgagatccaaagtggcaggaggtctgtgttgtcatggtgaactggagtttctcttgtgagagttccctcatctgaaatcatgtatctgtctcacaaatacaagcataagtagaagatttgttgaagacatagaacccttataaagaattattaacctttataaacatttaaagtcttgtgagcacctgggaattagtataataacaatgttaatatttttgatttacattttgtaaggctataattgtatcttttaagaaaacatacacttggatttctatgttgaaatggagatttttaagagttttaaccagctgctgcagatatataactcaaaacagatatagcgtataaagatatagtaaatgcatctcctagagtaatattcacttaacacattgaaactattattttttagatttgaatataaatgtattttttaaacacttgttatgagttaagttggattacattttgaaatcagttcattccatgatgcatattactggattagattaagaaagacagaaaagattaagggacgggcacatttttcaacgattaagaatcatcattacataacttggtgaaactgaaaaagtatatcatatgggtacacaaggctatttgccagcatatattaatattttagaaaatattccttttgtaatactgaatataaacatagagctagaatcatattatcatacttatcataatgttcaatttgatacagtagaattgcaagtccctaagtccctattcactgtgcttagtagtgactccatttaataaaaagtgtttttagtttttaacaactacactgatgtatctatatatatctataacatgttaaaaattcttaagaaaattaaaaattatataaaatg

SEQ ID NO: 106261 - DNA, 2516 bp, Homo sapiens
  Payload ID: 872
  Gene Symbol: ADH7
  Gene Name: alcohol dehydrogenase 7 (class IV), mu or sigma polypeptide
  ENST ID: ENST00000437033
  CDS Start-End: 505-1629
ctgttttcatttatatttaattccagaaaccacatcaagtctttgcagaatgaagtagagcattaagaagtagagatgtacacacgcatctctaaaatcagccatgcctaggcaaagcagcttgcacttaaacacccaatacatttttcatgattgtgttgaagtgaagtaacctaacccgtttttatatccttcaaaataaggtggataggaatgctttcagcccttttcaatagctttgattatcttgtttttgttagatccctcctcttggtttgatcatagtagttactgtatttctttttataagttggtctgcaaagggtagggcttgcagaccattgcaaagttgtgacggctgtgagtcatattgctgaaggtggaactctgaagccagactatctatgtgaaggcacaagctgctgttatatacaacagagtgaactgagcatcagtcagaaaaagtctatgtttgcagaaatacagatccaagacaaagacaggatgggcactgctggaaaagttattaaatgcaaagcagctgtgctttgggagcagaagcaacccttctccattgaggaaatagaagttgccccaccaaagactaaagaagttcgcattaagattttggccacaggaatctgtcgcacagatgaccatgtgataaaaggaacaatggtgtccaagtttccagtgattgtgggacatgaggcaactgggattgtagagagcattggagaaggagtgactacagtgaaaccaggtgacaaagtcatccctctctttctgccacaatgtagagaatgcaatgcttgtcgcaacccagatggcaacctttgcattaggagcgatattactggtcgtggagtactggctgatggcaccaccagatttacatgcaagggcaaaccagtccaccacttcatgaacaccagtacatttaccgagtacacagtggtggatgaatcttctgttgctaagattgatgatgcagctcctcctgagaaagtctgtttaattggctgtgggttttccactggatatggcgctgctgttaaaactggcaaggtcaaacctggttccacttgcgtcgtctttggcctgggaggagttggcctgtcagtcatcatgggctgtaagtcagctggtgcatctaggatcattgggattgacctcaacaaagacaaatttgagaaggccatggctgtaggtgccactgagtgtatcagtcccaaggactctaccaaacccatcagtgaggtgctgtcagaaatgacaggcaacaacgtgggatacacctttgaagttattgggcatcttgaaaccatgattgatgccctggcatcctgccacatgaactatgggaccagcgtggttgtaggagttcctccatcagccaagatgctcacctatgacccgatgttgctcttcactggacgcacatggaagggatgtgtctttggaggtttgaaaagcagagatgatgtcccaaaactagtgactgagttcctggcaaagaaatttgacctggaccagttgataactcatgttttaccatttaaaaaaatcagtgaaggatttgagctgctcaattcaggacaaagcattcgaacggtcctgacgttttgagatccaaagtggcaggaggtctgtgttgtcatggtgaactggagtttctcttgtgagagttccctcatctgaaatcatgtatctgtctcacaaatacaagcataagtagaagatttgttgaagacatagaacccttataaagaattattaacctttataaacatttaaagtcttgtgagcacctgggaattagtataataacaatgttaatatttttgatttacattttgtaaggctataattgtatcttttaagaaaacatacacttggatttctatgttgaaatggagatttttaagagttttaaccagctgctgcagatatataactcaaaacagatatagcgtataaagatatagtaaatgcatctcctagagtaatattcacttaacacattgaaactattattttttagatttgaatataaatgtattttttaaacacttgttatgagttaagttggattacattttgaaatcagttcattccatgatgcatattactggattagattaagaaagacagaaaagattaagggacgggcacatttttcaacgattaagaatcatcattacataacttggtgaaactgaaaaagtatatcatatgggtacacaaggctatttgccagcatatattaatattttagaaaatattccttttgtaatactgaatataaacatagagctagaatcatattatcatacttatcataatgttcaatttgatacagtagaattgcaagtccctaagtccctattcactgtgcttagtagtgactccatttaataaaaagtgtttttagtttttaacaactacactgatgtatctatatatatctataacatgttaaaaattcttaagaaaattaaaaattatataaaatg

SEQ ID NO: 106262 - DNA, 1325 bp, Homo sapiens
  Payload ID: 872
  Gene Symbol: ADH7
  Gene Name: alcohol dehydrogenase 7 (class IV), mu or sigma polypeptide
  Uniprot ID: P40394
  ENST ID: ENST00000476959
  CDS Start-End: 31-1215
aattaaacacttggagatattccttgaggaatgaaatgcttggtgagcaggcatacagtgagggaaacactggatatggtgtttcagagaatgtcagtggaagcaggggttattaaatgcaaagcagctgtgctttgggagcagaagcaacccttctccattgaggaaatagaagttgccccaccaaagactaaagaagttcgcattaagattttggccacaggaatctgtcgcacagatgaccatgtgataaaaggaacaatggtgtccaagtttccagtgattgtgggacatgaggcaactgggattgtagagagcattggagaaggagtgactacagtgaaaccaggtgacaaagtcatccctctctttctgccacaatgtagagaatgcaatgcttgtcgcaacccagatggcaacctttgcattaggagcgatattactggtcgtggagtactggctgatggcaccaccagatttacatgcaagggcaaaccagtccaccacttcatgaacaccagtacatttaccgagtacacagtggtggatgaatcttctgttgctaagattgatgatgcagctcctcctgagaaagtctgtttaattggctgtgggttttccactggatatggcgctgctgttaaaactggcaaggtcaaacctggttccacttgcgtcgtctttggcctgggaggagttggcctgtcagtcatcatgggctgtaagtcagctggtgcatctaggatcattgggattgacctcaacaaagacaaatttgagaaggccatggctgtaggtgccactgagtgtatcagtcccaaggactctaccaaacccatcagtgaggtgctgtcagaaatgacaggcaacaacgtgggatacacctttgaagttattgggcatcttgaaaccatgattgatgccctggcatcctgccacatgaactatgggaccagcgtggttgtaggagttcctccatcagccaagatgctcacctatgacccgatgttgctcttcactggacgcacatggaagggatgtgtctttggaggtttgaaaagcagagatgatgtcccaaaactagtgactgagttcctggcaaagaaatttgacctggaccagttgataactcatgttttaccatttaaaaaaatcagtgaaggatttgagctgctcaattcaggacaaagcattcgaacggtcctgacgttttgagatccaaagtggcaggaggtctgtgttgtcatggtgaactggagtttctcttgtgagagttccctcatctgaaatcatgtatctgtctcacaaatacaagcataagtaga

SEQ ID NO: 106263 - DNA, 589 bp, Homo sapiens
  Payload ID: 872
  Gene Symbol: ADH7
  Gene Name: alcohol dehydrogenase 7 (class IV), mu or sigma polypeptide
  ENST ID: ENST00000474027
  CDS Start-End: 267-589
aagctttaacctgcctatcaagccctaccaggtgcaagaactgggctaggtgcaaatgggatgcagagatgcagacacaaattcaatcatccaggaactcacagtcataatctgttattaaatgcaaagcagctgtgctttgggagcagaagcaacccttctccattgaggaaatagaagttgccccaccaaagactaaagaagttcgcattaagattttggccacaggaatctgtcgcacagatgaccatgtgataaaaggaacaatggtgtccaagtttccagtgattgtgggacatgaggcaactgggattgtagagagcattggagaaggagtgactacagtgaaaccaggtgacaaagtcatccctctctttctgccacaatgtagagaatgcaatgcttgtcgcaacccagatggcaacctttgcattaggagcgatattactggtcgtggagtactggctgatggcaccaccagatttacatgcaagggcaaaccagtccaccacttcatgaacaccagtacatttaccgagtacacagtggtggatgaatcttctgttgctaagattgatgatgcagctcc

SEQ ID NO: 106264 - DNA, 1420 bp, Homo sapiens
  Payload ID: 872
  Gene Symbol: ADH7
  Gene Name: alcohol dehydrogenase 7 (class IV), mu or sigma polypeptide
  ENST ID: ENST00000482593
  CDS Start-End: 325-1278
gtctatgtttgcagaaatacagatccaagacaaagacaggatgggcactgctggaaaattttttccataggtcctttgcctgctatgtatctcccaggatgtaagtgtggtatgtggaagtgggaaggagtgttaggagtgaagttgttaacacttcctctgtaaatttgagttattaaatgcaaagcagctgtgctttgggagcagaagcaacccttctccattgaggaaatagaagttgccccaccaaagactaaagaagttcgcattaagattttggccacaggaatctgtcgcacagatgaccatgtgataaaaggaacaatggtgtccaagtttccagtgattgtgggacatgaggcaactgggattgtagagagcattggagaaggagtgactacagtgaaaccaggtgacaaagtcatccctctctttctgccacaatgtagagaatgcaatgcttgtcgcaacccagatggcaacctttgcattaggagcgatattactggtcgtggagtactggctgatggcaccaccagatttacatgcaagggcaaaccagtccaccacttcatgaacaccagtacatttaccgagtacacagtggtggatgaatcttctgttgctaagattgatgatgcagctcctcctgagaaagtctgtttaattggctgtgggttttccactggatatggcgctgctgttaaaactggcaaggtcaaacctggttccacttgcgtcgtctttggcctgggaggagttggcctgtcagtcatcatgggctgtaagtcagctggtgcatctaggatcattgggattgacctcaacaaagacaaatttgagaaggccatggctgtaggtgccactgagtgtatcagtcccaaggactctaccaaacccatcagtgaggtgctgtcagaaatgacaggcaacaacgtgggatacacctttgaagttattgggcatcttgaaaccatgattgatgccctggcatcctgccacatgaactatgggaccagcgtggttgtaggagttcctccatcagccaagatgctcacctatgacccgatgttgctcttcactggacgcacatggaagggatgtgtctttggaggtttgaaaagcagagatgatgtcccaaaactagtgactgagttcctggcaaagaaatttgacctggaccagttgataactcatgttttaccatttaaaaaaatcagtgaaggatttgagctgctcaattcaggacaaagcattcgaacggtcctgacgttttgagatccaaagtggcaggaggtctgtgttgtcatggtgaactggagtttctcttgtgagagttccctcatctgaaatcatgtatctgtctcacaaatacaagcataagtagaagatttgttgaagacatagaacccttataaag

SEQ ID NO: 106265 - DNA, 1830 bp, Homo sapiens
  Payload ID: 873
  Gene Symbol: ADHFE1
  Gene Name: alcohol dehydrogenase, iron containing, 1
  ENST ID: ENST00000276576
  CDS Start-End: 19-135
aagaggactccaagcgccatggccgctgccgcccgagcccgggtcgcgtacttgctgaggcaactgcaacgcgcagcgtgccagtgcccaactcattctcatacttactcccaagatggctgtttcaaatattagatatggagcagcagttacaaaggaagtaggaatggacctaaaaaacatgggtgctaaaaatgtgtgcttgatgacagacaagaacctctccaagctccctcctgtgcaagtagctatggattccctagtgaagaatggcatcccctttacggtttatgataatgtgagagtggaaccaacggattcaagcttcatggaagctattgagtttgcccaaaagggagcttttgatgcctatgttgctgtcggtggtggctctaccatggacacctgtaaggctgctaatctgtatgcatccagccctcattctgatttcctagattatgtcagtgcccccattggcaagggaaagcctgtgtctgtgcctcttaagcctctgattgcagtgccaactacctcaggaaccgggagtgaaactactggggttgccatttttgactatgaacacttgaaagtaaaaattggcatcacttcgagagccatcaaacccacactgggactgattgatcctctgcacaccctccacatgcctgcccgagtggtcgccaacagtggctttgatgtgctttgccatgccctggagtcatacaccaccctgccctaccacctgcggagcccctgcccttcaaatcccatcacacggcctgcgtaccagggcagcaacccaatcagtgacatttgggctatccacgcgctgcggatcgtggctaagtatctgaagagggctgtcagaaatcccgatgatcttgaagcaaggtctcatatgcacttggcaagtgcttttgctggcatcggctttggaaatgctggtgttcatctgtgccatggaatgtcttacccaatttcaggtttagtgaagatgtataaagcaaaggattacaatgtggatcacccactggtgccccatggcctttctgtggtgctcacgtccccagcggtgttcactttcacggcccagatgtttccagagcgacacctggagatggcagaaatactgggagccgacacccgcactgccaggatccaagatgcagggctggtgttggcagacacgctccggaaattcttattcgatctggatgttgatgatggcctagcagctgttggttactccaaagctgatatccccgcactagtgaaaggaacgctgccccaggaaagggtcaccaagcttgcaccctgtccccagtcagaagaggatctggctgctctgtttgaagcttcaatgaaactgtattaattgtcattttaactgaaagaattaccgctggccattgtagtgctgagagcaagagctgatctagctagggctttgtcttttcatctttgcgcataacttacctgttaccagtataggtgggatatacatttatcttgcaggaaattccccaaagctcagagtccagttccttccataaaacaggctggacaaatgaccactatgttagacccccaggctcgacttcaggggtcagtgttcctgtcccaaaccccacacagaatactctgcctctgtttcatgtagcaaatgagcaaaaactcagtatctatcaaaagtgtaaattatatttcctatgcctagtaattcacttcatgtctaaaaatttatctgatagaaacactagcaccagtacatacagaagcatggcaaggatgtttctggcagcacttttctaataataaaagatttgaaac

SEQ ID NO: 106266 - DNA, 1006 bp, Homo sapiens
  Payload ID: 873
  Gene Symbol: ADHFE1
  Gene Name: alcohol dehydrogenase, iron containing, 1
  ENST ID: ENST00000396621
  CDS Start-End: 18-398
agaggactccaagcgccatggccgctgccgcccgagcccgggtcgcgtacttgctgaggcaactgcaacgcgcagcgtgccagtgcccaactcattctcatacttactcccaagcccctggactttcaccttctgggaaaacaacagattatgcctttgagatggctgtttcaaatattagatatggagcagcagttacaaaggaagtaggaatggacctaaaaaacatgggtgctaaaaatgtgtgcttgatgacagacaagaacctctccaagctccctcctgtgcaagtagctatggattccctagtgaagaatggcatcccctttacggtttatgataatgtgagagtggaaccaacggattcaagtgccaactacctcaggaaccgggagtgaaactactggggttgccatttttgactatgaacacttgaaagtaaaaattggcatcacttcgagagccatcaaacccacactgggactgattgatcctctgcacaccctccacatgcctgcccgagtggtcgccaacagtggctttgatgtgctttgccatgccctggagtcatacaccaccctgccctaccacctgcggagcccctgcccttcaaatcccatcacacggcctgcgtaccagggcagcaacccaatcagtgacatttgggctatccacgcgctgcggatcgtggctaagtatctgaagagggccgtcaacagcactgacaaatgaagaagaagaatgagtctcagggcaccttcctggagtggccctcgccatccagggaccagcgcgttgcctcccccggcgcttttacatcacatgagcagctgacagcgtatttattatgcctttgctgaaacagttgatgagaaatatgtttcccttcagttttcatttagaagacaaggcgtcgtttgaataacttgcctgatttttcttcctaccgagtagcatttctttttttttcaccatatctttccctaaggcagctccttattctgta

SEQ ID NO: 106267 - DNA, 1990 bp, Homo sapiens
  Payload ID: 873
  Gene Symbol: ADHFE1
  Gene Name: alcohol dehydrogenase, iron containing, 1
  Uniprot ID: Q8IWW8
  ENST ID: ENST00000396623
  CDS Start-End: 32-1435
gacccgaggagggaagaggactccaagcgccatggccgctgccgcccgagcccgggtcgcgtacttgctgaggcaactgcaacgcgcagcgtgccagtgcccaactcattctcatacttactcccaagcccctggactttcaccttctgggaaaacaacagattatgcctttgagatggctgtttcaaatattagatatggagcagcagttacaaaggaagtaggaatggacctaaaaaacatgggtgctaaaaatgtgtgcttgatgacagacaagaacctctccaagctccctcctgtgcaagtagctatggattccctagtgaagaatggcatcccctttacggtttatgataatgtgagagtggaaccaacggattcaagcttcatggaagctattgagtttgcccaaaagggagcttttgatgcctatgttgctgtcggtggtggctctaccatggacacctgtaaggctgctaatctgtatgcatccagccctcattctgatttcctagattatgtcagtgcccccattggcaagggaaagcctgtgtctgtgcctcttaagcctctgattgcagtgccaactacctcaggaaccgggagtgaaactactggggttgccatttttgactatgaacacttgaaagtaaaaattggcatcacttcgagagccatcaaacccacactgggactgattgatcctctgcacaccctccacatgcctgcccgagtggtcgccaacagtggctttgatgtgctttgccatgccctggagtcatacaccaccctgccctaccacctgcggagcccctgcccttcaaatcccatcacacggcctgcgtaccagggcagcaacccaatcagtgacatttgggctatccacgcgctgcggatcgtggctaagtatctgaagagggctgtcagaaatcccgatgatcttgaagcaaggtctcatatgcacttggcaagtgcttttgctggcatcggctttggaaatgctggtgttcatctgtgccatggaatgtcttacccaatttcaggtttagtgaagatgtataaagcaaaggattacaatgtggatcacccactggtgccccatggcctttctgtggtgctcacgtccccagcggtgttcactttcacggcccagatgtttccagagcgacacctggagatggcagaaatactgggagccgacacccgcactgccaggatccaagatgcagggctggtgttggcagacacgctccggaaattcttattcgatctggatgttgatgatggcctagcagctgttggttactccaaagctgatatccccgcactagtgaaaggaacgctgccccaggaaagggtcaccaagcttgcaccctgtccccagtcagaagaggatctggctgctctgtttgaagcttcaatgaaactgtattaattgtcattttaactgaaagaattaccgctggccattgtagtgctgagagcaagagctgatctagctagggctttgtcttttcatctttgcgcataacttacctgttaccagtataggtgggatatacatttatcttgcaggaaattccccaaagctcagagtccagttccttccataaaacaggctggacaaatgaccactatgttagacccccaggctcgacttcaggggtcagtgttcctgtcccaaaccccacacagaatactctgcctctgtttcatgtagcaaatgagcaaaaactcagtatctatcaaaagtgtaaattatatttcctatgcctagtaattcacttcatgtctaaaaatttatctgatagaaacactagcaccagtacatacagaagcatggcaaggatgtttctggcagcacttttctaataataaaagatttgaaacaaccttaagtattcattattggtatatagatcacttatagtatactagacagtggaatactatggtactgttaataaagatgaagtaaatctcttggaaa

SEQ ID NO: 106268 - DNA, 982 bp, Homo sapiens
  Payload ID: 873
  Gene Symbol: ADHFE1
  Gene Name: alcohol dehydrogenase, iron containing, 1
  ENST ID: ENST00000422166
  CDS Start-End: 13-408
actccaagcgccatggccgctgccgcccgagcccgggtcgcgtacttgctgaggcaactgcaacgcgcagcgtgccagtgcccaactcattctcatacttactcccaagcccctggactttcaccttctgggaaaacaacagattatgcctttgagatggctgtttcaaatattagatatggagcagcagttacaaaggaagtaggaatggacctaaaaaacatgggtgctaaaaatgtgtgcttgatgacagacaagaacctctccaagctccctcctgtgcaagtagctatggattccctagtgaagaatggcatcccctttacggtttatgataatgtgagagtggaaccaacggattcaaggcatcacttcgagagccatcaaacccacactgggactgattgatcctctgcacaccctccacatgcctgcccgagtggtcgccaacagtggctttgatgtgctttgccatgccctggagtcatacaccaccctgccctaccacctgcggagcccctgcccttcaaatcccatcacacggcctgcgtaccagggcagcaacccaatcagtgacatttgggctatccacgcgctgcggatcgtggctaagtatctgaagagggccgtcaacagcactgacaaatgaagaagaagaatgagtctcagggcaccttcctggagtggccctcgccatccagggaccagcgcgttgcctcccccggcgcttttacatcacatgagcagctgacagcgtatttattatgcctttgctgaaacagttgatgagaaatatgtttcccttcagttttcatttagaagacaaggcgtcgtttgaataacttgcctgatttttcttcctaccgagtagcatttctttttttttcaccatatctttccctaaggcagctccttattctgtaggaattgccaatgttgatgtgttattgttaggtatttatatcattcacagggctgtcag

SEQ ID NO: 106269 - DNA, 1979 bp, Homo sapiens
  Payload ID: 873
  Gene Symbol: ADHFE1
  Gene Name: alcohol dehydrogenase, iron containing, 1
  ENST ID: ENST00000419955
  CDS Start-End: 5-109
cgccatggccgctgccgcccgagcccgggtcgcgtacttgctgaggcaactgcaacgcgcagccccctggactttcaccttctgggaaaacaacagattatgcctttgagatggctgtttcaaatattagatatggagcagcagttacaaaggaagtaggaatggacctaaaaaacatgggtgctaaaaatgtgtgcttgatgacagacaagaacctctccaagctccctcctgtgcaagtagctatggattccctagtgaagaatggcatcccctttacggtttatgataatgtgagagtggaaccaacggattcaagtgccaactacctcaggaaccgggagtgaaactactggggttgccatttttgactatgaacacttgaaagtaaaaattggcatcacttcgagagccatcaaacccacactgggactgattgatcctctgcacaccctccacatgcctgcccgagtggtcgccaacagtggctttgatgtgctttgccatgccctggagtcatacaccaccctgccctaccacctgcggagcccctgcccttcaaatcccatcacacggcctgcgtaccagggcagcaacccaatcagtgacatttgggctatccacgcgctgcggatcgtggctaagtatctgaagagggccgtcaacagcactgacaaatgaagaagaagaatgagtctcagggcaccttcctggagtggccctcgccatccagggaccagcgcgttgcctcccccggcgcttttacatcacatgagcagctgacagcgtatttattatgcctttgctgaaacagttgatgagaaatatgtttcccttcagttttcatttagaagacaaggcgtcgtttgaataacttgcctgatttttcttcctaccgagtagcatttctttttttttcaccatatctttccctaaggcagctccttattctgtaggaattgccaatgttgatgtgttattgttaggtatttatatcattcacagggctgtcagaaatcccgatgatcttgaagcaaggtctcatatgcacttggcaagtgcttttgctggcatcggctttggaaatgctggtgttcatctgtgccatggaatgtcttacccaatttcaggtttagtgaagatgtataaagcaaaggattacaatgtggatcacccactggtgccccatggcctttctgtggtgctcacgtccccagcggtgttcactttcacggcccagatgtttccagagcgacacctggagatggcagaaatactgggagccgacacccgcactgccaggatccaagatgcagggctggtgttggcagacacgctccggaaattcttattcgatctggatgttgatgatggcctagcagctgttggttactccaaagctgatatccccgcactagtgaaaggaacgctgccccaggaaagggtcaccaagcttgcaccctgtccccagtcagaagaggatctggctgctctgtttgaagcttcaatgaaactgtattaattgtcattttaactgaaagaattaccgctggccattgtagtgctgagagcaagagctgatctagctagggctttgtcttttcatctttgcgcataacttacctgttaccagtataggtgggatatacatttatcttgcaggaaattccccaaagctcagagtccagttccttccataaaacaggctggacaaatgaccactatgttagacccccaggctcgacttcaggggtcagtgttcctgtcccaaaccccacacagaatactctgcctctgtttcatgtagcaaatgagcaaaaactcagtatctatcaaaagtgtaaattatatttcctatgcctagtaattcacttcatgtctaaaaatttatctgatagaaacactagcaccagtacatacagaagcatggcaaggatgtttctggcagcacttttctaataataaaagatttgaaacaa

SEQ ID NO: 106270 - DNA, 524 bp, Homo sapiens
  Payload ID: 873
  Gene Symbol: ADHFE1
  Gene Name: alcohol dehydrogenase, iron containing, 1
  ENST ID: ENST00000431959
  CDS Start-End: 13-117
actccaagcgccatggccgctgccgcccgagcccgggtcgcgtacttgctgaggcaactgcaacgcgcagccccctggactttcaccttctgggaaaacaacagattatgcctttgagatggctgtttcaaatattagatatggagcagcagttacaaaggaagtaggaatggacctaaaaaacatgggtgctaaaaatgtgtgcttgatgacagacaagaacctctccaagctccctcctgtgcaagtagctatggattccctagtgaagaatggcatcccctttacggtttatgataatgtgagagtggaaccaacggattcaagcttcatggaagctattgagtttgcccaaaagggagcttttgatgcctatgttgctgtcggtggtggctctaccatggacacctgtaaggctgctaatctgtatgcatccagccctcattctgatttcctagattatgtcagtgcccccattggcaagggaaagcctgtgtctgtgcctcttaagcctctgattgcag

SEQ ID NO: 106271 - DNA, 2179 bp, Homo sapiens
  Payload ID: 873
  Gene Symbol: ADHFE1
  Gene Name: alcohol dehydrogenase, iron containing, 1
  ENST ID: ENST00000426810
  CDS Start-End: 17-133
gaggactccaagcgccatggccgctgccgcccgagcccgggtcgcgtacttgctgaggcaactgcaacgcgcagcgtgccagtgcccaactcattctcatacttactcccaagatggctgtttcaaatattagatatggagcagcagttacaaaggaagtaggaatggacctaaaaaacatgggtgctaaaaatgtgtgcttgatgacagacaagaacctctccaagctccctcctgtgcaagtagctatggattccctagtgaagaatggcatcccctttacggtttatgataatgtgagagtggaaccaacggattcaagcttcatggaagctattgagtttgcccaaaagggagcttttgatgcctatgttgctgtcggtggtggctctaccatggacacctgtaaggctgctaatctgtatgcatccagccctcattctgatttcctagattatgtcagtgcccccattggcaagggaaagcctgtgtctgtgcctcttaagcctctgattgcagtgccaactacctcaggaaccgggagtgaaactactggggttgccatttttgactatgaacacttgaaagtaaaaattggcatcacttcgagagccatcaaacccacactgggactgattgatcctctgcacaccctccacatgcctgcccgagtggtcgccaacagtggctttgatgtgctttgccatgccctggagtcatacaccaccctgccctaccacctgcggagcccctgcccttcaaatcccatcacacggcctgcgtaccagggcagcaacccaatcagtgacatttgggctatccacgcgctgcggatcgtggctaagtatctgaagagggccgtcaacagcactgacaaatgaagaagaagaatgagtctcagggcaccttcctggagtggccctcgccatccagggaccagcgcgttgcctcccccggcgcttttacatcacatgagcagctgacagcgtatttattatgcctttgctgaaacagttgatgagaaatatgtttcccttcagttttcatttagaagacaaggcgtcgtttgaataacttgcctgatttttcttcctaccgagtagcatttctttttttttcaccatatctttccctaaggcagctccttattctgtaggaattgccaatgttgatgtgttattgttaggtatttatatcattcacagggctgtcagaaatcccgatgatcttgaagcaaggtctcatatgcacttggcaagtgcttttgctggcatcggctttggaaatgctggtgttcatctgtgccatggaatgtcttacccaatttcaggtttagtgaagatgtataaagcaaaggattacaatgtggatcacccactggtgccccatggcctttctgtggtgctcacgtccccagcggtgttcactttcacggcccagatgtttccagagcgacacctggagatggcagaaatactgggagccgacacccgcactgccaggatccaagatgcagggctggtgttggcagacacgctccggaaattcttattcgatctggatgttgatgatggcctagcagctgttggttactccaaagctgatatccccgcactagtgaaaggaacgctgccccaggaaagggtcaccaagcttgcaccctgtccccagtcagaagaggatctggctgctctgtttgaagcttcaatgaaactgtattaattgtcattttaactgaaagaattaccgctggccattgtagtgctgagagcaagagctgatctagctagggctttgtcttttcatctttgcgcataacttacctgttaccagtataggtgggatatacatttatcttgcaggaaattccccaaagctcagagtccagttccttccataaaacaggctggacaaatgaccactatgttagacccccaggctcgacttcaggggtcagtgttcctgtcccaaaccccacacagaatactctgcctctgtttcatgtagcaaatgagcaaaaactcagtatctatcaaaagtgtaaattatatttcctatgcctagtaattcacttcatgtctaaaaatttatctgatagaaacactagcaccagtacatacagaagcatggcaaggatgtttctggcagcacttttctaataataaaagatttgaaacaa

SEQ ID NO: 106272 - DNA, 1956 bp, Homo sapiens
  Payload ID: 873
  Gene Symbol: ADHFE1
  Gene Name: alcohol dehydrogenase, iron containing, 1
  Uniprot ID: Q8IWW8
  ENST ID: ENST00000415254
  CDS Start-End: 240-1499
aggagggaagaggactccaagcgccatggccgctgccgcccgagcccgggtcgcgtacttgctgaggcaactgcaacgcgcagcatttgaatttttggcggggagaaggaagtgatgcactcaagtatctaccgagacccaaccactggacaaggtgccagtgcccaactcattctcatacttactcccaagcccctggactttcaccttctgggaaaacaacagattatgcctttgagatggctgtttcaaatattagatatggagcagcagttacaaaggaagtaggaatggacctaaaaaacatgggtgctaaaaatgtgtgcttgatgacagacaagaacctctccaagctccctcctgtgcaagtagctatggattccctagtgaagaatggcatcccctttacggtttatgataatgtgagagtggaaccaacggattcaagcttcatggaagctattgagtttgcccaaaagggagcttttgatgcctatgttgctgtcggtggtggctctaccatggacacctgtaaggctgctaatctgtatgcatccagccctcattctgatttcctagattatgtcagtgcccccattggcaagggaaagcctgtgtctgtgcctcttaagcctctgattgcagtgccaactacctcaggaaccgggagtgaaactactggggttgccatttttgactatgaacacttgaaagtaaaaattggcatcacttcgagagccatcaaacccacactgggactgattgatcctctgcacaccctccacatgcctgcccgagtggtcgccaacagtggctttgatgtgctttgccatgccctggagtcatacaccaccctgccctaccacctgcggagcccctgcccttcaaatcccatcacacggcctgcgtaccagggcagcaacccaatcagtgacatttgggctatccacgcgctgcggatcgtggctaagtatctgaagagggctgtcagaaatcccgatgatcttgaagcaaggtctcatatgcacttggcaagtgcttttgctggcatcggctttggaaatgctggtgttcatctgtgccatggaatgtcttacccaatttcaggtttagtgaagatgtataaagcaaaggattacaatgtggatcacccactggtgccccatggcctttctgtggtgctcacgtccccagcggtgttcactttcacggcccagatgtttccagagcgacacctggagatggcagaaatactgggagccgacacccgcactgccaggatccaagatgcagggctggtgttggcagacacgctccggaaattcttattcgatctggatgttgatgatggcctagcagctgttggttactccaaagctgatatccccgcactagtgaaaggaacgctgccccaggaaagggtcaccaagcttgcaccctgtccccagtcagaagaggatctggctgctctgtttgaagcttcaatgaaactgtattaattgtcattttaactgaaagaattaccgctggccattgtagtgctgagagcaagagctgatctagctagggctttgtcttttcatctttgcgcataacttacctgttaccagtataggtgggatatacatttatcttgcaggaaattccccaaagctcagagtccagttccttccataaaacaggctggacaaatgaccactatgttagacccccaggctcgacttcaggggtcagtgttcctgtcccaaaccccacacagaatactctgcctctgtttcatgtagcaaatgagcaaaaactcagtatctatcaaaagtgtaaattatatttcctatgcctagtaattcacttcatgtctaaaaatttatctgatagaaacactagcaccagtacatacagaagcatggcaaggatgtttctggcagcacttttctaataataaaagatttgaaacaa

SEQ ID NO: 106273 - DNA, 515 bp, Homo sapiens
  Payload ID: 873
  Gene Symbol: ADHFE1
  Gene Name: alcohol dehydrogenase, iron containing, 1
  ENST ID: ENST00000443372
  CDS Start-End: 10-117
ccaagcgccatggccgctgccgcccgagcccgggtcgcgtacttgctgaggcaactgcaacgcgcagcatggctgtttcaaatattagatatggagcagcagttacaaaggaagtaggaatggacctaaaaaacatgggtgctaaaaatgtgtgcttgatgacagacaagaacctctccaagctccctcctgtgcaagtagctatggattccctagtgaagaatggcatcccctttacggtttatgataatgtgagagtggaaccaacggattcaagtgccaactacctcaggaaccgggagtgaaactactggggttgccatttttgactatgaacacttgaaagtaaaaattggcatcacttcgagagccatcaaacccacactgggactgattgatcctctgcacaccctccacatgcctgcccgagtggtcgccaacagtggctttgatgtgctttgccatgccctggagtcatacaccaccctgccctaccacctgcggagcccctgccc

SEQ ID NO: 106274 - DNA, 2229 bp, Homo sapiens
  Payload ID: 873
  Gene Symbol: ADHFE1
  Gene Name: alcohol dehydrogenase, iron containing, 1
  Uniprot ID: Q8IWW8
  ENST ID: ENST00000424777
  CDS Start-End: 20-931
gaagaggactccaagcgccatggccgctgccgcccgagcccgggtcgcgtacttgctgaggcaactgcaacgcgcagcgtgccagtgcccaactcattctcatacttactcccaagcccctggactttcaccttctgggaaaacaacagattatgcctttgagatggctgtttcaaatattagatatggagcagcagttacaaaggaagtaggaatggacctaaaaaacatgggtgctaaaaatgtgtgcttgatgacagacaagaacctctccaagctccctcctgtgcaagtagctatggattccctagtgaagaatggcatcccctttacggtttatgataatgtgagagtggaaccaacggattcaagcttcatggaagctattgagtttgcccaaaagggagcttttgatgcctatgttgctgtcggtggtggctctaccatggacacctgtaaggctgctaatctgtatgcatccagccctcattctgatttcctagattatgtcagtgcccccattggcaagggaaagcctgtgtctgtgcctcttaagcctctgattgcagtgccaactacctcaggaaccgggagtgaaactactggggttgccatttttgactatgaacacttgaaagtaaaaattggcatcacttcgagagccatcaaacccacactgggactgattgatcctctgcacaccctccacatgcctgcccgagtggtcgccaacagtggctttgatgtgctttgccatgccctggagtcatacaccaccctgccctaccacctgcggagcccctgcccttcaaatcccatcacacggcctgcgtaccagggcagcaacccaatcagtgacatttgggctatccacgcgctgcggatcgtggctaagtatctgaagagggccgtcaacagcactgacaaatgaagaagaagaatgagtctcagggcaccttcctggagtggccctcgccatccagggaccagcgcgttgcctcccccggcgcttttacatcacatgagcagctgacagcgtatttattatgcctttgctgaaacagttgatgagaaatatgtttcccttcagttttcatttagaagacaaggcgtcgtttgaataacttgcctgatttttcttcctaccgagtagcatttctttttttttcaccatatctttccctaaggcagctccttattctgtaggaattgccaatgttgatgtgttattgttaggtatttatatcattcacagggctgtcagaaatcccgatgatcttgaagcaaggtctcatatgcacttggcaagtgcttttgctggcatcggctttggaaatgctggtgttcatctgtgccatggaatgtcttacccaatttcaggtttagtgaagatgtataaagcaaaggattacaatgtggatcacccactggtgccccatggcctttctgtggtgctcacgtccccagcggtgttcactttcacggcccagatgtttccagagcgacacctggagatggcagaaatactgggagccgacacccgcactgccaggatccaagatgcagggctggtgttggcagacacgctccggaaattcttattcgatctggatgttgatgatggcctagcagctgttggttactccaaagctgatatccccgcactagtgaaaggaacgctgccccaggaaagggtcaccaagcttgcaccctgtccccagtcagaagaggatctggctgctctgtttgaagcttcaatgaaactgtattaattgtcattttaactgaaagaattaccgctggccattgtagtgctgagagcaagagctgatctagctagggctttgtcttttcatctttgcgcataacttacctgttaccagtataggtgggatatacatttatcttgcaggaaattccccaaagctcagagtccagttccttccataaaacaggctggacaaatgaccactatgttagacccccaggctcgacttcaggggtcagtgttcctgtcccaaaccccacacagaatactctgcctctgtttcatgtagcaaatgagcaaaaactcagtatctatcaaaagtgtaaattatatttcctatgcctagtaattcacttcatgtctaaaaatttatctgatagaaacactagcaccagtacatacagaagcatggcaaggatgtttctggcagcacttttctaataataaaagatttgaaacaa

SEQ ID NO: 106275 - DNA, 556 bp, Homo sapiens
  Payload ID: 873
  Gene Symbol: ADHFE1
  Gene Name: alcohol dehydrogenase, iron containing, 1
  ENST ID: ENST00000449512
  CDS Start-End: 13-120
actccaagcgccatggccgctgccgcccgagcccgggtcgcgtacttgctgaggcaactgcaacgcgcagcatggctgtttcaaatattagatatggagcagcagttacaaaggaagtaggaatggacctaaaaaacatgggtgctaaaaatgtgtgcttgatgacagacaagaacctctccaagctccctcctgtgcaagtagctatggattccctagtgaagaatggcatcccctttacggtttatgataatgtgagagtggaaccaacggattcaagcttcatggaagctattgagtttgcccaaaagggagcttttgatgcctatgttgctgtcggtggtggctctaccatggacacctgtaaggctgctaatctgtatgcatccagccctcattctgatttcctagattatgtcagtgcccccattggcaagggaaagcctgtgtctgtgcctcttaagcctctgattgcagtgccaactacctcaggaaccgggagtgaaactactggggttgccatttttgactatgaacacttgaaagtaaaaattgg

SEQ ID NO: 106276 - DNA, 557 bp, Homo sapiens
  Payload ID: 873
  Gene Symbol: ADHFE1
  Gene Name: alcohol dehydrogenase, iron containing, 1
  ENST ID: ENST00000523113
  CDS Start-End: 293-557
aagagaaaaggaggacagcgcccaggaggaaagaggaggaagtaatagtttctaactgtcggacccgtctgtaaaccaaggactatgaatactaaatgttaagttctaggcaattatacggggactcagaaggacctggccgctgccttcattgagtttaaagggacaggattgcccttccgtcaagaaagtatcccctggactttcaccttctgggaaaacaacagattatgcctttgagatggctgtttcaaatattagatatggagcagcagttacaaaggaagtaggaatggacctaaaaaacatgggtgctaaaaatgtgtgcttgatgacagacaagaacctctccaagctccctcctgtgcaagtagctatggattccctagtgaagaatggcatcccctttacggtttatgataatgtgagagtggaaccaacggattcaagcttcatggaagctattgagtttgcccaaaagggagcttttgatgcctatgttgctgtcggtggtggctctaccatggacacctgtaaggctgctaatctgtatgcat

SEQ ID NO: 106277 - DNA, 2107 bp, Homo sapiens
  Payload ID: 874
  Gene Symbol: ALDH1A1
  Gene Name: aldehyde dehydrogenase 1 family, member A1
  Uniprot ID: P00352
  ENST ID: ENST00000297785
  CDS Start-End: 56-1561
ctatcagaaccaaattgctgagccagtcacctgtgttccaggagccgaatcagaaatgtcatcctcaggcacgccagacttacctgtcctactcaccgatttgaagattcaatatactaagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatccccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatgggcctacagcaggggcagccatttcttctcacatggatatagacaaagtagccttcacaggatcaacagaggttggcaagttgatcaaagaagctgccgggaaaagcaatctgaagagggtgaccctggagcttggaggaaagagcccttgcattgtgttagctgatgccgacttggacaatgctgttgaatttgcacaccatggggtattctaccaccagggccagtgttgtatagccgcatccaggatttttgtggaagaatcaatttatgatgagtttgttcgaaggagtgttgagcgggctaagaagtatatccttggaaatcctctgaccccaggagtcactcaaggccctcagattgacaaggaacaatatgataaaatacttgacctcattgagagtgggaagaaagaaggggccaaactggaatgtggaggaggcccgtgggggaataaaggctactttgtccagcccacagtgttctctaatgttacagatgagatgcgcattgccaaagaggagatttttggaccagtgcagcaaatcatgaagtttaaatctttagatgacgtgatcaaaagagcaaacaatactttctatggcttatcagcaggagtgtttaccaaagacattgataaagccataacaatctcctctgctctgcaggcaggaacagtgtgggtgaattgctatggcgtggtaagtgcccagtgcccctttggtggattcaagatgtctggaaatggaagagaactgggagagtacggtttccatgaatatacagaggtcaaaacagtcacagtgaaaatctctcagaagaactcataaagaaaatacaagagtggagagaagctcttcaatagctaagcatctccttacagtcactaatatagtagattttaaagacaaaatttttcttttcttgatttttttaaacataagctaaatcatattagtattaatactacccatagaaaacttgacatgtagcttcttctgaaagaattatttgccttctgaaatgtgacccccaagtcctatcctaaataaaaaaagacaaattcggatgtatgatctctctagctttgtcatagttatgtgattttcctttgtagctacttttgcaggataataattttatagaaaaggaacagttgcatttagcttctttcccttagtgactcttgaagtacttaacatacacgttaactgcagagtaaattgctctgttcccagtagttataaagtccttggactgttttgaaaagtttcctaggatgtcatgtctgcttgtcaaaagaaataatccctgtaatatttagctgtaaactgaatataaagcttaataaaaacaaccttgcatgattcttgtta

SEQ ID NO: 106278 - DNA, 822 bp, Homo sapiens
  Payload ID: 874
  Gene Symbol: ALDH1A1
  Gene Name: aldehyde dehydrogenase 1 family, member A1
  ENST ID: ENST00000376939
  CDS Start-End: 57-749
tctatcagaaccaaattgctgagccagtcacctgtgttccaggagccgaatcagaaatgtcatcctcaggcacgccagacttacctgtcctactcaccgatttgaagattcaatatactaagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatccccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatggggccagtgttgtatagccgcatccaggatttttgtggaagaatcaatttatgatgagtttgttcgaaggagtgttgagcgggctaagaa

SEQ ID NO: 106279 - DNA, 806 bp, Homo sapiens
  Payload ID: 874
  Gene Symbol: ALDH1A1
  Gene Name: aldehyde dehydrogenase 1 family, member A1
  ENST ID: ENST00000419959
  CDS Start-End: 91-806
agaagtccaggatgggaagagagatctgcagactcccagggaacctacagctttctccttcacagcattgcaggaggagccgaatcagaaatgtcatcctcaggcacgccagacttacctgtcctactcaccgatttgaagattcaatatactaagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatccccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatgggcctacagcaggggcagccatttcttctcacatggatat

SEQ ID NO: 106280 - DNA, 805 bp, Homo sapiens
  Payload ID: 874
  Gene Symbol: ALDH1A1
  Gene Name: aldehyde dehydrogenase 1 family, member A1
  ENST ID: ENST00000446946
  CDS Start-End: 197-805
gtggccaggatcgggtctgggaagctcggagatttcactgtgagtggagtcagagggaaggcatttggagcaaaggcttctgtaagagggagtaggatggaaattgatctttgaagaaagcaagacagaagaagggagatggaaagatgaaatcattttaaaattgctggtaacaaacgaaggagccgaatcagaaatgtcatcctcaggcacgccagacttacctgtcctactcaccgatttgaagattcaatatactaagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatccccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctc

SEQ ID NO: 106281 - DNA, 4098 bp, Homo sapiens
  Payload ID: 875
  Gene Symbol: ALDH1A2
  Gene Name: aldehyde dehydrogenase 1 family, member A2
  Uniprot ID: O94788
  ENST ID: ENST00000249750
  CDS Start-End: 769-2325
attctgagcccgaggcgagggggactcgcacccactgccacctctccctgaccctctggccaccatgcacctcggcccggctgaggggagtcggggggtcgggggagagggcgtagctgccgagagcctggcgcccctgcccggaggaggagaacggaggacgccctcccgggtctccggaaaggaagggggacggggttcggtgggtcctgggacggggatgggagggaacgtgggcgagctgggagccgccctccgcagcctggactttcctggcctttctctactccgaagcagcaccgggccgctccggtccccgccagcccctgccagctccgcttccgggggccacgaccctcgctcgacttcggccgctgtgcgcctcccgccgactctgacccagggacccggagaccaagtccggctggccgaggcccgcgggccgcggcgcaagttccgctcccaccgtcgaggactgtggaggcggcgtgggctggtctccgcggccggggggcgggagcgccgggcggacttgaccgtgggcgccaagcgtcccggccgcgcggcgcgggctttatgtaaatggaggctgcgccgggcgtcctaggtaggatggaccagccccccgcgcctcggccctcacgtccaataagaagagccccagcttgacacctgcctatatacaggcgagcgcgcccccgggccgcggaccgcgcgcacagcccgcactgccccacgccgcgggctagggacacccggcccgccaccatgacttccagcaagatagagatgcccggcgaggtgaaggccgaccccgccgccctcatggcgtcgctgcacctcctgccgtcgcccacgcccaatctcgaaattaagtacaccaagatctttataaacaacgagtggcagaactcagagagtgggagagtgttccctgtctataatccagccacaggagaacaggtgtgtgaagttcaagaagcagacaaggcagatatagacaaagcagtgcaggcagcccgcctggctttctctcttggttcagtgtggagaaggatggatgcttcagaaaggggacgtctgttggataagcttgcagacttggtggaacgggacagggcagttcttgcaaccatggaatccctaaatggtggcaaaccattcctgcaagctttttatgtggatttgcagggcgtcatcaaaacctttcgatattacgcaggctgggctgataaaattcatgggatgaccattcctgtagatggagactattttacctttacaagacatgaacccattggagtgtgtggacagatcatcccatggaacttccccctgctgatgtttgcctggaaaatagctccagctttgtgctgtggcaatacagtagttattaagccagcagagcaaacaccactcagtgcactctacatgggagccctcatcaaggaggctggctttcctcccggggtcatcaatattttgccaggatatgggccaacggctggggcagcaatagcttctcacattggcatagacaagattgcattcacagggtctactgaggttggaaagcttatccaagaagcagctggaagaagtaatttgaagagagtaactctggaacttggaggcaaaagtcctaatattatttttgctgatgctgacttggactatgctgtggagcaggcccaccagggtgtgttcttcaatcaaggtcagtgctgcactgcaggctctcgcatcttcgtggaggagtccatctatgaggagtttgtgagaagaagcgtggagcgggccaagaggcgcgtagtggggagtccctttgaccccaccactgagcagggtccccagattgataagaaacagtacaacaagatcttggaactcatccagagtggtgtggctgagggcgccaagctggaatgtggaggcaaaggactgggccgaaaggggtttttcattgagcccacagtgttttccaacgtcactgatgatatgcggattgccaaggaggagatctttggccctgttcaggaaattttgagatttaagacgatggatgaagttatcgaaagagccaataactcagactttggactcgtagcagctgtctttactaatgacatcaacaaggccctcacagtgtcttctgcaatgcaagctgggactgtttggatcaattgttacaatgccttaaatgcccagagcccctttgggggattcaagatgtctggaaatgggagagaaatgggagaatttggcttgcgggagtactcagaagttaagacggtgacagtaaagatcccccagaagaactcctaagaaggccaagaaggaggatgaagcccagcctgcacgtctgtccctctctgctttctctgtagggcccagctctcaggaatacaaagttgagccacggtccttacttaaagattgaaaagataacatgtaggccaggcaggtcactgcacaactaaagcaaaccagctgggtacagtttcttggcactctgtaaggggccaccttaatcataccaaatattggggaaagtgggataaagggaggaggaggagctagcagacacatccagtatctccttctggagcacaggatgaaataagggagctgtattatttcatgtctttgtcacaaagaactttcctctcaaggaaaggtgacctttctcctgtcttcattttcctccttccaggccctcctcgctcacccacccctccctctcttccaaggagatgtcagctgagctcattctggggcagatgtttgggccgggaacaatttttcaaggttgtaaagccaaattatcatttcatgttatccatttcttcaaagcaaaacatgaaatggttttagctagagtcagaccagaatgaaaatgccaggagctggtacactacagatgtagtaagaacctgggatattcctgacccaatctggttttcttttacccataaataacatgaatgaaaaaagattgggacaatagagactggaagtcatcatgtgcagttcaccgcttctgagcttgctgcagttttggggtgtgtgtgtattagattccttctcagttattctggaataaggcaaggagtgggttgtttttcatagctagataagatcttttccaaagtttttcttagaaccaaccaaaaaacaatccgagtaggcccaagaatttgataatgctggatgccttgcagacatcattcagtttctaatattgggcaacaattattattaaatgaattatttctgtagttggaatctgtaccttctgaacctctacaccaataactgctgcaggtgtgattttggtctgtcacactgtacatctatcataatgtgccctgtatctattggcagtgaccttggaaaatctggccaagcctaggggtttccttttccatttgccaagttccattgtgccaggactgccgtgctccactgagctcctctgtcacaccccattcttgcccctcactgggcaggccatggcctacagcttgcagggagtaaagcaggcccgcctccctttcttcccatccacatactcctcttctgctttccagtgactccaccagtttgatgtgggaagtgttagcttcctttccttcttccatcccttcttccatctttccagctgtcaaatccaatccagtctctaacctaaatgcagatcatttatttaaaagtaccaaacataacccagagtatgtggaatatgggcaacatatatatagccttctgtatttaacgatcttctgcttcttaaccgtaccagttttctatttataactcttatctatccatgatgttttaaagtctccacttgctgttatttacaaacgacagtgcattcagcagcccagtgccgtgagccctgacagatgccgtatttctgagtgcttccatgtgaatgctgccctcctgtagcatgtgtccaagtggacatagccactaaccaactagttacctttggactgcaacaaaaaatgtgaaaatgaagatttatttcttttaatttacttaaaaagaaacctctgtgctagcaataaagcatttatattgtgtactcct

SEQ ID NO: 106282 - DNA, 3297 bp, Homo sapiens
  Payload ID: 875
  Gene Symbol: ALDH1A2
  Gene Name: aldehyde dehydrogenase 1 family, member A2
  Uniprot ID: O94788
  ENST ID: ENST00000347587
  CDS Start-End: 89-1531
atacaggcgagcgcgcccccgggccgcggaccgcgcgcacagcccgcactgccccacgccgcgggctagggacacccggcccgccaccatgacttccagcaagatagagatgcccggcgaggtgaaggccgaccccgccgccctcatggcgtcgctgcacctcctgccgtcgcccacgcccaatctcgaaattaagtacaccaagatctttataaacaacgagtggcagaactcagagagtgggagagtgttccctgtctataatccagccacaggagaacaggtgtgtgaagttcaagaagcagacaaggcagatatagacaaagcagtgcaggcagcccgcctggctttctctcttggttcagtgtggagaaggatggatgcttcagaaaggggacgtctgttggataagcttgcagacttggtggaacgggacagggcagttcttgcaaccatggaatccctaaatggtggcaaaccattcctgcaagctttttatgtggatttgcagggcgtcatcaaaacctttcgatattacgcaggctgggctgataaaattcatgggatgaccattcctgtagatggagactattttacctttacaagacatgaacccattggagtgtgtggacagatcatcccatggaacttccccctgctgatgtttgcctggaaaatagctccagctttgtgctgtggcaatacagtagttattaagccagcagagcaaacaccactcagtgcactctacatgggagccctcatcaaggaggttggaaagcttatccaagaagcagctggaagaagtaatttgaagagagtaactctggaacttggaggcaaaagtcctaatattatttttgctgatgctgacttggactatgctgtggagcaggcccaccagggtgtgttcttcaatcaaggtcagtgctgcactgcaggctctcgcatcttcgtggaggagtccatctatgaggagtttgtgagaagaagcgtggagcgggccaagaggcgcgtagtggggagtccctttgaccccaccactgagcagggtccccagattgataagaaacagtacaacaagatcttggaactcatccagagtggtgtggctgagggcgccaagctggaatgtggaggcaaaggactgggccgaaaggggtttttcattgagcccacagtgttttccaacgtcactgatgatatgcggattgccaaggaggagatctttggccctgttcaggaaattttgagatttaagacgatggatgaagttatcgaaagagccaataactcagactttggactcgtagcagctgtctttactaatgacatcaacaaggccctcacagtgtcttctgcaatgcaagctgggactgtttggatcaattgttacaatgccttaaatgcccagagcccctttgggggattcaagatgtctggaaatgggagagaaatgggagaatttggcttgcgggagtactcagaagttaagacggtgacagtaaagatcccccagaagaactcctaagaaggccaagaaggaggatgaagcccagcctgcacgtctgtccctctctgctttctctgtagggcccagctctcaggaatacaaagttgagccacggtccttacttaaagattgaaaagataacatgtaggccaggcaggtcactgcacaactaaagcaaaccagctgggtacagtttcttggcactctgtaaggggccaccttaatcataccaaatattggggaaagtgggataaagggaggaggaggagctagcagacacatccagtatctccttctggagcacaggatgaaataagggagctgtattatttcatgtctttgtcacaaagaactttcctctcaaggaaaggtgacctttctcctgtcttcattttcctccttccaggccctcctcgctcacccacccctccctctcttccaaggagatgtcagctgagctcattctggggcagatgtttgggccgggaacaatttttcaaggttgtaaagccaaattatcatttcatgttatccatttcttcaaagcaaaacatgaaatggttttagctagagtcagaccagaatgaaaatgccaggagctggtacactacagatgtagtaagaacctgggatattcctgacccaatctggttttcttttacccataaataacatgaatgaaaaaagattgggacaatagagactggaagtcatcatgtgcagttcaccgcttctgagcttgctgcagttttggggtgtgtgtgtattagattccttctcagttattctggaataaggcaaggagtgggttgtttttcatagctagataagatcttttccaaagtttttcttagaaccaaccaaaaaacaatccgagtaggcccaagaatttgataatgctggatgccttgcagacatcattcagtttctaatattgggcaacaattattattaaatgaattatttctgtagttggaatctgtaccttctgaacctctacaccaataactgctgcaggtgtgattttggtctgtcacactgtacatctatcataatgtgccctgtatctattggcagtgaccttggaaaatctggccaagcctaggggtttccttttccatttgccaagttccattgtgccaggactgccgtgctccactgagctcctctgtcacaccccattcttgcccctcactgggcaggccatggcctacagcttgcagggagtaaagcaggcccgcctccctttcttcccatccacatactcctcttctgctttccagtgactccaccagtttgatgtgggaagtgttagcttcctttccttcttccatcccttcttccatctttccagctgtcaaatccaatccagtctctaacctaaatgcagatcatttatttaaaagtaccaaacataacccagagtatgtggaatatgggcaacatatatatagccttctgtatttaacgatcttctgcttcttaaccgtaccagttttctatttataactcttatctatccatgatgttttaaagtctccacttgctgttatttacaaacgacagtgcattcagcagcccagtgccgtgagccctgacagatgccgtatttctgagtgcttccatgtgaatgctgccctcctgtagcatgtgtccaagtggacatagccactaaccaactagttacctttggactgcaacaaaaaatgtgaaaatgaagatttatttcttttaatttacttaaaaagaaacctctgtgctagcaataaagcatttatattgtg

SEQ ID NO: 106283 - DNA, 3049 bp, Homo sapiens
  Payload ID: 875
  Gene Symbol: ALDH1A2
  Gene Name: aldehyde dehydrogenase 1 family, member A2
  ENST ID: ENST00000430119
  CDS Start-End: 19-141
gacacccggcccgccaccatgacttccagcaagatagagatgcccggcgaggtgaaggccgaccccgccgccctcatggcgtcgctgcacctcctgccgtcgcccacgcccaatctcgaaattaagtacaccaaggtgtgaaaattggacttgctggcagaatcctttttgggagaagatgaagaatcagtgtgagactgtttggttaaaatccccaataaaactgaaactgatctttataaacaacgagtggcagaactcagagagtgggagagtgttccctgtctataatccagccacaggagaacaggtgtgtgaagttcaagaagcagacaaggcagatatagacaaagcagtgcaggcagcccgcctggctttctctcttggttcagtgtggagaaggatggatgcttcagaaaggggacgtctgttggataagcttgcagacttggtggaacgggacagggcagttcttgcaaccatggaatccctaaatggtggcaaaccattcctgcaagctttttatgtggatttgcagggcgtcatcaaaacctttcgatattacgcaggctgggctgataaaattcatgggatgaccattcctgtagatggagactattttacctttacaagacatgaacccattggagtgtgtggacagatcatcccatggaacttccccctgctgatgtttgcctggaaaatagctccagctttgtgctgtggcaatacagtagttattaagccagcagagcaaacaccactcagtgcactctacatgggagccctcatcaaggaggctggctttcctcccggggtcatcaatattttgccaggatatgggccaacggctggggcagcaatagcttctcacattggcatagacaagattgcattcacagggtctactgaggttggaaagcttatccaagaagcagctggaagaagtaatttgaagagagtaactctggaacttggaggcaaaagtcctaatattatttttgctgatgctgacttggactatgctgtggagcaggcccaccagggtgtgttcttcaatcaaggtcagtgctgcactgcaggctctcgcatcttcgtggaggagtccatctatgaggagtttgtgagaagaagcgtggagcgggccaagaggcgcgtagtggggagtccctttgaccccaccactgagcagggtccccagattgataagaaacagtacaacaagatcttggaactcatccagagtggtgtggctgagggcgccaagctggaatgtggaggcaaaggactgggccgaaaggggtttttcattgagcccacagtgttttccaacgtcactgatgatatgcggattgccaaggaggagatctttggccctgttcaggaaattttgagatttaagacgatggatgaagttatcgaaagagccaataactcagactttggactcgtagcagctgtctttactaatgacatcaacaaggccctcacagtgtcttctgcaatgcaagctgggactgtttggatcaattgttacaatgccttaaatgcccagagcccctttgggggattcaagatgtctggaaatgggagagaaatgggagaatttggcttgcgggagtactcagaagttaagacggtgacagtaaagatcccccagaagaactcctaagaaggccaagaaggaggatgaagcccagcctgcacgtctgtccctctctgctttctctgtagggcccagctctcaggaatacaaagttgagccacggtccttacttaaagattgaaaagataacatgtaggccaggcaggtcactgcacaactaaagcaaaccagctgggtacagtttcttggcactctgtaaggggccaccttaatcataccaaatattggggaaagtgggataaagggaggaggaggagctagcagacacatccagtatctccttctggagcacaggatgaaataagggagctgtattatttcatgtctttgtcacaaagaactttcctctcaaggaaaggtgacctttctcctgtcttcattttcctccttccaggccctcctcgctcacccacccctccctctcttccaaggagatgtcagctgagctcattctggggcagatgtttgggccgggaacaatttttcaaggttgtaaagccaaattatcatttcatgttatccatttcttcaaagcaaaacatgaaatggttttagctagagtcagaccagaatgaaaatgccaggagctggtacactacagatgtagtaagaacctgggatattcctgacccaatctggttttcttttacccataaataacatgaatgaaaaaagattgggacaatagagactggaagtcatcatgtgcagttcaccgcttctgagcttgctgcagttttggggtgtgtgtgtattagattccttctcagttattctggaataaggcaaggagtgggttgtttttcatagctagataagatcttttccaaagtttttcttagaaccaaccaaaaaacaatccgagtaggcccaagaatttgataatgctggatgccttgcagacatcattcagtttctaatattgggcaacaattattattaaatgaattatttctgtagttggaatctgtaccttctgaacctctacaccaataactgctgcaggtgtgattttggtctgtcacactgtacatctatcataatgtgccctgtatctattggcagtgaccttggaaaatctggccaagcctaggggtttccttttccatttgccaagttccattgtgccaggactgccgtgctccactgagctcctctgtcacaccccattcttgcccctcactgggcaggccatggcctacagcttgcagggagtaaagcaggcccgcctccctttcttcccatccacatactcctcttctgctttccagtgactccaccagtttgatgtgggaagtgttagcttcctttccttcttccatcccttcttccatctttccagctgtcaaatccaatccagtctctaacctaaatgcagatcat

SEQ ID NO: 106284 - DNA, 3700 bp, Homo sapiens
  Payload ID: 875
  Gene Symbol: ALDH1A2
  Gene Name: aldehyde dehydrogenase 1 family, member A2
  Uniprot ID: O94788
  ENST ID: ENST00000537372
  CDS Start-End: 434-1927
ggtctccgcggccggggggcgggagcgccgggcggacttgaccgtgggcgccaagcgtcccggccgcgcggcgcgggctttatgtaaatggaggctgcgccgggcgtcctaggtaggatggaccagccccccgcgcctcggccctcacgtccaataagaagagccccagcttgacacctgcctatatacaggcgagcgcgcccccgggccgcggaccgcgcgcacagcccgcactgccccacgccgcgggctagggacacccggcccgccaccatgacttccagcaagatagagatgcccggcgaggtgaaggccgaccccgccgccctcatggcgtcgctgcacctcctgccgtcgcccacgcccaatctcgaaattaagtacaccaaggtgtgaaaattggacttgctggcagaatcctttttgggagaagatgaagaatcagtgtgagactgtttggttaaaatccccaataaaactgaaactgatctttataaacaacgagtggcagaactcagagagtgggagagtgttccctgtctataatccagccacaggagaacaggtgtgtgaagttcaagaagcagacaaggcagatatagacaaagcagtgcaggcagcccgcctggctttctctcttggttcagtgtggagaaggatggatgcttcagaaaggggacgtctgttggataagcttgcagacttggtggaacgggacagggcagttcttgcaaccatggaatccctaaatggtggcaaaccattcctgcaagctttttatgtggatttgcagggcgtcatcaaaacctttcgatattacgcaggctgggctgataaaattcatgggatgaccattcctgtagatggagactattttacctttacaagacatgaacccattggagtgtgtggacagatcatcccatggaacttccccctgctgatgtttgcctggaaaatagctccagctttgtgctgtggcaatacagtagttattaagccagcagagcaaacaccactcagtgcactctacatgggagccctcatcaaggaggctggctttcctcccggggtcatcaatattttgccaggatatgggccaacggctggggcagcaatagcttctcacattggcatagacaagattgcattcacagggtctactgaggttggaaagcttatccaagaagcagctggaagaagtaatttgaagagagtaactctggaacttggaggcaaaagtcctaatattatttttgctgatgctgacttggactatgctgtggagcaggcccaccagggtgtgttcttcaatcaaggtcagtgctgcactgcaggctctcgcatcttcgtggaggagtccatctatgaggagtttgtgagaagaagcgtggagcgggccaagaggcgcgtagtggggagtccctttgaccccaccactgagcagggtccccagattgataagaaacagtacaacaagatcttggaactcatccagagtggtgtggctgagggcgccaagctggaatgtggaggcaaaggactgggccgaaaggggtttttcattgagcccacagtgttttccaacgtcactgatgatatgcggattgccaaggaggagatctttggccctgttcaggaaattttgagatttaagacgatggatgaagttatcgaaagagccaataactcagactttggactcgtagcagctgtctttactaatgacatcaacaaggccctcacagtgtcttctgcaatgcaagctgggactgtttggatcaattgttacaatgccttaaatgcccagagcccctttgggggattcaagatgtctggaaatgggagagaaatgggagaatttggcttgcgggagtactcagaagttaagacggtgacagtaaagatcccccagaagaactcctaagaaggccaagaaggaggatgaagcccagcctgcacgtctgtccctctctgctttctctgtagggcccagctctcaggaatacaaagttgagccacggtccttacttaaagattgaaaagataacatgtaggccaggcaggtcactgcacaactaaagcaaaccagctgggtacagtttcttggcactctgtaaggggccaccttaatcataccaaatattggggaaagtgggataaagggaggaggaggagctagcagacacatccagtatctccttctggagcacaggatgaaataagggagctgtattatttcatgtctttgtcacaaagaactttcctctcaaggaaaggtgacctttctcctgtcttcattttcctccttccaggccctcctcgctcacccacccctccctctcttccaaggagatgtcagctgagctcattctggggcagatgtttgggccgggaacaatttttcaaggttgtaaagccaaattatcatttcatgttatccatttcttcaaagcaaaacatgaaatggttttagctagagtcagaccagaatgaaaatgccaggagctggtacactacagatgtagtaagaacctgggatattcctgacccaatctggttttcttttacccataaataacatgaatgaaaaaagattgggacaatagagactggaagtcatcatgtgcagttcaccgcttctgagcttgctgcagttttggggtgtgtgtgtattagattccttctcagttattctggaataaggcaaggagtgggttgtttttcatagctagataagatcttttccaaagtttttcttagaaccaaccaaaaaacaatccgagtaggcccaagaatttgataatgctggatgccttgcagacatcattcagtttctaatattgggcaacaattattattaaatgaattatttctgtagttggaatctgtaccttctgaacctctacaccaataactgctgcaggtgtgattttggtctgtcacactgtacatctatcataatgtgccctgtatctattggcagtgaccttggaaaatctggccaagcctaggggtttccttttccatttgccaagttccattgtgccaggactgccgtgctccactgagctcctctgtcacaccccattcttgcccctcactgggcaggccatggcctacagcttgcagggagtaaagcaggcccgcctccctttcttcccatccacatactcctcttctgctttccagtgactccaccagtttgatgtgggaagtgttagcttcctttccttcttccatcccttcttccatctttccagctgtcaaatccaatccagtctctaacctaaatgcagatcatttatttaaaagtaccaaacataacccagagtatgtggaatatgggcaacatatatatagccttctgtatttaacgatcttctgcttcttaaccgtaccagttttctatttataactcttatctatccatgatgttttaaagtctccacttgctgttatttacaaacgacagtgcattcagcagcccagtgccgtgagccctgacagatgccgtatttctgagtgcttccatgtgaatgctgccctcctgtagcatgtgtccaagtggacatagccactaaccaactagttacctttggactgcaacaaaaaatgtgaaaatgaagatttatttcttttaatttacttaaaaagaaacctctgtgctagcaataaagcatttatattgtgtactcct

SEQ ID NO: 106285 - DNA, 554 bp, Homo sapiens
  Payload ID: 875
  Gene Symbol: ALDH1A2
  Gene Name: aldehyde dehydrogenase 1 family, member A2
  ENST ID: ENST00000561070
  CDS Start-End: 300-554
attgaagcattattataagctccagagtacacgtcttctgtggattttcagtcgtacttacaatttcatgctcagaagaggcctttagtatatattttgcagtgtcttctgtgaagtcaaatttctgctcagatctttataaacaacgagtggcagaactcagagagtgggagagtgttccctgtctataatccagccacaggagaacaggtgtgtgaagttcaagaagcagacaagatatagacaaagcagtgcaggcagcccgcctggctttctctcttggttcagtgtggagaaggatggatgcttcagaaaggggacgtctgttggataagcttgcagacttggtggaacgggacagggcagttcttgcaaccatggaatccctaaatggtggcaaaccattcctgcaagctttttatgtggatttgcagggcgtcatcaaaacctttcgatattacgcaggctgggctgataaaattcatgggatgaccattcctgtagatggagactattttacctttacaagacatgaacccattggagtgtgtgga

SEQ ID NO: 106286 - DNA, 664 bp, Homo sapiens
  Payload ID: 875
  Gene Symbol: ALDH1A2
  Gene Name: aldehyde dehydrogenase 1 family, member A2
  ENST ID: ENST00000558239
  CDS Start-End: 590-664
agctatagtctggcaggaaaactggactgagtggactagcttggggatcgtcaagactcttgatcttattggaggcagcttggtacattgcaatgagggggagatttgggatcagggaacctgggatggagccatgtctttctcccttcccagctgtgtaaccttggacaagtcacttaacctccaagactcactttcctccttcatcaagtgctgtgtgaagaatgcaggagagtgatttaagcaaagccccctaactgcctggcgtctagtaagtacacaggcagtgtgtacacaaggaaggaaatggcaggctgttcatatgcagcaagatccacacttggccaaacctggggtcacagagatggacatggaatcgagggcagaagatctgggtttgagtccagcagtgctttagatctttataaacaacgagtggcagaactcagagagtgggagagtgttccctgtctataatccagccacaggagaacaggtgtgtgaagttcaagaagcagacaaggcagatatagacaaagcagtgcaggcagcccgcctggctttctctcttggttcagtgtggagaaggatggatgcttcagaaaggggacgtctgttggataagcttgcagacttggtggaacgggacagggcagttcttgca

SEQ ID NO: 106287 - DNA, 1468 bp, Homo sapiens
  Payload ID: 875
  Gene Symbol: ALDH1A2
  Gene Name: aldehyde dehydrogenase 1 family, member A2
  Uniprot ID: O94788
  ENST ID: ENST00000559517
  CDS Start-End: 170-1438
agtacaccactacatgctcatgcttcacttttttcatgacagtggatggttcttcctttatttggagtgtttttcttcagttgtgcctcttcctctctaacaggcagatatagacaaagcagtgcaggcagcccgcctggctttctctcttggttcagtgtggagaaggatggatgcttcagaaaggggacgtctgttggataagcttgcagacttggtggaacgggacagggcagttcttgcaaccatggaatccctaaatggtggcaaaccattcctgcaagctttttatgtggatttgcagggcgtcatcaaaacctttcgatattacgcaggctgggctgataaaattcatgggatgaccattcctgtagatggagactattttacctttacaagacatgaacccattggagtgtgtggacagatcatcccatggaacttccccctgctgatgtttgcctggaaaatagctccagctttgtgctgtggcaatacagtagttattaagccagcagagcaaacaccactcagtgcactctacatgggagccctcatcaaggaggctggctttcctcccggggtcatcaatattttgccaggatatgggccaacggctggggcagcaatagcttctcacattggcatagacaagattgcattcacagggtctactgaggttggaaagcttatccaagaagcagctggaagaagtaatttgaagagagtaactctggaacttggaggcaaaagtcctaatattatttttgctgatgctgacttggactatgctgtggagcaggcccaccagggtgtgttcttcaatcaaggtcagtgctgcactgcaggctctcgcatcttcgtggaggagtccatctatgaggagtttgtgagaagaagcgtggagcgggccaagaggcgcgtagtggggagtccctttgaccccaccactgagcagggtccccagattgataagaaacagtacaacaagatcttggaactcatccagagtggtgtggctgagggcgccaagctggaatgtggaggcaaaggactgggccgaaaggggtttttcattgagcccacagtgttttccaacgtcactgatgatatgcggattgccaaggaggagatctttggccctgttcaggaaattttgagatttaagacgatggatgaagttatcgaaagagccaataactcagactttggactcgtagcagctgtctttactaatgacatcaacaaggccctcacagtgtcttctgcaatgcaagctgggactgtttggatcaattgttacaatgccttaaatgcccagagcccctttgggggattcaagatgtctggaaatgggagagaaatgggagaatttggcttgcgggagtactcagaagttaagacggtgacagtaaagatcccccagaagaactcctaagaaggccaagaaggaggatgaagcccagcc

SEQ ID NO: 106288 - DNA, 1664 bp, Homo sapiens
  Payload ID: 875
  Gene Symbol: ALDH1A2
  Gene Name: aldehyde dehydrogenase 1 family, member A2
  ENST ID: ENST00000558231
  CDS Start-End: 61-1530
agagcagcaggatggcacttggtgtctggatgcctttggagttgcacatacagcttctttatgaaaggaagaaactggaagacaacaaagatctttataaacaacgagtggcagaactcagagagtgggagagtgttccctgtctataatccagccacaggagaacaggtgtgtgaagttcaagaagcagacaaggcagatatagacaaagcagtgcaggcagcccgcctggctttctctcttggttcagtgtggagaaggatggatgcttcagaaaggggacgtctgttggataagcttgcagacttggtggaacgggacagggcagttcttgcaaccatggaatccctaaatggtggcaaaccattcctgcaagctttttatgtggatttgcagggcgtcatcaaaacctttcgatattacgcaggctgggctgataaaattcatgggatgaccattcctgtagatggagactattttacctttacaagacatgaacccattggagtgtgtggacagatcatcccatggaacttccccctgctgatgtttgcctggaaaatagctccagctttgtgctgtggcaatacagtagttattaagccagcagagcaaacaccactcagtgcactctacatgggagccctcatcaaggaggctggctttcctcccggggtcatcaatattttgccaggatatgggccaacggctggggcagcaatagcttctcacattggcatagacaagattgcattcacagggtctactgaggttggaaagcttatccaagaagcagctggaagaagtaatttgaagagagtaactctggaacttggaggcaaaagtcctaatattatttttgctgatgctgacttggactatgctgtggagcaggcccaccagggtgtgttcttcaatcaaggtcagtgctgcactgcaggctctcgcatcttcgtggaggagtccatctatgaggagtttgtgagaagaagcgtggagcgggccaagaggcgcgtagtggggagtccctttgaccccaccactgagcagggtccccagattgataagaaacagtacaacaagatcttggaactcatccagagtggtgtggctgagggcgccaagctggaatgtggaggcaaaggactgggccgaaaggggtttttcattgagcccacagtgttttccaacgtcactgatgatatgcggattgccaaggaggagatctttggccctgttcaggaaattttgagatttaagacgatggatgaagttatcgaaagagccaataactcagactttggactcgtagcagctgtctttactaatgacatcaacaaggccctcacagtgtcttctgcaatgcaagctgggactgtttggatcaattgttacaatgccttaaatgcccagagcccctttgggggattcaagatgtctggaaatgggagagaaatgggagaatttggcttgcgggagtactcagaagttaagacggtgacagtaaagatcccccagaagaactcctaagaaggccaagaaggaggatgaagcccagcctgcacgtctgtccctctctgctttctctgtagggcccagctctcaggaatacaaagttgagccacggtccttacttaaagattgaaaagataacatgtaggcca

SEQ ID NO: 106289 - DNA, 466 bp, Homo sapiens
  Payload ID: 875
  Gene Symbol: ALDH1A2
  Gene Name: aldehyde dehydrogenase 1 family, member A2
  ENST ID: ENST00000558384
  CDS Start-End: 1-73
gggagaatttggcttgcgggagtactcagaagttaagacggtgacagtaaagatcccccagaagaactcctaagaaggccaagaaggaggatgaagcccagcctgcacgtctgtccctctctgctttctctgtagggcccagctctcaggaatacaaagttgagccacggtccttacttaaagattgaaaagataacatgtaggccaggcaggtcactgcacaactaaagcaaaccagctggtgcattcagcagcccagtgccgtgagccctgacagatgccgtatttctgagtgcttccatgtgaatgctgccctcctgtagcatgtgtccaagtggacatagccactaaccaactagttacctttggactgcaacaaaaaatgtgaaaatgaagatttatttcttttaatttacttaaaaagaaacctctgtgctagcaataaagcatttatattgtgtactcc

SEQ ID NO: 106290 - DNA, 577 bp, Homo sapiens
  Payload ID: 875
  Gene Symbol: ALDH1A2
  Gene Name: aldehyde dehydrogenase 1 family, member A2
  ENST ID: ENST00000557967
  CDS Start-End: 551-577
cagcctctagtaacttgtttcttcctggaaaagatgaatctgatcccaattaacttaaataaaacaaaccaaacaaaactctccactaccagcctggcagctagggaggcattattgggtctgaatgtaggaaatcaggaaatacttacaatcaagatgaacgtgcccaagaactcagagagggtttctttcgctaagctgctcttcaagaccagtctctgcttgaagctttttcccttttctgctccctcaggctgcatcttggggcttctctgaggactcctgtttctaccaatacctacctgttgtggtcctcactttcacagccagatgaaaatggacgttttgacaatggctcacagattcctggagatgtctgatctttataaacaacgagtggcagaactcagagagtgggagagtgttccctgtctataatccagccacaggagaacaggtgtgtgaagttcaagaagcagacaaggcagatatagacaaagcagtgcaggcagcccgcctggctttctctcttggttcagtgtggagaaggatggatgcttcagaaaggggacgtctg

SEQ ID NO: 106291 - DNA, 3924 bp, Homo sapiens
  Payload ID: 876
  Gene Symbol: ALDH1A3
  Gene Name: aldehyde dehydrogenase 1 family, member A3
  Uniprot ID: P47895
  ENST ID: ENST00000329841
  CDS Start-End: 533-2071
attcccgagcgccgcgagccggccgaagtcgggcgagcgcgccgtgcggcggctgggagtgggctgcatgtgccgcgcggggagcccgcccgacttcggggaggcagcggggcgccgtggccccgcggctcagctccctgccgggtcgggtgtcccagccctgcgacttccggggcccggcggctcctcggggagctcgtccacaggcagcctccggggcgagagagcgcgcggcgcgggcgccgggacggtccgcggcacgcgggtggagccgccggcgctcgggctcccgcaggggcggcgggcggggcggggtgaggcgggccggccgccctcccctctcctccctcccgcagcccgccctcccttcctccggtcccgcagccaattaggcggccccctcgggcgggaggcgtggggcgctgcataaagcggcggggagctgccaccccgggagcgggctgcgcagtgtccgggccgagccggtgcgccgcagactagggcgcctcgggccagggagcgcggaggagccatggccaccgctaacggggccgtggaaaacgggcagccggacaggaagccgccggccctgccgcgccccatccgcaacctggaggtcaagttcaccaagatatttatcaacaatgaatggcacgaatccaagagtgggaaaaagtttgctacatgtaacccttcaactcgggagcaaatatgtgaagtggaagaaggagataagcccgacgtggacaaggctgtggaggctgcacaggttgccttccagaggggctcgccatggcgccggctggatgccctgagtcgtgggcggctgctgcaccagctggctgacctggtggagagggaccgcgccaccttggccgccctggagacgatggatacagggaagccatttcttcatgcttttttcatcgacctggagggctgtattagaaccctcagatactttgcagggtgggcagacaaaatccagggcaagaccatccccacagatgacaacgtcgtgtgcttcaccaggcatgagcccattggtgtctgtggggccatcactccatggaacttccccctgctgatgctggtgtggaagctggcacccgccctctgctgtgggaacaccatggtcctgaagcctgcggagcagacacctctcaccgccctttatctcggctctctgatcaaagaggccgggttccctccaggagtggtgaacattgtgccaggattcgggcccacagtgggagcagcaatttcttctcaccctcagatcaacaagatcgccttcaccggctccacagaggttggaaaactggttaaagaagctgcgtcccggagcaatctgaagcgggtgacgctggagctgggggggaagaacccctgcatcgtgtgtgcggacgctgacttggacttggcagtggagtgtgcccatcagggagtgttcttcaaccaaggccagtgttgcacggcagcctccagggtgttcgtggaggagcaggtctactctgagtttgtcaggcggagcgtggagtatgccaagaaacggcccgtgggagaccccttcgatgtcaaaacagaacaggggcctcagattgatcaaaagcagttcgacaaaatcttagagctgatcgagagtgggaagaaggaaggggccaagctggaatgcgggggctcagccatggaagacaaggggctcttcatcaaacccactgtcttctcagaagtcacagacaacatgcggattgccaaagaggagattttcgggccagtgcaaccaatactgaagttcaaaagtatcgaagaagtgataaaaagagcgaatagcaccgactatggactcacagcagccgtgttcacaaaaaatctcgacaaagccctgaagttggcttctgccttagagtctggaacggtctggatcaactgctacaacgccctctatgcacaggctccatttggtggctttaaaatgtcaggaaatggcagagaactaggtgaatacgctttggccgaatacacagaagtgaaaactgtcaccatcaaacttggcgacaagaacccctgaaggaaaggcggggctccttcctcaaacatcggacggcggaatgtggcagatgaaatgtgctggaggaaaaaaatgacatttctgaccttcccgggacacattcttctggaggctttacatctactggagttgaatgattgctgttttcctctcactctcctgtttattcaccagactggggatgcctataggttgtctgtgaaatcgcagtcctgcctggggagggagctgttggccatttctgtgtttccctttaaaccagatcctggagacagtgagatactcagggcgttgttaacagggagtggtatttgaagtgtccagcagttgcttgaaatgctttgccgaatctgactccagtaagaatgtgggaaaaccccctgtgtgttctgcaagcagggctcttgcaccagcggtctcctcagggtggacctgcttacagagcaagccacgcctctttccgaggtgaaggtgggaccattccttgggaaaggattcacagtaaggttttttggtttttgttttttgttttcttgtttttaaaaaaaggatttcacagtgagaaagttttggttagtgcataccgtggaagggcgccagggtctttgtggattgcatgttgacattgaccgtgagattcggcttcaaaccaatactgcctttggaatatgacagaatcaatagcccagagagcttagtcaaagacgatatcacggtctaccttaaccaaggcactttcttaagcagaaaatattgttgaggttacctttgctgctaaagatccaatcttctaacgccacaacagcatagcaaatcctaggataattcacctcctcatttgacaaatcagagctgtaattcgctttaacaaattacgcatttctatcacgttcactaacagcttatgataagtctgtgtagtcttccttttctccagttctgttacccaatttagattagtaaagcgtacacaactggaaagactgctgtaataacacagccttgttatttttaagtcctattttgatattaatttctgattagttagtaaataacacctggattctatggaggacctcggtcttcatccaagtggcctgagtatttcactggcaggttgtgaatttttcttttcctctttggggatccaaatgatgatgtgcaatttcatgttttaacttgggaaactgaaagtgttcccatatagcttcaaaaacaaaaacaaatgtgttatccgacggatacttttatggttactaactagtactttcctaattgggaaagtagtgcttaagtttgcaaattaagttggggagggcaataataaaatgagggcccgtaacagaaccagtgtgtgtataacgaaaaccatgtataaaatgggcctatcacccttgtcagagatataaattaccacatttgccttcccttcatcagctaacacttatcacttatactaccaataacttgttaaatcaggatttggcttcatacactgaattttcagtattttatctcaagtagatatagacactaaccttgatagtgatacgttagagggttcctattcttccattgtacgataatgtctttaatatgaaatgctacattatttataattggtagagttattgtatctttttatagttgtaagtacacagaggtggtatatttaaacttctgtaatatactgtatttagaaatggaaatatatatagtgttaggtttcacttcttttaaggtttacccctgtggtgtggtttaaaaatctataggcctgggaattccgatcctagctgcagatcgcatcccacaatgcgagaatgataaaataaaattggatatttgagaaa

SEQ ID NO: 106292 - DNA, 3104 bp, Homo sapiens
  Payload ID: 876
  Gene Symbol: ALDH1A3
  Gene Name: aldehyde dehydrogenase 1 family, member A3
  ENST ID: ENST00000346623
  CDS Start-End: 34-1251
agggcgcctcgggccagggagcgcggaggagccatggccaccgctaacggggccgtggaaaacgggcagccggacaggaagccgccggccctgccgcgccccatccgcaacctggaggtcaagttcaccaagatatttatcaacaatgaatggcacgaatccaagagtgggaaaaagtttgctacatgtaacccttcaactcgggagcaaatatgtgaagtggaagaaggagataagcccgacgtggacaaggctgtggaggctgcacaggttgccttccagaggggctcgccatggcgccggctggatgccctgagtcgtgggcggctgctgcaccagctggctgacctggtggagagggaccgcgccaccttggccgccgggttccctccaggagtggtgaacattgtgccaggattcgggcccacagtgggagcagcaatttcttctcaccctcagatcaacaagatcgccttcaccggctccacagaggttggaaaactggttaaagaagctgcgtcccggagcaatctgaagcgggtgacgctggagctgggggggaagaacccctgcatcgtgtgtgcggacgctgacttggacttggcagtggagtgtgcccatcagggagtgttcttcaaccaaggccagtgttgcacggcagcctccagggtgttcgtggaggagcaggtctactctgagtttgtcaggcggagcgtggagtatgccaagaaacggcccgtgggagaccccttcgatgtcaaaacagaacaggggcctcagattgatcaaaagcagttcgacaaaatcttagagctgatcgagagtgggaagaaggaaggggccaagctggaatgcgggggctcagccatggaagacaaggggctcttcatcaaacccactgtcttctcagaagtcacagacaacatgcggattgccaaagaggagattttcgggccagtgcaaccaatactgaagttcaaaagtatcgaagaagtgataaaaagagcgaatagcaccgactatggactcacagcagccgtgttcacaaaaaatctcgacaaagccctgaagttggcttctgccttagagtctggaacggtctggatcaactgctacaacgccctctatgcacaggctccatttggtggctttaaaatgtcaggaaatggcagagaactaggtgaatacgctttggccgaatacacagaagtgaaaactgtcaccatcaaacttggcgacaagaacccctgaaggaaaggcggggctccttcctcaaacatcggacggcggaatgtggcagatgaaatgtgctggaggaaaaaaatgacatttctgaccttcccgggacacattcttctggaggctttacatctactggagttgaatgattgctgttttcctctcactctcctgtttattcaccagactggggatgcctataggttgtctgtgaaatcgcagtcctgcctggggagggagctgttggccatttctgtgtttccctttaaaccagatcctggagacagtgagatactcagggcgttgttaacagggagtggtatttgaagtgtccagcagttgcttgaaatgctttgccgaatctgactccagtaagaatgtgggaaaaccccctgtgtgttctgcaagcagggctcttgcaccagcggtctcctcagggtggacctgcttacagagcaagccacgcctctttccgaggtgaaggtgggaccattccttgggaaaggattcacagtaaggttttttggtttttgttttttgttttcttgtttttaaaaaaaggatttcacagtgagaaagttttggttagtgcataccgtggaagggcgccagggtctttgtggattgcatgttgacattgaccgtgagattcggcttcaaaccaatactgcctttggaatatgacagaatcaatagcccagagagcttagtcaaagacgatatcacggtctaccttaaccaaggcactttcttaagcagaaaatattgttgaggttacctttgctgctaaagatccaatcttctaacgccacaacagcatagcaaatcctaggataattcacctcctcatttgacaaatcagagctgtaattcgctttaacaaattacgcatttctatcacgttcactaacagcttatgataagtctgtgtagtcttccttttctccagttctgttacccaatttagattagtaaagcgtacacaactggaaagactgctgtaataacacagccttgttatttttaagtcctattttgatattaatttctgattagttagtaaataacacctggattctatggaggacctcggtcttcatccaagtggcctgagtatttcactggcaggttgtgaatttttcttttcctctttggggatccaaatgatgatgtgcaatttcatgttttaacttgggaaactgaaagtgttcccatatagcttcaaaaacaaaaacaaatgtgttatccgacggatacttttatggttactaactagtactttcctaattgggaaagtagtgcttaagtttgcaaattaagttggggagggcaataataaaatgagggcccgtaacagaaccagtgtgtgtataacgaaaaccatgtataaaatgggcctatcacccttgtcagagatataaattaccacatttgccttcccttcatcagctaacacttatcacttatactaccaataacttgttaaatcaggatttggcttcatacactgaattttcagtattttatctcaagtagatatagacactaaccttgatagtgatacgttagagggttcctattcttccattgtacgataatgtctttaatatgaaatgctacattatttataattggtagagttattgtatctttttatagttgtaagtacacagaggtggtatatttaaacttctgtaatatactgtatttagaaatggaaatatatatagtgttaggtttcacttcttttaaggtttacccctgtggtgtggtttaaaaatctataggcctgggaattccgatcctagctgcagatcgcatcccacaatgcgagaatgataaaataaaattggatatttgagaaa

SEQ ID NO: 106293 - DNA, 571 bp, Homo sapiens
  Payload ID: 876
  Gene Symbol: ALDH1A3
  Gene Name: aldehyde dehydrogenase 1 family, member A3
  ENST ID: ENST00000561338
  CDS Start-End: 138-571
gacaaagtctatggctgagtgctccagtctgatctcaggctcccaggatcacgtgggtatcaaacggaggagctgcaggtgagccagtcggcatctttgcaactggctcctgagaccagacgcctcgggtcacaaggatgtctgagtgtgagatatttatcaacaatgaatggcacgaatccaagagtgggaaaaagtttgctacatgtaacccttcaactcgggagcaaatatgtgaagtggaagaaggagataagcccgacgtggacaaggctgtggaggctgcacaggttgccttccagaggggctcgccatggcgccggctggatgccctgagtcgtgggcggctgctgcaccagctggctgacctggtggagagggaccgcgccaccttggccgccctggagacgatggatacagggaagccatttcttcatgcttttttcatcgacctggagggctgtattagaaccctcagatactttgcagggtgggcagacaaaatccagggcaagaccatccccacagatgacaacgtcgtgtgcttcaccaggcatgagcccattggtgt

SEQ ID NO: 106294 - DNA, 1670 bp, Homo sapiens
  Payload ID: 876
  Gene Symbol: ALDH1A3
  Gene Name: aldehyde dehydrogenase 1 family, member A3
  ENST ID: ENST00000557963
  CDS Start-End: 70-378
gcgcagtgtccgggccgagccggtgcgccgcagactagggcgcctcgggccagggagcgcggaggagccatggccaccgctaacggggccgtggaaaacgggcagccggacaggaagccgccggccctgccgcgccccatccgcaacctggaggtcaagttcaccaaggtgaggcgggcgcccctcccacccgacggccgcgggcccctgcgctgggcagccagactcggggcggcgggggcgagggagcagcgggccgggggtccgccgggcgccgccgagacccgagcctccctgcccgggcgcggctctccagaaaccgcacctttcgcgggacgtctcgggcgggatcgcaggcggcggggctcggcgctgtgagcctcgaagccgggaaaccgaggccgtccagcgcccgcgcggggccgggccgcccgcatccctgcgaggccccgacgtgtccctgcgctgcccgctttgatcgcgagtggaggtgcgcgccgcgttgactcggagcgcgctggttttggggagctccctccccaaaaacccctgcgatgatttccagggtggacgagtctggctttgagagggtcggagggtccgagagcgccaagagagagtccgggaggcagatggcggagctgcagttggaagactggggaagcgggtcctccgagcaaagcgcagcgggcgccttccgtgcttagtttatacccggctcagcagcagaacgaggaggagtaggaaggtgctcgcttactgacgaaacctccccggagcccagaggtcccggtgtttacacacaaggcgcgcgctccggaaggtcgcagacctgggcctttgggaagcggtgggtcgcgaggccgcagaagcgcacggttctctgcctcctcgctctgtgggctgggaggctacagcgttggcagaacggcgagattacctgcccggggcagaaaggaataaaagaagatggtgaggcctccgaggcctctgagctggggctgaggagggccgagagacccgggtccgggagcgcgacccgatggaggacacccccaggctgtctggcgtgcgcgtctgtcgtgggccggtgctggggcactttagaggcacaggccaggccgagagccattgccttaactttccccacctttggcttctcttgatttttgcttttacccatagcccccaactccagctgacaccgcacttagagaatttcctcatccgttttactttaagaagtagcaattatctttctcaaagaattttaatcaagcggagaaagttgcagggcactatgtgtggccttcagatttgggtctcttggcacttaattcccaatgtcggctgagcctctgatcacaagacatttaaattaactgttttcagaaggctctgtaatcaacaaagacacgtcgctgtaaactaaacgctggaaattattcttaatgtagttttatttgtaatatcagcttcagagtgaaaattccaacacgaattctgggaagagtgaaaatggtacccgaattttgtaagaccctaaccccaggtgcttggctgctgctactgatggttaagtggggaggttgtttgttttcttttggttgtacaggatttcaaaatactgtatatagaaaccagacagtaaatgtattatggtcctttta

SEQ ID NO: 106295 - DNA, 713 bp, Homo sapiens
  Payload ID: 876
  Gene Symbol: ALDH1A3
  Gene Name: aldehyde dehydrogenase 1 family, member A3
  ENST ID: ENST00000558033
  CDS Start-End: 96-521
gggagctgccaccccgggagcgggctgcgcagtgtccgggccgagccggtgcgccgcagactagggcgcctcgggccagggagcgcggaggagccatggccaccgctaacggggccgtggaaaacgggcagccggacaggaagccgccggccctgccgcgccccatccgcaacctggaggtcaagttcaccaagatatttatcaacaatgaatggcacgaatccaagagtgggaaaaagtttgctacatgtaacccttcaactcgggagcaaatatgtgaagtggaagaaggagataagcccgacgtggacaaggctgtggaggctgcacaggttgccttccagaggggctcgccatggcgccggctggatgccctgagtcgtgggcggctgctgcaccagctggctgacctggtggagagggaccgcgccaccttggccatgacaacgtcgtgtgcttcaccaggcatgagcccattggtgtctgtggggccatcactccatggaacttccccctgctgatgctggtgtggaagctggcacccgccctctgctgtgggaacaccatggtcctgaagcctgcggagcagacacctctcaccgccctttatctcggctctctgatcaaagaggccgggttccctccaggagtggtgaacattgtgccaggattcgggcccacagtgggagcagcaatttcttctcaccctcaga

SEQ ID NO: 106296 - DNA, 3066 bp, Homo sapiens
  Payload ID: 877
  Gene Symbol: ALDH1B1
  Gene Name: aldehyde dehydrogenase 1 family, member B1
  Uniprot ID: P30837
  ENST ID: ENST00000377698
  CDS Start-End: 154-1707
aggcggagcctcattggccgctgagccccgggctgcgcggaggcgggacctgcggccagccctgggcggccatgtggacagagctgggagggccggaaccagaacccaagcgtgatcctgaaccggagcccgagcctgctgcagagtgtcagcatgctgcgcttcctggcaccccggctgcttagcctccagggcaggaccgcccgctactcctcggcagcagccctcccaagccccattctgaacccagacatcccctacaaccagctgttcatcaacaatgaatggcaagatgcagtcagcaagaagaccttcccgacggtcaaccctaccaccggggaggtcattgggcacgtggctgaaggtgaccgggctgatgtggatcgggccgtgaaagcagcccgggaagccttccgcctggggtccccatggcgccggatggatgcctctgagcggggccggctgctgaaccgcctggcagacctagtggagcgggatcgagtctacttggcctcactcgagaccttggacaatgggaagcctttccaagagtcttacgccttggacttggatgaggtcatcaaggtgtatcggtactttgctggctgggctgacaagtggcatggcaagaccatccccatggatggccagcatttctgcttcacccggcatgagcccgttggtgtctgtggccagatcatcccgtggaacttccccttggtcatgcagggttggaaacttgccccggcactcgccacaggcaacactgtggttatgaaggtggcagagcagacccccctctctgccctgtatttggcctccctcatcaaggaggcaggctttccccctggggtggtgaacatcatcacggggtatggcccaacagcaggtgcggccatcgcccagcacgtggatgttgacaaagttgccttcaccggttccaccgaggtgggccacctgatccagaaagcagctggcgattccaacctcaagagagtcaccctggagctgggtggtaagagccccagcatcgtgctggccgatgctgacatggagcatgccgtggagcagtgccacgaagccctgttcttcaacatgggccagtgctgctgtgctggctcccggaccttcgtggaagaatccatctacaatgagtttctcgagagaaccgtggagaaagcaaagcagaggaaagtggggaacccctttgagctggacacccagcaggggcctcaggtggacaaggagcagtttgaacgagtcctaggctacatccagcttggccagaaggagggcgcaaaactcctctgtggcggagagcgtttcggggagcgtggtttcttcatcaagcctactgtctttggtggcgtgcaggatgacatgagaattgccaaagaggagatctttgggcctgtgcagcccctgttcaagttcaagaagattgaggaggtggttgagagggccaacaacaccaggtatggcctggctgcggctgtgttcacccgggatctggacaaggccatgtacttcacccaggcactccaggccgggaccgtgtgggtaaacacctacaacatcgtcacctgccacacgccatttggagggtttaaggaatctggaaacgggagggagctgggtgaggatgggcttaaggcctacacagaggtaaagacggtcaccatcaaggttcctcagaagaactcgtaagagcagctgtcagggaggcccagtcacagtccagcaattccacaaccaccttgacgaatgcttgccaagctgttttaaagccaagaacaccctttctttgttccaaattaactcttagaagaaaccccacaaataaagcaattcaatcaaggctgttctatttaaatcagagatggggaccaggctcagagttctacctatctaacccccaaccacagcccccttggtggcccatgagttgcttccatgaaatcttaggagtctctggaggacagattaaaaaccagtgatctgtaatttgtagctcttcctgctgatccaaggactttcccatgggtgcgcttgatggtttagtggatcgactcaactcagaacacaagcttggaaagtgttaggggttttgaactaggtggatactaaatctcggccccactcttcattggcttaacctaaaaaccagaggtgcttttccttgtctgtgtgccagttgctggctgttttagttgcttgcccttcattttgctactgattttccttaatttgtgggaaggagtaggcaaagaatatgcttacatgattacacctgtaaagtaagcccaaacatcccaaatgtccgtcaactgatgagtggattaataaaatgtttccatggaatattccttggattactcagccataaaaaggaatgaagtactgacacatgctgtgacatcagtgaaccctgaaaacatccttctcagtgaaacaagccagagagatgtacaaggctacagactgtatgattccatttatatgaaatatacatactaggcaaatccatggagatggaacatagattagtggttgccaggggatagaggagtaattgttagtgggcatgggatttgtttttgggaggttttgaaaatgttctggagttgaacaatagtaatggttgcatgatttggtaaaaatactaaaaactatggaattgtttaattatggtatatgaattaatttctttctttttttcttttttttttttttttttgacacggagtctcactctgtcgcccaggctggagtgcagtggtgtgatctcgtctcactgcaacctccgcctcccagattcaagcgattctcctgtctcagcctcctgagtagctgggattataggtacatgccatcacacctggctaatttttgtatttttagtagagatgaggtttcaccattttggccaggctgatcttgaactcctgacctcaggtgatccacccgcctcagcctcccaaagtgctgggattacaggtgggagccacaacacccggccatgaattaactccgttaaaaaataaacgtatacattctgtgagcaaa

SEQ ID NO: 106297 - DNA, 584 bp, Homo sapiens
  Payload ID: 877
  Gene Symbol: ALDH1B1
  Gene Name: aldehyde dehydrogenase 1 family, member B1
  ENST ID: ENST00000635162
  CDS Start-End: 195-584
cctgcggccagccctgggcggccatgtggacagagctgggagggccggaaccagaacccaagcgtgatcctgaaccggagcccgagcctgctgcagagacacggttcttgctatgtgctcaggctggtctcaaactcctggcctcaagcagtccttccacttcggcctaccaaagcgttaccagcagtgtcagcatgctgcgcttcctggcaccccggctgcttagcctccagggcaggaccgcccgctactcctcggcagcagccctcccaagccccattctgaacccagacatcccctacaaccagctgttcatcaacaatgaatggcaagatgcagtcagcaagaagaccttcccgacggtcaaccctaccaccggggaggtcattgggcacgtggctgaaggtgaccgggctgatgtggatcgggccgtgaaagcagcccgggaagccttccgcctggggtccccatggcgccggatggatgcctctgagcggggccggctgctgaaccgcctggcagacctagtggagcgggatcgagtctacttggcctcactcgagaccttggacaatgggaagcct

SEQ ID NO: 106298 - DNA, 3179 bp, Homo sapiens
  Payload ID: 878
  Gene Symbol: ALDH1L1
  Gene Name: aldehyde dehydrogenase 1 family, member L1
  Uniprot ID: O75891
  ENST ID: ENST00000273450
  CDS Start-End: 219-2957
tctgcggcaccaggactgagtagaagggagagagtggagaaggggaattgcagagagaaaaccaggggctgtttttctctcggagaggcgggtaggcactgggcgggcagaagcgccgctatccacccggatgcgcagctgctaaggggccgcctctgcaagcggctgcaaattcccggagggcagcgtctcctttcgctctgctgtgtccgtagcacatggcaggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccatcaactggaccctcattcacggagataagaaaggggggttttccatcttctgggcggatgatggtctggacaccggagacctgctgctgcagaaggagtgtgaggtgctcccggacgacaccgtgagcacgctgtacaaccgcttcctcttccctgaaggcatcaaagggatggtgcaggccgtgaggctgatcgctgagggcaaagcccccagactccctcagcctgaggaaggagccacctatgaggggattcagaagaaggagacagccaagatcaactgggaccagccggcagaggccattcacaactggatccgcgggaacgacaaggtgccgggagcctggacagaggcctgtgaacagaaactgacatttttcaactcaacgctgaacacttcaggcctggtgcccgagggagacgctttgcccatcccaggagcccatcggccaggggtggtcaccaaagcaggactcatcctctttgggaatgatgacaaaatgctgctggtgaagaatattcagctggaggatggcaaaatgatcctggcctcgaacttctttaagggggcagccagcagtgtccttgagctgacagaggcagagctggttactgcggaggctgtgcggagtgtttggcagcggatcctccccaaagtcctggaggttgaagactccactgatttcttcaagtcaggggccgcgtctgtggacgttgtgaggctggtggaggaagtgaaggagctgtgtgatggcctggagttagaaaatgaagatgtgtacatggcatccacctttggggacttcatccagctgttagtgaggaagctgcgaggggacgatgaggagggcgagtgcagcattgactacgtggaaatggcagtgaacaagcgcactgtccgcatgccccaccagctcttcattgggggggagttcgtggatgccgagggcgccaagacctctgagaccatcaatcccaccgatggaagtgtcatctgccaggtatccctggcccaagtcaccgacgtcgacaaggcagtggccgcagccaaggatgcctttgagaatggacggtgggggaagatcagtgcgcgggaccggggccggctgatgtacaggttggcagatctcatggagcagcaccaggaggagctggccaccattgaggccctggatgcgggtgccgtctacacgctggccctgaagacccacgtgggcatgtccatccagaccttccgctactttgctggctggtgtgacaagatccagggctccaccatccccatcaaccaggccagacccaaccgcaacctgaccttgaccaggaaggagcctgttggggtttgtggcatcatcatcccctggaactatcccctgatgatgctgtcctggaagacagctgcctgcctggctgccgggaacacagtggtgatcaagcctgctcaggtgaccccactcacagccttgaagtttgcagagctgacattaaaggccggcattcccaaaggtgtggttaacgtcctcccaggatctggctccctggtcggccagagactctcagaccatcctgatgtgaggaaaatcgggttcacaggctccacagaggtgggcaagcacatcatgaaaagctgtgccataagtaacgtgaagaaggtgtccctggaactgggcgggaagtcacccctcatcatctttgctgactgtgacctcaacaaggctgtgcagatggggatgagttctgttttcttcaacaaaggagagaattgcattgcagcaggccgactctttgtggaggactccattcatgatgagttcgtgcggagagtggtagaagaggtgcggaagatgaaggtgggcaacccgctggacagggacaccgaccacgggccgcagaatcaccatgcccaccttgtgaagctgatggagtactgccagcatggcgtgaaggaaggggccacactggtctgcggcgggaatcaggtccctcggccagggttcttctttgagccaactgttttcacagacgtggaagaccacatgttcatagccaaggaggagtccttcgggcctgtcatgatcatctctcggtttgctgatggggacttggatgccgtgctgtctcgggccaatgccacggaatttggcctggcttctggtgtcttcaccagggacatcaacaaggccctgtatgtcagtgacaagctccaggcaggcactgtgtttgtcaacacgtacaacaagaccgacgtggccgctcccttcggaggattcaaacagtctggatttggcaaagatctaggagaggcggctctgaacgagtacctgcgggtcaagacagtgaccttcgaatactgaagaaaggtctttgtgagaagaaagtccctgcccctccctcgtggctggggccccctccctcttgagcctgggtgcacagcacctcccacctggggggctagtggaagccctcctgcctgcacaccatgtctgcatcttggacgccctctgtccagtcagaagcagcccttggctgggtgaggtgtgcccctcccagggagaataaagcttctgaagagagac

SEQ ID NO: 106299 - DNA, 2797 bp, Homo sapiens
  Payload ID: 878
  Gene Symbol: ALDH1L1
  Gene Name: aldehyde dehydrogenase 1 family, member L1
  Uniprot ID: O75891
  ENST ID: ENST00000393431
  CDS Start-End: 124-1641
ctcctggctcccaggacgggtctgcaccaacctcagtttcggggctgcggctcacagaagtctaacctgcccgggacgcccgcaccaactcctgcgcgcggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccatcaactggaccctcattcacggagataagaaaggggggttttccatcttctgggcggatgatggtctggacaccggagacctgctgctgcagaaggagtgtgaggtgctcccggacgacaccgtgagcacgctgtacaaccgcttcctcttccctgaaggcatcaaagggatggtgcaggccgtgaggctgatcgctgagggcaaagcccccagactccctcagcctgaggaaggagccacctatgaggggattcagaagaaggagacagccaagatcaactgggaccagccggcagaggccattcacaactggatccgcgggaacgacaaggtgccgggagcctggacagaggcctgtgaacagaaactgacatttttcaactcaacgctgaacacttcaggcctggtgcccgagggagacgctttgcccatcccaggagcccatcggccaggggtggtcaccaaagcaggactcatcctctttgggaatgatgacaaaatgctgctggtgaagaatattcagctggaggatggcaaaatgatcctggcctcgaacttctttaagggggcagccagcagtgtccttgagctgacagaggcagagctggttactgcggaggctgtgcggagtgtttggcagcggatcctccccaaagtcctggaggttgaagactccactgatttcttcaagtcaggggccgcgtctgtggacgttgtgaggctggtggaggaagtgaaggagctgtgtgatggcctggagttagaaaatgaagatgtgtacatggcatccacctttggggacttcatccagctgttagtgaggaagctgcgaggggacgatgaggagggcgagtgcagcattgactacgtggaaatggcagtgaacaagcgcactgtccgcatgccccaccagctcttcattgggggggagttcgtggatgccgagggcgccaagacctctgagaccatcaatcccaccgatggaagtgtcatctgccaggtatccctggcccaagtcaccgacgtcgacaaggcagtggccgcagccaaggatgcctttgagaatggacggtgggggaagatcagtgcgcgggaccggggccggctgatgtacagggctccaccatccccatcaaccaggccagacccaaccgcaacctgaccttgaccaggaaggagcctgttggggtttgtggcatcatcatcccctggaactatcccctgatgatgctgtcctggaagacagctgcctgcctggctgccgggaacacagtggtgatcaagcctgctcaggtgaccccactcacagccttgaagtttgcagagctgacattaaaggccggcattcccaaaggtgtggttaacgtcctcccaggatctggctccctggtcggccagagactctcagaccatcctgatgtgaggaaaatcgggttcacaggctccacagaggtgggcaagcacatcatgaaaaggggatgagttctgttttcttcaacaaaggagagaattgcattgcagcaggccgactctttgtggaggactccattcatgatgagttcgtgcggagagtggtagaagaggtgcggaagatgaaggtgggcaacccgctggacagggacaccgaccacgggccgcagaatcaccatgcccaccttgtgaagctgatggagtactgccagcatggcgtgaaggaaggggccacactggtctgcggcgggaatcaggtccctcggccagggttcttctttgagccaactgttttcacagacgtggaagaccacatgttcatagccaaggaggagtccttcgggcctgtcatgatcatctctcggtttgctgatggggacttggatgccgtgctgtctcgggccaatgccacggaatttggcctggcttctggtgtcttcaccagggacatcaacaaggccctgtatgtcagtgacaagctccaggcaggcactgtgtttgtcaacacgtacaacaagaccgacgtggccgctcccttcggaggattcaaacagtctggatttggcaaagatctaggagaggcggctctgaacgagtacctgcgggtcaagacagtgaccttcgaatactgaagaaaggtctttgtgagaagaaagtccctgcccctccctcgtggctggggccccctccctcttgagcctgggtgcacagcacctcccacctggggggctagtggaagccctcctgcctgcacaccatgtctgcatcttggacgccctctgtccagtcagaagcagcccttggctgggtgaggtgtgcccctcccagggagaataaagcttctgaag

SEQ ID NO: 106300 - DNA, 3277 bp, Homo sapiens
  Payload ID: 878
  Gene Symbol: ALDH1L1
  Gene Name: aldehyde dehydrogenase 1 family, member L1
  Uniprot ID: O75891
  ENST ID: ENST00000393434
  CDS Start-End: 351-3059
acagtaagtcttcttgacctaagcgggaaagagcgcaggcccctgcggggttggcttttacatggcatttatagacccgcccggagagggtgcgctgcgctcccgccatagtcccaccaccggtgagcgccgcccccactcggctgactctccgcccgccccgcgcccctcccctcacgggctctggccttaaccagagctcgcggactggcggggacaggtcccacctcctggctcccaggacgggtctgcaccaacctcagtttcggggctgcggctcacagaagtctaacctgcccgggacgcccgcaccaactcctgcgcgcggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccatcaactggaccctcattcacggagataagaaaggggggttttccatcttctgggcggatgatggtctggacaccggagacctgctgctgcagaaggagtgtgaggtgctcccggacgacaccgtgagcacgctgtacaaccgcttcctcttccctgaaggcatcaaagggatggtgcaggccgtgaggctgatcgctgagggcaaagcccccagactccctcagcctgaggaaggagccacctatgaggggattcagaagaaggagacagccaagatcaactgggaccagccggcagaggccattcacaactggatccgcgggaacgacaaggtgccgggagcctggacagaggcctgtgaacagaaactgacatttttcaactcaacgctgaacacttcaggcctggtgcccgagggagacgctttgcccatcccaggagcccatcggccaggggtggtcaccaaagcaggactcatcctctttgggaatgatgacaaaatgctgctggtgaagaatattcagctggaggatggcaaaatgatcctggcctcgaacttctttaagggggcagccagcagtgtccttgagctgacagaggcagagctggttactgcggaggctgtgcggagtgtttggcagcggatcctccccaaagtcctggaggttgaagactccactgatttcttcaagtcaggggccgcgtctgtggacgttgtgaggctggtggaggaagtgaaggagctgtgtgatggcctggagttagaaaatgaagatgtgtacatggcatccacctttggggacttcatccagctgttagtgaggaagctgcgaggggacgatgaggagggcgagtgcagcattgactacgtggaaatggcagtgaacaagcgcactgtccgcatgccccaccagctcttcattgggggggagttcgtggatgccgagggcgccaagacctctgagaccatcaatcccaccgatggaagtgtcatctgccaggtatccctggcccaagtcaccgacgtcgacaaggcagtggccgcagccaaggatgcctttgagaatggacggtgggggaagatcagtgcgcgggaccggggccggctgatgtacaggttggcagatctcatggagcagcaccaggaggagctggccaccattgaggccctggatgcgggtgccgtctacacgctggccctgaagacccacgtgggcatgtccatccagaccttccgctactttgctggctggtgtgacaagatccagggctccaccatccccatcaaccaggccagacccaaccgcaacctgaccttgaccaggaaggagcctgttggggtttgtggcatcatcatcccctggaactatcccctgatgatgctgtcctggaagacagctgcctgcctggctgccgggaacacagtggtgatcaagcctgctcaggtgaccccactcacagccttgaagtttgcagagctgacattaaaggccggcattcccaaaggtgtggttaacgtcctcccaggatctggctccctggtcggccagagactctcagaccatcctgatgtgaggaaaatcgggttcacaggctccacagaggtgggcaagcacatcatgaaaagctgtgccataagtaacgtgaagaaggtgtccctggaactgggcgggaagtcacccctcatcatctttgctgactgtgacctcaacaaggctgtgcagatggggatgagttctgttttcttcaacaaaggagagaattgcattgcagcaggccgactctttgtggaggactccattcatgatgagttcgtgcggagagtggtagaagaggtgcggaagatgaaggtgggcaacccgctggacagggacaccgaccacgggccgcagaatcaccatgcccaccttgtgaagctgatggagtactgccagcatggcgtgaaggaaggggccacactggtctgcggcgggaatcaggtccctcggccagggttcttctttgagccaactgttttcacagacgtggaagaccacatgttcatagccaaggaggagtccttcgggcctgtcatgatcatctctcggtttgctgatggggacttggatgccgtgctgtctcgggccaatgccacggaatttggcctggcttctggtgtcttcaccagggacatcaacaaggccctgtatgtcagtgacaagctccaggcaggcactgtgtttgtcaacacgtacaacaagaccgacgtggccgctcccttcggaggattcaaacagtctggatttggcaaagatctaggagaggcggctctgaacgagtacctgcgggtcaagacagtgaccttcgaatactgaagaaaggtctttgtgagaagaaagtccctgcccctccctcgtggctggggccccctccctcttgagcctgggtgcacagcacctcccacctggggggctagtggaagccctcctgcctgcacaccatgtctgcatcttggacgccctctgtccagtcagaagcagcccttggctgggtgaggtgtgcccctcccagggagaataaagcttctgaagag

SEQ ID NO: 106301 - DNA, 2758 bp, Homo sapiens
  Payload ID: 878
  Gene Symbol: ALDH1L1
  Gene Name: aldehyde dehydrogenase 1 family, member L1
  Uniprot ID: O75891
  ENST ID: ENST00000452905
  CDS Start-End: 135-2540
acaggtcccacctcctggctcccaggacgggtctgcaccaacctcagtttcggggctgcggctcacagaagtctaacctgcccgggacgcccgcaccaactcctgcgcgcggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccattcacaactggatccgcgggaacgacaaggtgccgggagcctggacagaggcctgtgaacagaaactgacatttttcaactcaacgctgaacacttcaggcctggtgcccgagggagacgctttgcccatcccaggagcccatcggccaggggtggtcaccaaagcaggactcatcctctttgggaatgatgacaaaatgctgctggtgaagaatattcagctggaggatggcaaaatgatcctggcctcgaacttctttaagggggcagccagcagtgtccttgagctgacagaggcagagctggttactgcggaggctgtgcggagtgtttggcagcggatcctccccaaagtcctggaggttgaagactccactgatttcttcaagtcaggggccgcgtctgtggacgttgtgaggctggtggaggaagtgaaggagctgtgtgatggcctggagttagaaaatgaagatgtgtacatggcatccacctttggggacttcatccagctgttagtgaggaagctgcgaggggacgatgaggagggcgagtgcagcattgactacgtggaaatggcagtgaacaagcgcactgtccgcatgccccaccagctcttcattgggggggagttcgtggatgccgagggcgccaagacctctgagaccatcaatcccaccgatggaagtgtcatctgccaggtatccctggcccaagtcaccgacgtcgacaaggcagtggccgcagccaaggatgcctttgagaatggacggtgggggaagatcagtgcgcgggaccggggccggctgatgtacaggttggcagatctcatggagcagcaccaggaggagctggccaccattgaggccctggatgcgggtgccgtctacacgctggccctgaagacccacgtgggcatgtccatccagaccttccgctactttgctggctggtgtgacaagatccagggctccaccatccccatcaaccaggccagacccaaccgcaacctgaccttgaccaggaaggagcctgttggggtttgtggcatcatcatcccctggaactatcccctgatgatgctgtcctggaagacagctgcctgcctggctgccgggaacacagtggtgatcaagcctgctcaggtgaccccactcacagccttgaagtttgcagagctgacattaaaggccggcattcccaaaggtgtggttaacgtcctcccaggatctggctccctggtcggccagagactctcagaccatcctgatgtgaggaaaatcgggttcacaggctccacagaggtgggcaagcacatcatgaaaagctgtgccataagtaacgtgaagaaggtgtccctggaactgggcgggaagtcacccctcatcatctttgctgactgtgacctcaacaaggctgtgcagatggggatgagttctgttttcttcaacaaaggagagaattgcattgcagcaggccgactctttgtggaggactccattcatgatgagttcgtgcggagagtggtagaagaggtgcggaagatgaaggtgggcaacccgctggacagggacaccgaccacgggccgcagaatcaccatgcccaccttgtgaagctgatggagtactgccagcatggcgtgaaggaaggggccacactggtctgcggcgggaatcaggtccctcggccagggttcttctttgagccaactgttttcacagacgtggaagaccacatgttcatagccaaggaggagtccttcgggcctgtcatgatcatctctcggtttgctgatggggacttggatgccgtgctgtctcgggccaatgccacggaatttggcctggcttctggtgtcttcaccagggacatcaacaaggccctgtatgtcagtgacaagctccaggcaggcactgtgtttgtcaacacgtacaacaagaccgacgtggccgctcccttcggaggattcaaacagtctggatttggcaaagatctaggagaggcggctctgaacgagtacctgcgggtcaagacagtgaccttcgaatactgaagaaaggtctttgtgagaagaaagtccctgcccctccctcgtggctggggccccctccctcttgagcctgggtgcacagcacctcccacctggggggctagtggaagccctcctgcctgcacaccatgtctgcatcttggacgccctctgtccagtcagaagcagcccttggctgggtgaggtgtgcccctcccagggagaataaagcttctgaagag

SEQ ID NO: 106302 - DNA, 3137 bp, Homo sapiens
  Payload ID: 878
  Gene Symbol: ALDH1L1
  Gene Name: aldehyde dehydrogenase 1 family, member L1
  Uniprot ID: O75891
  ENST ID: ENST00000455064
  CDS Start-End: 351-1868
acagtaagtcttcttgacctaagcgggaaagagcgcaggcccctgcggggttggcttttacatggcatttatagacccgcccggagagggtgcgctgcgctcccgccatagtcccaccaccggtgagcgccgcccccactcggctgactctccgcccgccccgcgcccctcccctcacgggctctggccttaaccagagctcgcggactggcggggacaggtcccacctcctggctcccaggacgggtctgcaccaacctcagtttcggggctgcggctcacagaagtctaacctgcccgggacgcccgcaccaactcctgcgcgcggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccatcaactggaccctcattcacggagataagaaaggggggttttccatcttctgggcggatgatggtctggacaccggagacctgctgctgcagaaggagtgtgaggtgctcccggacgacaccgtgagcacgctgtacaaccgcttcctcttccctgaaggcatcaaagggatggtgcaggccgtgaggctgatcgctgagggcaaagcccccagactccctcagcctgaggaaggagccacctatgaggggattcagaagaaggagacagccaagatcaactgggaccagccggcagaggccattcacaactggatccgcgggaacgacaaggtgccgggagcctggacagaggcctgtgaacagaaactgacatttttcaactcaacgctgaacacttcaggcctggtgcccgagggagacgctttgcccatcccaggagcccatcggccaggggtggtcaccaaagcaggactcatcctctttgggaatgatgacaaaatgctgctggtgaagaatattcagctggaggatggcaaaatgatcctggcctcgaacttctttaagggggcagccagcagtgtccttgagctgacagaggcagagctggttactgcggaggctgtgcggagtgtttggcagcggatcctccccaaagtcctggaggttgaagactccactgatttcttcaagtcaggggccgcgtctgtggacgttgtgaggctggtggaggaagtgaaggagctgtgtgatggcctggagttagaaaatgaagatgtgtacatggcatccacctttggggacttcatccagctgttagtgaggaagctgcgaggggacgatgaggagggcgagtgcagcattgactacgtggaaatggcagtgaacaagcgcactgtccgcatgccccaccagctcttcattgggggggagttcgtggatgccgagggcgccaagacctctgagaccatcaatcccaccgatggaagtgtcatctgccaggtatccctggcccaagtcaccgacgtcgacaaggcagtggccgcagccaaggatgcctttgagaatggacggtgggggaagatcagtgcgcgggaccggggccggctgatgtacagggctccaccatccccatcaaccaggccagacccaaccgcaacctgaccttgaccaggaaggagcctgttggggtttgtggcatcatcatcccctggaactatcccctgatgatgctgtcctggaagacagctgcctgcctggctgccgggaacacagtggtgatcaagcctgctcaggtgaccccactcacagccttgaagtttgcagagctgacattaaaggccggcattcccaaaggtgtggttaacgtcctcccaggatctggctccctggtcggccagagactctcagaccatcctgatgtgaggaaaatcgggttcacaggctccacagaggtgggcaagcacatcatgaaaagctgtgccataagtaacgtgaagaaggtgtccctggaactgggcgggaagtcacccctcatcatctttgctgactgtgacctcaacaaggctgtgcagatggggatgagttctgttttcttcaacaaaggagagaattgcattgcagcaggccgactctttgtggaggactccattcatgatgagttcgtgcggagagtggtagaagaggtgcggaagatgaaggtgggcaacccgctggacagggacaccgaccacgggccgcagaatcaccatgcccaccttgtgaagctgatggagtactgccagcatggcgtgaaggaaggggccacactggtctgcggcgggaatcaggtccctcggccagggttcttctttgagccaactgttttcacagacgtggaagaccacatgttcatagccaaggaggagtccttcgggcctgtcatgatcatctctcggtttgctgatggggacttggatgccgtgctgtctcgggccaatgccacggaatttggcctggcttctggtgtcttcaccagggacatcaacaaggccctgtatgtcagtgacaagctccaggcaggcactgtgtttgtcaacacgtacaacaagaccgacgtggccgctcccttcggaggattcaaacagtctggatttggcaaagatctaggagaggcggctctgaacgagtacctgcgggtcaagacagtgaccttcgaatactgaagaaaggtctttgtgagaagaaagtccctgcccctccctcgtggctggggccccctccctcttgagcctgggtgcacagcacctcccacctggggggctagtggaagccctcctgcctgcacaccatgtctgcatcttggacgccctctgtccagtcagaagcagcccttggctgggtgaggtgtgcccctcccagggagaataaagcttctgaagagagaccgtccac

SEQ ID NO: 106303 - DNA, 615 bp, Homo sapiens
  Payload ID: 878
  Gene Symbol: ALDH1L1
  Gene Name: aldehyde dehydrogenase 1 family, member L1
  ENST ID: ENST00000490367
  CDS Start-End: 83-615
atatctgatatgtgataccatatgggagcaggctctgaaagaacactacaagtagagaggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccatcaactggaccctcattcacggagataagaaaggggggttttccatcttctgggcggatgatggtctggacaccggagacctgctgctgcagaaggagtgtgaggtgctcccggacgacaccgtgagcacgctgtacaaccgcttcctcttccctgaaggcatcaaagggatggtgca

SEQ ID NO: 106304 - DNA, 1010 bp, Homo sapiens
  Payload ID: 878
  Gene Symbol: ALDH1L1
  Gene Name: aldehyde dehydrogenase 1 family, member L1
  ENST ID: ENST00000493803
  CDS Start-End: 135-380
acaggtcccacctcctggctcccaggacgggtctgcaccaacctcagtttcggggctgcggctcacagaagtctaacctgcccgggacgcccgcaccaactcctgcgcgcggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggaccctcattcacggagataagaaaggggggttttccatcttctgggcggatgatggtctggacaccggagacctgctgctgcagaaggagtgtgaggtgctcccggacgacaccgtgagcacgctgtacaaccgcttcctcttccctgaaggcatcaaagggatggtgcaggccgtgaggctgatcgctgagggcaaagcccccagactccctcagcctgaggaaggagccacctatgaggggattcagaagaaggagacagccaagatcaactgggaccagccggcagaggccattcacaactggatccgcgggaacgacaaggtgccgggagcctggacagaggcctgtgaacagaaactgacatttttcaactcaacgctgaacacttcaggcctggtgcccgagggagacgctttgcccatcccaggagcccatcggccaggggtggtcaccaaagcaggactcatcctctttgggaatgatgacaaaatggtaagggcacggctgtgggtcacttgcctgctcaaagccacccatgctcctgtccttggactcaggcctcacaggaagaccctaggctcctctggagaaaatggaaaaaaccagacccaggaaggaacactgaccctgatttgtccctgaccacccggctggtcctgagcacagggtgtccgaggcagtttacccacttctctgttctgggaaagctgggctccctacccttcctggctaggcacccatctcc

SEQ ID NO: 106305 - DNA, 2192 bp, Homo sapiens
  Payload ID: 878
  Gene Symbol: ALDH1L1
  Gene Name: aldehyde dehydrogenase 1 family, member L1
  ENST ID: ENST00000473607
  CDS Start-End: 78-221
gcggctcacagaagtctaacctgcccgggacgcccgcaccaactcctgcgcgcggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctggacaccaggacagagtgacagaggaggagaccggagaggagagccagtccagtcagggcccaaacatcacaccagaggctctaacagagaactgaatacaaagaagtgttccttgggtattgaagagtggaaggcagagagcccaaagttattggggacagcgactgcaggaagcagctgccactgtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccatcaactggaccctcattcacggagataagaaaggggggttttccatcttctgggcggatgatggtctggacaccggagacctgctgctgcagaaggagtgtgaggtgctcccggacgacaccgtgagcacgctgtacaaccgcttcctcttccctgaaggcatcaaagggatggtgcaggccgtgaggctgatcgctgagggcaaagcccccagactccctcagcctgaggaaggagccacctatgaggggattcagaagaaggagacagccaagatcaactgggaccagccggcagaggccattcacaactggatccgcgggaacgacaaggtgccgggagcctggacagaggcctgtgaacagaaactgacatttttcaactcaacgctgaacacttcaggcctggtgcccgagggagacgctttgcccatcccaggagcccatcggccaggggtggtcaccaaagcaggactcatcctctttgggaatgatgacaaaatgctgctggtgaagaatattcagctggaggatggcaaaatgatcctggcctcgaacttctttaagggggcagccagcagtgtccttgagctgacagaggcagagctggttactgcggaggctgtgcggagtgtttggcagcggatcctccccaaagtcctggaggttgaagactccactgatttcttcaagtcaggggccgcgtctgtggacgttgtgaggctggtggaggaagtgaaggagctgtgtgatggcctggagttagaaaatgaagatgtgtacatggcatccacctttggggacttcatccagctgttagtgaggaagctgcgaggggacgatgaggagggcgagtgcagcattgactacgtggaaatggcagtgaacaagcgcactgtccgcatgccccaccagctcttcattgggggggagttcgtggatgccgagggcgccaagacctctgagaccatcaatcccaccgatggaagtgtcatctgccaggtatccctggcccaagtcaccgacgtcgacaaggcagtggccgcagccaaggatgcctttgagaatggacggtgggggaagatcagtgcgcgggaccggggccggctgatgtacaggtgggagcccaacatgtacctgccagccactgccaccatcagcttctgggcagtggcacgggggggacttctgtggaggcccttttacctgccaggaggagctgggtcctggggaggctatgggaccgaggccatcagatgggccaggctggggctccttgcctgaggctcagaaaaggcttctcagaggaagggatatgagaaacaggagacatttcagcagagtgggctcaggggaggtgcctggtggaggtgaggaggtgcggaagccaagggatgcttccaaagtgggcgcaggctgggcctcccaggcagacaaagcacttccctcaccagcctgggctggaggggacttagctcctgcacgcagaagacagcaagggccagagaagggctggcctggtctctgcttgctcagccaggctctgactactggaatctataggtttcacattttct

SEQ ID NO: 106306 - DNA, 1020 bp, Homo sapiens
  Payload ID: 878
  Gene Symbol: ALDH1L1
  Gene Name: aldehyde dehydrogenase 1 family, member L1
  ENST ID: ENST00000460368
  CDS Start-End: 515-1020
acagtaagtcttcttgacctaagcgggaaagagcgcaggcccctgcggggttggcttttacatggcatttatagacccgcccggagagggtgcgctgcgctcccgccatagtcccaccaccggtgagcgccgcccccactcggctgactctccgcccgccccgcgcccctcccctcacgggctctggccttaaccagagctcgcggactggcggggacaggtcccacctcctggctcccaggacgggtctgcaccaacctcagtttcggggctgcggctcacagaagtctaacctgcccgggacgcccgcaccaactcctgcgcgcggtgagtttctgggctctcgagagcgctggactcccggcggaaaggaggctgccccggctgcagctccgggggctccgggggctccaggggctccaggactcggttctcaccgcaagggctcctgcggggcccatcaacttcgccgctgggacgccgggctcggggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccatcaactggaccctcattcacggagataagaaaggggggttttccatcttctgggcggatgatggtctggacaccggagacctgctgctgcagaaggagtgtgaggtgctcccggacgacaccgtgagcacgctgtacaaccgcttcctctt

SEQ ID NO: 106307 - DNA, 689 bp, Homo sapiens
  Payload ID: 878
  Gene Symbol: ALDH1L1
  Gene Name: aldehyde dehydrogenase 1 family, member L1
  ENST ID: ENST00000488356
  CDS Start-End: 219-689
ctttcgctctgctgtgtccgtagcacatggcaggtacttggcccatcaagagtgagagagggtgagcgagtgagtgagtcaccggcttggcgagggtctcctctgacccacttagccttgccagcgctcagaactgccagccctgctgggtgcttgggacttttcaaagccctgggaattctccaagggtccacagtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccatcaactggaccctcattcacggagataagaaaggggggttttccatcttctgggcggatgatggtctggacaccggagacctgctgctgcagaaggagtgtgaggtgctcccggac

SEQ ID NO: 106308 - DNA, 3157 bp, Homo sapiens
  Payload ID: 878
  Gene Symbol: ALDH1L1
  Gene Name: aldehyde dehydrogenase 1 family, member L1
  Uniprot ID: O75891
  ENST ID: ENST00000472186
  CDS Start-End: 229-2937
actgcgctcaagtggacggtcgcgcgtgcagagggaggccggatagcagaccccacaacgtggctcctggggccccgctatcgagagctcaggccccgcgggcacttgcctaggagaggaaagaatcttcccaaagtgcagacagagacggaatttaatcaggagtcccagacttggagtttggaggcatgggctctggtgtcaggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccatcaactggaccctcattcacggagataagaaaggggggttttccatcttctgggcggatgatggtctggacaccggagacctgctgctgcagaaggagtgtgaggtgctcccggacgacaccgtgagcacgctgtacaaccgcttcctcttccctgaaggcatcaaagggatggtgcaggccgtgaggctgatcgctgagggcaaagcccccagactccctcagcctgaggaaggagccacctatgaggggattcagaagaaggagacagccaagatcaactgggaccagccggcagaggccattcacaactggatccgcgggaacgacaaggtgccgggagcctggacagaggcctgtgaacagaaactgacatttttcaactcaacgctgaacacttcaggcctggtgcccgagggagacgctttgcccatcccaggagcccatcggccaggggtggtcaccaaagcaggactcatcctctttgggaatgatgacaaaatgctgctggtgaagaatattcagctggaggatggcaaaatgatcctggcctcgaacttctttaagggggcagccagcagtgtccttgagctgacagaggcagagctggttactgcggaggctgtgcggagtgtttggcagcggatcctccccaaagtcctggaggttgaagactccactgatttcttcaagtcaggggccgcgtctgtggacgttgtgaggctggtggaggaagtgaaggagctgtgtgatggcctggagttagaaaatgaagatgtgtacatggcatccacctttggggacttcatccagctgttagtgaggaagctgcgaggggacgatgaggagggcgagtgcagcattgactacgtggaaatggcagtgaacaagcgcactgtccgcatgccccaccagctcttcattgggggggagttcgtggatgccgagggcgccaagacctctgagaccatcaatcccaccgatggaagtgtcatctgccaggtatccctggcccaagtcaccgacgtcgacaaggcagtggccgcagccaaggatgcctttgagaatggacggtgggggaagatcagtgcgcgggaccggggccggctgatgtacaggttggcagatctcatggagcagcaccaggaggagctggccaccattgaggccctggatgcgggtgccgtctacacgctggccctgaagacccacgtgggcatgtccatccagaccttccgctactttgctggctggtgtgacaagatccagggctccaccatccccatcaaccaggccagacccaaccgcaacctgaccttgaccaggaaggagcctgttggggtttgtggcatcatcatcccctggaactatcccctgatgatgctgtcctggaagacagctgcctgcctggctgccgggaacacagtggtgatcaagcctgctcaggtgaccccactcacagccttgaagtttgcagagctgacattaaaggccggcattcccaaaggtgtggttaacgtcctcccaggatctggctccctggtcggccagagactctcagaccatcctgatgtgaggaaaatcgggttcacaggctccacagaggtgggcaagcacatcatgaaaagctgtgccataagtaacgtgaagaaggtgtccctggaactgggcgggaagtcacccctcatcatctttgctgactgtgacctcaacaaggctgtgcagatggggatgagttctgttttcttcaacaaaggagagaattgcattgcagcaggccgactctttgtggaggactccattcatgatgagttcgtgcggagagtggtagaagaggtgcggaagatgaaggtgggcaacccgctggacagggacaccgaccacgggccgcagaatcaccatgcccaccttgtgaagctgatggagtactgccagcatggcgtgaaggaaggggccacactggtctgcggcgggaatcaggtccctcggccagggttcttctttgagccaactgttttcacagacgtggaagaccacatgttcatagccaaggaggagtccttcgggcctgtcatgatcatctctcggtttgctgatggggacttggatgccgtgctgtctcgggccaatgccacggaatttggcctggcttctggtgtcttcaccagggacatcaacaaggccctgtatgtcagtgacaagctccaggcaggcactgtgtttgtcaacacgtacaacaagaccgacgtggccgctcccttcggaggattcaaacagtctggatttggcaaagatctaggagaggcggctctgaacgagtacctgcgggtcaagacagtgaccttcgaatactgaagaaaggtctttgtgagaagaaagtccctgcccctccctcgtggctggggccccctccctcttgagcctgggtgcacagcacctcccacctggggggctagtggaagccctcctgcctgcacaccatgtctgcatcttggacgccctctgtccagtcagaagcagcccttggctgggtgaggtgtgcccctcccagggagaataaagcttctgaagagag

SEQ ID NO: 106309 - DNA, 583 bp, Homo sapiens
  Payload ID: 878
  Gene Symbol: ALDH1L1
  Gene Name: aldehyde dehydrogenase 1 family, member L1
  ENST ID: ENST00000509952
  CDS Start-End: 284-583
gttctgtacctcacttctgatttctgcaagtcacttcctttttttttttgtctataaatttgttctgtccacgaggcaaccctggagtctctctgaatctgctgtgattctgagggctgcccaatttgtgaatcgttcattgctcaattaaacttttttaaatttaatttggctgaagtttttcttttaacatggtgtcagaagcgggatccaaagtacagcttctagcgacccccaggagtactgagtgaacaagcaaggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcat

SEQ ID NO: 106310 - DNA, 583 bp, Homo sapiens
  Payload ID: 878
  Gene Symbol: ALDH1L1
  Gene Name: aldehyde dehydrogenase 1 family, member L1
  ENST ID: ENST00000511283
  CDS Start-End: 231-374
ataaatttgttctgtccacgaggcaaccctggagtctctctgaatctgctgtgattctgagggctgcccaatttgtgaatcgttcattgctcaattaaacttttttaaatttaatttggctgaagtttttcttttaacatggtgtcagaagcgggatccaaagtacagcttctagcgacccccaggagtactgagtgaacaagcaaggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctggacaccaggacagagtgacagaggaggagaccggagaggagagccagtccagtcagggcccaaacatcacaccagaggctctaacagagaactgaatacaaagaagtgttccttgggtattgaagagtggaaggcagagagcccaaagttattggggacagcgactgcaggaagcagctgccactgtctggaagctgagaaggatggagtgccggtattcaagtact

SEQ ID NO: 106311 - DNA, 7547 bp, Homo sapiens
  Payload ID: 879
  Gene Symbol: ALDH1L2
  Gene Name: aldehyde dehydrogenase 1 family, member L2
  Uniprot ID: Q3SY69
  ENST ID: ENST00000258494
  CDS Start-End: 142-2913
agcagaggccgagagcggcgagccgcgagccaggcagtccggggcatccagactgcaggccgcgcccaggccgcgcccaggctgcgccgcccgcctgcctcccgcgctgccgcgtcgccagtgctagcgctcctctccagcatgctgcggcggggcagccaggcgctccggcgcttctccactggccgggtttatttcaaaaacaagctgaagttggcactaattggccagagcctctttggacaagaagtctatagccacctccgcaaagagggccaccgagtagtaggggtgttcacagttccagacaaggatggaaaagctgaccctctggctttggctgcagagaaagatgggacccctgtgttcaagcttcctaaatggagggtcaagggcaagaccatcaaagaagtggcagaagcctacagatccgtgggtgcagagctaaatgtgctccctttctgcactcagttcattcccatggatataattgatagtccaaagcacggctctatcatttatcacccatccatcctgcccaggcacagaggagcctctgctatcaattggactctaattatgggagataagaaagctgggttttctgttttctgggctgatgatggcttggatacaggacccatccttcttcagagatcatgtgatgttgaacccaatgatacagtggatgcactttataatcggtttctttttcctgaaggaatcaaggccatggtagaagctgtccaactcatagctgatggaaaagctcctcgtataccccagccagaagaaggggcaacatatgaaggtatccagaaaaaggaaaatgctgagatttcttgggaccagtctgccgaagttttacataactggattcgaggtcatgataaagtccctggagcttggacagagataaatggacagatggtcactttctatggctcgacattactgaatagctctgtgcctcctggagaaccactggaaattaaaggtgccaagaagcctggtctcgttaccaaaaatggacttgttctttttggtaacgatggaaaagcactgacggtgagaaatctgcagtttgaagatggaaaaatgatccctgcctctcagtacttttcaacgggtgagacgtcagtggtagaactgacagctgaagaggtgaaagtggcagagaccatcaaggtcatctgggctggaattttaagcaatgtccccattattgaagactcaacagacttctttaaatctggagcaagctcaatggatgttgccaggctggttgaagagatcagacagaaatgtggtgggcttcagttgcagaatgaagatgtctatatggccaccaagtttgaaggctttatccaaaaggtcgtgaggaaactgagaggagaagatcaagaggtggagctggttgtagattatatttcaaaggaggtcaatgaaatcatggtaaaaatgccataccagtgtttcataaatggacagttcacagatgcagacgatggaaagacttacgacactatcaacccaacagatggatctacaatatgcaaagtatcctacgcttctttggcggatgttgataaagcagtagcagcagcaaaagatgcttttgaaaacggtgaatggggaagaatgaatgcaagagaaagaggaagattgatgtatagacttgcagacctactggaagagaaccaagaagagctggcaactattgaagcccttgattcaggggctgtctataccttggccctgaagacacacattggaatgtctgtgcaaacattcagatattttgctggctggtgcgacaaaattcagggttctactattccaatcaaccaggcccgtccaaatcgcaatctgaccttcaccaagaaagagccactcggtgtctgtgccattattattccctggaactacccgctgatgatgctggcatggaagagtgctgcgtgtttggcagcaggcaataccttagtgctcaagccagcacaggtcacgcccttgactgctttgaagtttgcagaactgtctgtgaaagcaggctttccaaagggggtcatcaacatcattccaggctcaggtggcatagcaggacaacgtctgtctgaacatcctgacatccgcaaacttggtttcactggatccactcctattggcaaacagatcatgaagagctgtgctgttagcaacttgaagaaagtttcccttgagcttggtggcaagtctccacttataatatttaatgactgtgaacttgacaaggctgtgcgaatgggcatgggagcagtatttttcaacaaaggagagaactgtattgctgctgggcggttgttcgtggaagaatccatccacgacgaatttgtgacaagagtggtagaagaaattaaaaagatgaaaattggtgatccacttgacagatccactgatcatgggccccaaaatcataaggctcatctggaaaagctgctgcaatactgtgaaactggagtgaaagaaggggccactttggtgtacgggggaagacaagtccaaaggccaggctttttcatggagccgaccgtgttcacagatgtggaagactacatgtacctcgccaaagaggaatcctttgggcctattatggtcatttctaaattccaaaatggggacatcgatggagtgttgcagcgagcaaatagtacagagtatggtttggcctcaggggtttttacaagagacataaacaaagctatgtatgtgagtgaaaaactggaagcaggaactgtttttattaacacatacaacaagacagatgtggcggccccatttggcggagttaaacaatctggctttggaaaagacttaggtgaggaagctctaaatgaatatctcaaaaccaagacggtgacactggaatattagagcaacaccatcatcaggaaagccttgacagacagccctttacaactctggacacacttaagaagattgggtgtgttgaggcaggaggtgtcagccacaaaccaaaaaatacacagatggaccatgaagagggccaggccatgttaaagcatttacacatgtgcctgagtattttctaatacaccttccagtgatttggagttgttgcattttgactatgttgtatatcatacgtatttctaaaataccaagctgtttctcccctacctagacaaatctattcatggttcccatcttgaagatgtcagtaccatgcagttataatacacaaggtgcatttattggaaactttgtataatatgtacaggtttttaacctctgaactatacatagggggttattaaaaagattttctataagtcttctaaggaacagtataacctgtaaggaatgtgaaggtagttcttttttagtatttggaaataagatacatctttgtgcctttgatattccattttttaacccactgtgatgggtgatcaacctagaaacattatcttgagtacctactaggtaccaggtactatattatgttctgaggagtatagagaatttaatgatatgatggctggcccccacatagtttaaattttagtaaatagcttttgaagcaaattttacatatgatatagtagaaggctgatcctggtcgtatcataccatcttcctatctatgtaactttgggaaactctcgcaactcctctgagcctctgcttccctatgtgtaaaacagggatagtaaatgccttcctcaggacccttaataggagaattcattgcagtaatgtaagtaaagcacctcacattaatgctttgctcatggtaagtactcaaatttaactctgatttcctccgtcaccattcttaaaagatattgagatagtttaattaactagatgaattcatttcccacaacccttttcaatcatcaattcctagatatttttctcatccattgttctgacacaatgcctgatacagcagcactgaaaaatgccacacaatgaaaaatggcaatagtacaaggaaaaggggtgcttttctttgggcagctcgctcgtccttcatgggacatcttactttccatttttctacctattggttctgctgttcactggctgtgtgatcttgggcaagatagtaatctaatatctcagagcctaggttgagtatctataaaatgaaaatcaaatctctatctcagtaggtgttgcaaggattcagtgagataatatacataatgcacttaacaaggcgtttggaccatagcattgaagaaatggaaactattaacagcccatttcccattggcagacagaagtagtcaggtgagtaaattttcaccatctatgtgtgactagaaggcggcaaatttctgaatcacatgagtctccaaaagatagccagaaagttaaattctattaatcctcctttaaaaataaaatttcagtaaacattcctttttctttggctttgaagaagccttagggaatatttgtcattttggagacttggcagaataacatgaggggattgtagggaatcaataaaaactaaacaacaaaatcagagtcagagaacattttcaaaaggaagaataggaggtttgatcccagcatgataaacagagcgaatttggcctggaagcacttttgattatactatagctcatttaccatcccagagtttggcacagctgaaattttaagttggaatgaatattcactgggcccaaaatgacagttcatatttgaataaaagtgacaaaagcctttttataagtaatcacttttaagtgaaatgttttaactgatttcatgtgatttagaatatgatttaatcaaattattttaatgatagatggaatggcagacaaaaacatgcctgtccttctagactgattttactttaccctctaatattcatctcagtagcagtgttttaaatattctctgggctgcaaaactctttgggaatctgataaaagctatgaacactccctgtgtcccgcttctacccccaaaattcatgtgcacacacacaattctgcaagtatcttcaaagggttcacagacctcccaaaggccatgcttgggccccagattaagaactcctttctccatagcaagttttaaacatttcttaccagcttacatttttagatctggctgatcagaatcaaaggctctgtgtaatacataaagttaccaagtgaactggaattggaacatcaccctccccagcctgctaggtgatttacttaacacatagagtaataaaatcatcgctgttgctttagatcacggattattttgctaataatgctaaggatgaagctgtgatcttattatcacctgaatcgggaggtgtggacactttaagcagttccactttccttctaattccccatccccatgcctttgctaaagctgtcccttttgctctaacacccttcctggaccttcctaccctagctgggctaagtgtttctcctcagcgttcccacttgtttcaaacatagcacttaccacttgtactaaaattacttgccttcttaattagatatgaacaaccctccccaactccagtatgggccttctgtcaataataatacgatatgacagctaccatttattaagggcctcctgtatgaaagaccttaggctaagcatgttttaaatgttatttaatcttcacaatctctgaaaaaaatgaagaaatcaacgtgcttttcttactacctctacccctaagccattattacttttttttttttttgagacagagttttgctcttgttgcccaggctgcagtgcagtggtgcaatcttggctcactgcaacctctgcctcttgggttcaagcgattgtcatgccttagccttccaagtagctgggattacaggtgtgtgccactacacctggctaagtagagatggggtttcgccatgttggccaggctggtcttgaactcctgacctcaagtgatccacctgcctccgcctcccaaagtgctgggattacaggcatgaaccactgcacctggcctgttacctctttcctacaattttgctcaagtctcccaactggtcttctggattcctctcttctgcggtcctgttcaaagcttaagtcagacagtgtcacttcactcgtctgtttaaaacctttcaatggcccccatttcacgtagaccaaagtccaacgtatttacctggcctactgatcttgctcctagctacctctgacctcatctcctgtcaatttccctctcattctgttccaccatcctgactgccttgacttcctcaacagaacaagcctgctcctgcctcagggcctctgtccttattcttcctcttcccaggggtgtgctggtaaaatatttaacaaatagttctccgggacgggggagaaaaccctcatttgtagcatttgcaggtatctatgtgtaaatactctcatcaaggctatttttgagccactaatttgccttcactgaatacagagtttgggaagagatgcatgccatcagaacaaatgcaagccagcaccagcacaccactgcctcttcctgcaactcttgtccatacacaacctcatggctggctggctcacttcctgcaggtctctcctcaaatatcatctgatgagagacacattccctgactatgctttctaaaataggccatatgcccccacattcataccccatctgctgtcattctttattctttttataagtgcattattttcatagcacttatcactacctgttgtatattaatcaatgatcttttcccattagaatgtaagtttcatgaacaggtacttgttttaatactgtatctccagtcctaatgtgtaacaggagcccaataaatgtttgctttcaaatggagaggttaagtaacctgctcaaatcacacagctattaagtggcagaacaggttttcaagcaatgcatctggtggttttaactaagtcgagatagtttttattcctaatgcctaaatcagggcctaggtagtgagctgtgggcacatattaagtattggttaaactaaaaataataagcaaaatggacattatctataaaagcttttgtggaaatggctagagctagggtaaggaaacaaatttggttccccatacctgccctccaagaaaataaagctgtcaaggaaaatctgggctaagagtaggatatgagggatgatggataaggcatgagacatgagaaataagggggattaaattattattactattatacaaatgatgcctgagtagatttttaaaatgattaaatacccaatgatgtaaaaaacatttataaaataggaaagtaagactgactcaaccataatttgttgagtcaacccaaaaatctatttggttattttcaaacagaaatagcctacagatgatatctgagattgttccaaactttttctatgaatatgtatactttttttacataattaacataatactgtatattaatttgttacctgctttttcaattaacaatatatcataagcatctatgccaataaacacaattctgcata

SEQ ID NO: 106312 - DNA, 527 bp, Homo sapiens
  Payload ID: 879
  Gene Symbol: ALDH1L2
  Gene Name: aldehyde dehydrogenase 1 family, member L2
  ENST ID: ENST00000548418
  CDS Start-End: 1-277
ggtagaagaaattaaaaagatgaaaattggtgatccacttgacagatccactgatcatgggccccaaaatcataaggctcatctggaaaagctgctgcaatactgtgaaactggagtgaaagaaggggccactttggtgtacgggggaagacaagtccaaaggccaggctttttcatggagccgaccgtgttcacagatgtggaagactacatgtacctcgccaaagaggaatcctttgggcctattatggtcatttctaaattccaaaatgggtaggttcttcagacacaatgtaacttaggttttgactagataagtcatttttcccctttgccactgtgctatatacacagcataagattaatgaacatgtaattttctaccataagaataattaacttaaataattagaagttacgcttttgctaaccatcgtagatcatagtatatttttgcttttcagcttcaattaatggccaacataatgggcttttagctgaataaattttagtttttctgcacttga

SEQ ID NO: 106313 - DNA, 2746 bp, Homo sapiens
  Payload ID: 879
  Gene Symbol: ALDH1L2
  Gene Name: aldehyde dehydrogenase 1 family, member L2
  Uniprot ID: Q3SY69
  ENST ID: ENST00000552270
  CDS Start-End: 23-634
agtgctagcgctcctctccagcatgctgcggcggggcagccaggcgctccggcgcttctccactggccgggtttatttcaaaaacaagctgaagttggcactaattggccagagcctctttggacaagaagtctatagccacctccgcaaagagggccaccgagtagtaggggtgttcacagttccagacaaggatggaaaagctgaccctctggctttggctgcagagaaagatgggacccctgtgttcaagcttcctaaatggagggtcaagggcaagaccatcaaagaagtggcagaagcctacagatccgtgggtgcagagctaaatgtgctccctttctgcactcagttcattcccatggatataattgatagtccaaagcacggctctatcatttatcacccatccatcctgcccaggcacagaggagcctctgctatcaattggactctaattatgggagataagaaagctgggttttctgttttctgggctgatgatggcttggatacaggacccatccttcttcagagatcatgtgatgttgaacccaatgatacagtggatgcactttataatcggtttctttttcctgaaggaatcaaggccatgaagctgtccaactcatagctgatggaaaagctcctcgtataccccagccagaagaaggggcaacatatgaaggtatccagaaaaaggaaaatgctgagatttcttgggaccagtctgccgaagttttacataactggattcgaggtcatgataaagtccctggagcttggacagagataaatggacagatggtcactttctatggctcgacattactgaatagctctgtgcctcctggagaaccactggaaattaaaggtgccaagaagcctggtctcgttaccaaaaatggacttgttctttttggtaacgatggaaaagcactgacggtgagaaatctgcagtttgaagatggaaaaatgatccctgcctctcagtacttttcaacgggtgagacgtcagtggtagaactgacagctgaagaggtgaaagtggcagagaccatcaaggtcatctgggctggaattttaagcaatgtccccattattgaagactcaacagacttctttaaatctggagcaagctcaatggatgttgccaggctggttgaagagatcagacagaaatgtggtgggcttcagttgcagaatgaagatgtctatatggccaccaagtttgaaggctttatccaaaaggtcgtgaggaaactgagaggagaagatcaagaggtggagctggttgtagattatatttcaaaggaggtcaatgaaatcatggtaaaaatgccataccagtgtttcataaatggacagttcacagatgcagacgatggaaagacttacgacactatcaacccaacagatggatctacaatatgcaaagtatcctacgcttctttggcggatgttgataaagcagtagcagcagcaaaagatgcttttgaaaacggtgaatggggaagaatgaatgcaagagaaagaggaagattgatgtatagacttgcagacctactggaagagaaccaagaagagctggcaactattgaagcccttgattcaggggctgtctataccttggccctgaagacacacattggaatgtctgtgcaaacattcagatattttgctggctggtgcgacaaaattcagggttctactattccaatcaaccaggcccgtccaaatcgcaatctgaccttcaccaagaaagagccactcggtgtctgtgccattattattccctggaactacccgctgatgatgctggcatggaagagtgctgcgtgtttggcagcaggcaataccttagtgctcaagccagcacaggtcacgcccttgactgctttgaagtttgcagaactgtctgtgaaagcaggctttccaaagggggtcatcaacatcattccaggctcaggtggcatagcaggacaacgtctgtctgaacatcctgacatccgcaaacttggtttcactggatccactcctattggcaaacagatcatgaagagctgtgctgttagcaacttgaagaaagtttcccttgagcttggtggcaagtctccacttataatatttaatgactgtgaacttgacaaggctgtgcgaatgggcatgggagcagtatttttcaacaaaggagagaactgtattgctgctgggcggttgttcgtggaagaatccatccacgacgaatttgtgacaagagtgatccactgatcatgggccccaaaatcataaggctcatctggaaaagctgctgcaatactgtgaaactggagtgaaagaaggggccactttggtgtacgggggaagacaagtccaaaggccaggctttttcatggagccgaccgtgttcacagatgtggaagactacatgtacctcgccaaagaggaatcctttgggcctattatggtcatttctaaattccaaaatggggacatcgatggagtgttgcagcgagcaaatagtacagagtatggtttggcctcaggggtttttacaagagacataaacaaagctatgtatgtgagtgaaaaactggaagcaggaactgtttttattaacacatacaacaagacagatgtggcggccccatttggcggagttaaacaatctggctttggaaaagacttaggtgaggaagctctaaatgaatatctcaaaaccaagacggtgacactggaatattag

SEQ ID NO: 106314 - DNA, 3153 bp, Homo sapiens
  Payload ID: 880
  Gene Symbol: ALDH16A1
  Gene Name: aldehyde dehydrogenase 16 family, member A1
  Uniprot ID: Q8IZ83
  ENST ID: ENST00000293350
  CDS Start-End: 164-2572
gaaaaagtgtgggcgtggctgctctctgtatcttgtagccccaccccattcccattagccccgcccctttgggctggaaccggaggtgtcgctcttcggacctcaaggttccccttaacacagagcgccccgcagtcttcgcggaaagcgttcggggtaggcgatggctgcgacgcgtgcagggccccgcgcccgcgagatcttcacctcgctggagtacggaccggtgccggagagccacgcatgcgcactggcctggctggacacccaggaccggtgcttgggccactatgtgaatgggaagtggttaaagcctgaacacagaaattcagtgccttgccaggatcccatcacaggagagaacttggccagttgcctgcaggcacaggccgaggatgtggctgcagccgtggaggcagccaggatggcatttaagggctggagtgcgcaccccggcgtcgtccgggcccagcacctgaccaggctggccgaggtgatccagaagcaccagcggctgctgtggaccctggaatccctggtgactgggcgggctgttcgagaggttcgagacggggacgtccagctggcccagcagctgctccactaccatgcaatccaggcatccacccaggaggaggcactggcaggctgggagcccatgggagtaattggcctcatcctgccacccacattctccttccttgagatgatgtggaggatttgccctgccctggctgtgggctgcaccgtggtggccctcgtgcccccggcctccccggcgcccctcctcctggcccagctggcgggggagctgggccccttcccgggaatcctgaatgtcctcagtggccctgcgtccctggtgcccatcctggcctcccagcctggaatccggaaggtggccttctgcggagccccggaggaagggcgtgcccttcgacggagcctggcgggagagtgtgcggagctgggcctggcgctggggacggagtcgctgctgctgctgacggacacggcggacgtagactcggccgtggagggtgtcgtggacgccgcctggtccgaccgcggcccgggtggcctcaggctcctcatccaggagtctgtgtgggatgaagccatgagacggctgcaggagcggatggggcggcttcggagtggccgagggctggatggggccgtggacatgggggcccggggggctgccgcatgtgacctggtccagcgctttgtgcgtgaggcccagagccagggtgcacaggtgttccaggctggtgatgtgccttcggaacgcccattctatcccccaaccttggtctccaacctgcccccagcctccccatgtgcccaggtggaggtgccgtggcctgtggtcgtggcctcccccttccgcacagccaaggaggcactgttggtggccaacgggacgccccgcgggggcagcgccagtgtgtggagcgagaggctggggcaggcgctggagctgggctatgggctccaggtgggcactgtctggatcaacgcccacggcctcagagacccttcggtgcccacaggcggctgcaaggagagtgggtgttcctggcacgggggcccagacgggctgtatgagtatctgcggccctcagggacccctgcccggctgtcctgcctctccaagaacctgaactatgacacctttggcctcgctgttccctcaaccctgccggctgggcctgaaatagggcccagcccagcacccccctatgggctcttcgttgggggccgtttccaggctcctggggcccgaagctccaggcccatccgggattcgtctggcaacctccatggctacgtggctgagggtggagccaaggacatccgaggtgctgtggaggccgctcaccaggctttccctggctgggcgggccagtccccaggagcccgggcagccctgctgtgggccctggcggctgcactggagcgccggaagtctaccctggcctcgaggctggagaggcagggagcggagctcaaggctgcggaggcggaggtggagctgagcgcaagacgacttcgggcgtggggggcccgggtgcaggcccaaggccacaccctgcaggtagccgggctgagaggccctgtgctgcgcctgcgggagccgctgggtgtgctggctgtggtgtgtccggacgagtggcccctgcttgccttcgtgtccctgctggctcccgccctggcctacggcaacactgtggtcatggtgcccagtgcggcctgtcctctgctggccctggaggtctgccaggacatggccaccgtgttcccagcaggcctggccaacgtggtgacaggagaccgggaccatctgacccgctgcctggccttgcaccaagacgtccaggccatgtggtatttcggatcagcccagggttcccagtttgtcgagtgggcctcggcaggaaacctcaaaccggtgtgggcgagcaggggctgcccgcgggcctgggaccaggaggccgagggggcaggcccagagctggggctgcgagtggcgcggaccaaggccctgtggctgcctatgggggactgatgcctgagcgccacctactgcattttggacacctcacaccaaggggagatgcaccccacagacacctgggactttccccttctggttcctgtgtctcccaataaactctctgaccaaccctagctgtgcttctgcgagaagaaagggtgtagcaacttctggcagatatgaggcttttttcttttttttttttttttttgagacaacgtctggctctgtcacccaggctggagcgcagtggcacaatctcggcccactgcagcctcgacctctggggctcaagggatcctcatgcctcagcctcatatgtagctggggccacagacatgcaccaccacacctggctcgaggccattttagttctgaggttgagcagctcaggagccggctccagcacggtgctgtgtttgtgaaacagagaaaggggacccccgaggaccccagacagggccttaggactctcatatcttcttgtcttctccatctggtggctcttgctctctggttttctctaccttttcatggccccagaatccatatgcagtaaaggaactctctggaataaaattaaagtcctccta

SEQ ID NO: 106315 - DNA, 2470 bp, Homo sapiens
  Payload ID: 880
  Gene Symbol: ALDH16A1
  Gene Name: aldehyde dehydrogenase 16 family, member A1
  Uniprot ID: Q8IZ83
  ENST ID: ENST00000455361
  CDS Start-End: 97-2352
tttgggctggaaccggaggtgtcgctcttcggacctcaaggttccccttaacacagagcgccccgcagtcttcgcggaaagcgttcggggtaggcgatggctgcgacgcgtgcagggccccgcgcccgcgagatcttcacctcgctggagtacggaccggtgccggagagccacgcatgcgcactggcctggctggacacccaggaccggtgcttgggccactatgtgaatgggaagtggttaaagcctgaacacagaaattcagtgccttgccaggatcccatcacaggagagaacttggccagttgcctgcaggcacaggccgaggatgtggctgcagccgtggaggcagccaggatggcatttaagggctggagtgcgcaccccggcgtcgtccgggcccagcacctgaccaggctggccgaggtgatccagaagcaccagcggctgctgtggaccctggaatccctggtgactgggcgggctgttcgagaggttcgagacggggacgtccagctggcccagcagctgctccactaccatgcaatccaggcatccacccaggaggaggcactggcaggctgggagcccatgggagtaattggcctcatcctgccacccacattctccttccttgagatgatgtggaggatttgccctgccctggctgtgggctgcaccgtggtggccctcgtgcccccggcctccccggcgcccctcctcctggcccagctggcgggggagctgggccccttcccgggaatcctgaatgtcctcagtggccctgcgtccctggtgcccatcctggcctcccagcctggaatccggaaggtggccttctgcggagccccggagggtggcctcaggctcctcatccaggagtctgtgtgggatgaagccatgagacggctgcaggagcggatggggcggcttcggagtggccgagggctggatggggccgtggacatgggggcccggggggctgccgcatgtgacctggtccagcgctttgtgcgtgaggcccagagccagggtgcacaggtgttccaggctggtgatgtgccttcggaacgcccattctatcccccaaccttggtctccaacctgcccccagcctccccatgtgcccaggtggaggtgccgtggcctgtggtcgtggcctcccccttccgcacagccaaggaggcactgttggtggccaacgggacgccccgcgggggcagcgccagtgtgtggagcgagaggctggggcaggcgctggagctgggctatgggctccaggtgggcactgtctggatcaacgcccacggcctcagagacccttcggtgcccacaggcggctgcaaggagagtgggtgttcctggcacgggggcccagacgggctgtatgagtatctgcggccctcagggacccctgcccggctgtcctgcctctccaagaacctgaactatgacacctttggcctcgctgttccctcaaccctgccggctgggcctgaaatagggcccagcccagcacccccctatgggctcttcgttgggggccgtttccaggctcctggggcccgaagctccaggcccatccgggattcgtctggcaacctccatggctacgtggctgagggtggagccaaggacatccgaggtgctgtggaggccgctcaccaggctttccctggctgggcgggccagtccccaggagcccgggcagccctgctgtgggccctggcggctgcactggagcgccggaagtctaccctggcctcgaggctggagaggcagggagcggagctcaaggctgcggaggcggaggtggagctgagcgcaagacgacttcgggcgtggggggcccgggtgcaggcccaaggccacaccctgcaggtagccgggctgagaggccctgtgctgcgcctgcgggagccgctgggtgtgctggctgtggtgtgtccggacgagtggcccctgcttgccttcgtgtccctgctggctcccgccctggcctacggcaacactgtggtcatggtgcccagtgcggcctgtcctctgctggccctggaggtctgccaggacatggccaccgtgttcccagcaggcctggccaacgtggtgacaggagaccgggaccatctgacccgctgcctggccttgcaccaagacgtccaggccatgtggtatttcggatcagcccagggttcccagtttgtcgagtgggcctcggcaggaaacctcaaaccggtgtgggcgagcaggggctgcccgcgggcctgggaccaggaggccgagggggcaggcccagagctggggctgcgagtggcgcggaccaaggccctgtggctgcctatgggggactgatgcctgagcgccacctactgcattttggacacctcacaccaaggggagatgcaccccacagacacctgggactttccccttctggttcctgtgtctcccaataaactctctgaccaac

SEQ ID NO: 106316 - DNA, 2174 bp, Homo sapiens
  Payload ID: 880
  Gene Symbol: ALDH16A1
  Gene Name: aldehyde dehydrogenase 16 family, member A1
  ENST ID: ENST00000540132
  CDS Start-End: 188-2107
agccccgcccctttgggctggaaccggaggtgtcgctcttcggacctcaaggttccccttaacacagagcgccccgcagtcttcgcggaaagcgttcggggtaggcgatggctgcgacgcgtgcagggccccgcgcccgcgagatcttcacctcgctggagtacggaccggtgccggagagccacgcatgcgcactggagtaattggcctcatcctgccacccacattctccttccttgagatgatgtggaggatttgccctgccctggctgtgggctgcaccgtggtggccctcgtgcccccggcctccccggcgcccctcctcctggcccagctggcgggggagctgggccccttcccgggaatcctgaatgtcctcagtggccctgcgtccctggtgcccatcctggcctcccagcctggaatccggaaggtggccttctgcggagccccggaggaagggcgtgcccttcgacggagcctggcgggagagtgtgcggagctgggcctggcgctggggacggagtcgctgctgctgctgacggacacggcggacgtagactcggccgtggagggtgtcgtggacgccgcctggtccgaccgcggcccgggtggcctcaggctcctcatccaggagtctgtgtgggatgaagccatgagacggctgcaggagcggatggggcggcttcggagtggccgagggctggatggggccgtggacatgggggcccggggggctgccgcatgtgacctggtccagcgctttgtgcgtgaggcccagagccagggtgcacaggtgttccaggctggtgatgtgccttcggaacgcccattctatcccccaaccttggtctccaacctgcccccagcctccccatgtgcccaggtggaggtgccgtggcctgtggtcgtggcctcccccttccgcacagccaaggaggcactgttggtggccaacgggacgccccgcgggggcagcgccagtgtgtggagcgagaggctggggcaggcgctggagctgggctatgggctccaggtgggcactgtctggatcaacgcccacggcctcagagacccttcggtgcccacaggcggctgcaaggagagtgggtgttcctggcacgggggcccagacgggctgtatgagtatctgcggccctcagggacccctgcccggctgtcctgcctctccaagaacctgaactatgacacctttggcctcgctgttccctcaaccctgccggctgggcctgaaatagggcccagcccagcacccccctatgggctcttcgttgggggccgtttccaggctcctggggcccgaagctccaggcccatccgggattcgtctggcaacctccatggctacgtggctgagggtggagccaaggacatccgaggtgctgtggaggccgctcaccaggctttccctggctgggcgggccagtccccaggagcccgggcagccctgctgtgggccctggcggctgcactggagcgccggaagtctaccctggcctcgaggctggagaggcagggagcggagctcaaggctgcggaggcggaggtggagctgagcgcaagacgacttcgggcgtggggggcccgggtgcaggcccaaggccacaccctgcaggtagccgggctgagaggccctgtgctgcgcctgcgggagccgctgggtgtgctggctgtggtgtgtccggacgagtggcccctgcttgccttcgtgtccctgctggctcccgccctggcctacggcaacactgtggtcatggtgcccagtgcggcctgtcctctgctggccctggaggtctgccaggacatggccaccgtgttcccagcaggcctggccaacgtggtgacaggagaccgggaccatctgacccgctgcctggccttgcaccaagacgtccaggccatgtggtatttcggatcagcccagggttcccagtttgtcgagtgggcctcggcaggaaacctcaaaccggtgtgggcgagcaggggctgcccgcgggcctgggaccaggaggccgagggggcaggcccagagctggggctgcgagtggcgcggaccaaggccctgtggctgcctatgggggactgatgcctgagcgccacctactgcattttggacacctcacaccaaggggagatgcaccccacagacacct

SEQ ID NO: 106317 - DNA, 819 bp, Homo sapiens
  Payload ID: 880
  Gene Symbol: ALDH16A1
  Gene Name: aldehyde dehydrogenase 16 family, member A1
  ENST ID: ENST00000600265
  CDS Start-End: 1-492
atcaacgcccacggcctcagagacccttcggtgcccacaggcggctgcaaggagagtgggtgttcctggcacgggggcccagacgggctgtatgagtatctgcggccctcagggacccctgcccggctgtcctgcctctccaagaacctgaactatgacacctttggcctcgctgttccctcaaccctgccggctgggcctgaaatagggcccagcccagcacccccctatgggctcttcgttgggggccgtttccaggctcctggggcccgaagctccaggcccatccgggattcgtctggcaacctccatggctacgtggctgagggtggagccaaggacatccgagctgggcgggccagtccccaggagcccgggcagccctgctgtgggccctggcggctgcactggagcgccggaagtctaccctggcctcgaggctggagaggcagggagcggagctcaaggctgcggaggcggaggtggagctgagcgcaagacgacttcgggcgtggggggcccgggtgcaggcccaaggccacaccctgcaggtagccgggctgagaggccctgtgctgcgcctgcgggagccgctgggtgtgctggctgtggtgtgtccggacgagtggcccctgcttgccttcgtgtccctgctggctcccgccctggcctacggcaacactgtggtcatggtgcccagtgcggcctgtcctctgctggccctggaggtctgccaggacatggccaccgtgttcccagcaggcctggccaacgtggtgacaggagaccgggaccatctgacccgctgcctggccttgc

SEQ ID NO: 106318 - DNA, 2343 bp, Homo sapiens
  Payload ID: 880
  Gene Symbol: ALDH16A1
  Gene Name: aldehyde dehydrogenase 16 family, member A1
  ENST ID: ENST00000593417
  CDS Start-End: 45-356
acagagcgccccgcagtcttcgcggaaagcgttcggggtaggcgatggctgcgacgcgtgcagggccccgcgcccgcgagatcttcacctcgctggagtacggaccggtgccggagagccacgcatgcgcactggctggccgaggtgatccagaagcaccagcggctgctgtggaccctggaatccctggtgactgggcgggctgttcgagaggttcgagacggggacgtccagctggcccagcagctgctccactaccatgcaatccaggcatccacccaggaggaggcactggcaggctgggagcccatgggagtaattggcctcatcctgccacccacattctccttccttgagatgatgtggaggatttgccctgccctggctgtgggctgcaccgtggtggccctcgtgcccccggcctccccggcgcccctcctcctggcccagctggcgggggagctgggccccttcccgggaatcctgaatgtcctcagtggccctgcgtccctggtgcccatcctggcctcccagcctggaatccggaaggtggccttctgcggagccccggaggaagggcgtgcccttcgacggagcctggcgggagagtgtgcggagctgggcctggcgctggggacggagtcgctgctgctgctgacggacacggcggacgtagactcggccgtggagggtgtcgtggacgccgcctggtccgaccgcggcccgggtggcctcaggctcctcatccaggagtctgtgtgggatgaagccatgagacggctgcaggagcggatggggcggcttcggagtggccgagggctggatggggccgtggacatgggggcccggggggctgccgcatgtgacctggtccagcgctttgtgcgtgaggcccagagccagggtgcacaggtgttccaggctggtgatgtgccttcggaacgcccattctatcccccaaccttggtctccaacctgcccccagcctccccatgtgcccaggtggaggtgccgtggcctgtggtcgtggcctcccccttccgcacagccaaggaggcactgttggtggccaacgggacgccccgcgggggcagcgccagtgtgtggagcgagaggctggggcaggcgctggagctgggctatgggctccaggtgggcactgtctggatcaacgcccacggcctcagagacccttcggtgcccacaggcggctgcaaggagagtgggtgttcctggcacgggggcccagacgggctgtatgagtatctgcggccctcagggacccctgcccggctgtcctgcctctccaagaacctgaactatgacacctttggcctcgctgttccctcaaccctgccggctgggcctgaaatagggcccagcccagcacccccctatgggctcttcgttgggggccgtttccaggctcctggggcccgaagctccaggcccatccgggattcgtctggcaacctccatggctacgtggctgagggtggagccaaggacatccgaggtgctgtggaggccgctcaccaggctttccctggctgggcgggccagtccccaggagcccgggcagccctgctgtgggccctggcggctgcactggagcgccggaagtctaccctggcctcgaggctggagaggcagggagcggagctcaaggctgcggaggcggaggtggagctgagcgcaagacgacttcgggcgtggggggcccgggtgcaggcccaaggccacaccctgcaggtagccgggctgagaggccctgtgctgcgcctgcgggagccgctgggtgtgctggctgtggtgtgtccggacgagtggcccctgcttgccttcgtgtccctgctggctcccgccctggcctacggcaacactgtggtcatggtgcccagtgcggcctgtcctctgctggccctggaggtctgccaggacatggccaccgtgttcccagcaggcctggccaacgtggtgacaggagaccgggaccatctgacccgctgcctggccttgcaccaagacgtccaggccatgtggtatttcggatcagcccagggttcccagtttgtcgagtgggcctcggcaggaaacctcaaaccggtgtgggcgagcaggggctgcccgcgggcctgggaccaggaggccgagggggcaggcccagagctggggctgcgagtggcgcggaccaaggccctgtggctgcctatgggggactgatgcctgagcgccacctactgcattttggacacctcacaccaaggggagatgcaccccacagacacctgggactttccccttctggttcctgtgtctcccaataaactctctgaccaaccc

SEQ ID NO: 106319 - DNA, 3337 bp, Homo sapiens
  Payload ID: 881
  Gene Symbol: ALDH18A1
  Gene Name: aldehyde dehydrogenase 18 family, member A1
  Uniprot ID: P54886
  ENST ID: ENST00000371221
  CDS Start-End: 139-2520
gcgggacgtggacggaagaaaaaagagagtgagcgagcgccggaatcagcccggcgtggagtgcggacccgcggtagtgccagggggcgaaggcggcggtggtgaggaagatactttggttagtgaccacatcgcagcatgttgagtcaagtttaccgctgtgggttccagcccttcaaccaacatcttctgccctgggtcaagtgtacaaccgtcttcagatctcattgtatccagccttcagtcatcagacatgttcgttcttggagcaacatcccgtttatcactgtacccctcagtcgtacacatggcaagtccttcgcccaccgcagtgagctgaagcatgccaagagaatcgtggtgaagctcggcagtgccgtggtgacccgaggggatgaatgtggcctggccctggggcgcttggcatctattgttgagcaggtatcagtgctgcagaatcagggcagagagatgatgctggtgaccagtggagccgtagcctttggcaaacaacgcttgcgccatgagatccttctgtctcagagcgtgcggcaggccctccactcggggcagaaccagctgaaagaaatggcaattccagtcttagaggcacgagcctgtgcagctgccggacagagtgggctgatggccttgtatgaggctatgtttacccagtacagcatctgtgctgcccagattttggtgaccaatttggatttccatgatgagcagaagcgccggaacctcaatggaacacttcatgaactccttagaatgaacattgtccccattgtcaacacaaatgatgctgttgtccccccagctgagcccaacagtgacctgcagggggttattagtgttaaagataatgatagcctggctgcccgactggctgtggaaatgaaaactgatctcttgattgttctttcagatgtagaaggcctttttgacagccccccaggttcagatgatgcaaagcttattgatatattttatcccggagatcagcagtctgtgacatttggaaccaagtctagagtgggaatgggtggcatggaagccaaggtgaaagcagccctctgggctttgcaaggtggcacttctgttgttattgccaatggaacccacccaaaggtgtctgggcacgtcatcacagacattgtggaggggaagaaagttggtaccttcttttcagaagtaaagcctgcaggccctactgttgagcagcagggagaaatggcgcgatctggaggaaggatgttggccaccttggaacctgagcagagagcagaaattatccatcatctggctgatctgttgacggaccagcgtgatgagatcctgttagccaacaaaaaagacttggaggaggcagaggggagacttgcagctcctctgctgaaacgtttaagcctctccacatccaaattgaacagcctggccatcggtctgcgacagatcgcagcctcctcccaggacagcgtgggacgtgttttgcgccgcacccgaatcgccaaaaacttggaactggaacaagtgactgtcccaattggagttctgctggtgatctttgaatctcgtcctgactgtctaccccaggtggcagctttggctatcgcaagtggcaatggcttgttactcaaaggagggaaggaggctgcacacagcaaccggattctccacctcctgacccaggaggctctctcaatccatggagtcaaggaggccgtgcaactggtgaataccagagaagaagttgaagatctttgccgcctagacaaaatgatagatctgatcattccacgtggctcttcccagctggtcagagacatccagaaagctgctaaggggattccagtgatggggcacagcgaagggatctgtcacatgtatgtggattccgaggccagtgttgataaggtcaccaggctagtcagagactctaaatgtgaatatccagctgcctgtaatgctttggagactttgttaatccaccgggatctgctcaggacaccattatttgaccagatcattgatatgctgagagtggaacaggtaaaaattcatgcaggccccaaatttgcctcctatctgaccttcagcccctccgaagtgaagtcactccgaactgagtatggggacctggaattatgcattgaagtagtggacaacgttcaggatgccattgaccacatccacaagtatggcagctcccacacggatgtcatcgtcacagaggacgaaaacacagcggagttcttcctgcagcacgtagacagtgcctgtgtgttctggaatgccagcactcgcttttctgatggttaccgctttggactgggagctgaagtgggaatcagtacatcgagaatccacgcccggggaccagtaggacttgagggactgcttactactaagtggctgctgcgagggaaggaccacgtggtctcagatttctcagagcatggaagtttaaaatatcttcatgagaacctccctattcctcagagaaacaccaactgaaaagagccaggaaaacccgggaattttccaaaaggtcttcacgttaaacttgtcttatctcaggagagagcccgctcttgtctcccagttcctggtagggtctgcctgttggaaagtgtacctggatgcttctgggctccgtttggcaatagcagtcttggctgatgtgcacagtctggctcccagctcaccctttttttttaaagtaagaaaatagttgctaccgatagggactttgccaagtccaattatcttctaggattgaaaggtgcattttccccataaaaaaggcgaggaaaacccatggctgctttgtgtcacctcagtgacttacagtcccccttggcatttagttggtactagagccagtcatccttaacaaatcttttcacattttatttctttcacatgtagtcatcttcaaaaaggaaagatttggaattttagaaaaggggcaactcttctttttagcattctcatcagaaagtcacaaaaatcgatggaatcatttccactgggaagattgaccttttgtatttatttgtggggtaaattaataagcattccagatgcttgcagcttcctgcatccaggagatgctgtgttccccgtgatgcagctggaacccaagctgcagcaggagatgcaagtttcaggatgttccccactgagctggaggaatatctacagcagtgatgcttgaaatttttgtatgaattattttgtcgtcctacccttttcctccaaaacaaaaattagaggattattttaatactttggattcttcccccttttttgagaaataaagttttttatg

SEQ ID NO: 106320 - DNA, 3359 bp, Homo sapiens
  Payload ID: 881
  Gene Symbol: ALDH18A1
  Gene Name: aldehyde dehydrogenase 18 family, member A1
  Uniprot ID: P54886
  ENST ID: ENST00000371224
  CDS Start-End: 139-2526
gcgggacgtggacggaagaaaaaagagagtgagcgagcgccggaatcagcccggcgtggagtgcggacccgcggtagtgccagggggcgaaggcggcggtggtgaggaagatactttggttagtgaccacatcgcagcatgttgagtcaagtttaccgctgtgggttccagcccttcaaccaacatcttctgccctgggtcaagtgtacaaccgtcttcagatctcattgtatccagccttcagtcatcagacatgttcgttcttggagcaacatcccgtttatcactgtacccctcagtcgtacacatggcaagtccttcgcccaccgcagtgagctgaagcatgccaagagaatcgtggtgaagctcggcagtgccgtggtgacccgaggggatgaatgtggcctggccctggggcgcttggcatctattgttgagcaggtatcagtgctgcagaatcagggcagagagatgatgctggtgaccagtggagccgtagcctttggcaaacaacgcttgcgccatgagatccttctgtctcagagcgtgcggcaggccctccactcggggcagaaccagctgaaagaaatggcaattccagtcttagaggcacgagcctgtgcagctgccggacagagtgggctgatggccttgtatgaggctatgtttacccagtacagcatctgtgctgcccagattttggtgaccaatttggatttccatgatgagcagaagcgccggaacctcaatggaacacttcatgaactccttagaatgaacattgtccccattgtcaacacaaatgatgctgttgtccccccagctgagcccaacagtgacctgcagggggtaaatgttattagtgttaaagataatgatagcctggctgcccgactggctgtggaaatgaaaactgatctcttgattgttctttcagatgtagaaggcctttttgacagccccccaggttcagatgatgcaaagcttattgatatattttatcccggagatcagcagtctgtgacatttggaaccaagtctagagtgggaatgggtggcatggaagccaaggtgaaagcagccctctgggctttgcaaggtggcacttctgttgttattgccaatggaacccacccaaaggtgtctgggcacgtcatcacagacattgtggaggggaagaaagttggtaccttcttttcagaagtaaagcctgcaggccctactgttgagcagcagggagaaatggcgcgatctggaggaaggatgttggccaccttggaacctgagcagagagcagaaattatccatcatctggctgatctgttgacggaccagcgtgatgagatcctgttagccaacaaaaaagacttggaggaggcagaggggagacttgcagctcctctgctgaaacgtttaagcctctccacatccaaattgaacagcctggccatcggtctgcgacagatcgcagcctcctcccaggacagcgtgggacgtgttttgcgccgcacccgaatcgccaaaaacttggaactggaacaagtgactgtcccaattggagttctgctggtgatctttgaatctcgtcctgactgtctaccccaggtggcagctttggctatcgcaagtggcaatggcttgttactcaaaggagggaaggaggctgcacacagcaaccggattctccacctcctgacccaggaggctctctcaatccatggagtcaaggaggccgtgcaactggtgaataccagagaagaagttgaagatctttgccgcctagacaaaatgatagatctgatcattccacgtggctcttcccagctggtcagagacatccagaaagctgctaaggggattccagtgatggggcacagcgaagggatctgtcacatgtatgtggattccgaggccagtgttgataaggtcaccaggctagtcagagactctaaatgtgaatatccagctgcctgtaatgctttggagactttgttaatccaccgggatctgctcaggacaccattatttgaccagatcattgatatgctgagagtggaacaggtaaaaattcatgcaggccccaaatttgcctcctatctgaccttcagcccctccgaagtgaagtcactccgaactgagtatggggacctggaattatgcattgaagtagtggacaacgttcaggatgccattgaccacatccacaagtatggcagctcccacacggatgtcatcgtcacagaggacgaaaacacagcggagttcttcctgcagcacgtagacagtgcctgtgtgttctggaatgccagcactcgcttttctgatggttaccgctttggactgggagctgaagtgggaatcagtacatcgagaatccacgcccggggaccagtaggacttgagggactgcttactactaagtggctgctgcgagggaaggaccacgtggtctcagatttctcagagcatggaagtttaaaatatcttcatgagaacctccctattcctcagagaaacaccaactgaaaagagccaggaaaacccgggaattttccaaaaggtcttcacgttaaacttgtcttatctcaggagagagcccgctcttgtctcccagttcctggtagggtctgcctgttggaaagtgtacctggatgcttctgggctccgtttggcaatagcagtcttggctgatgtgcacagtctggctcccagctcaccctttttttttaaagtaagaaaatagttgctaccgatagggactttgccaagtccaattatcttctaggattgaaaggtgcattttccccataaaaaaggcgaggaaaacccatggctgctttgtgtcacctcagtgacttacagtcccccttggcatttagttggtactagagccagtcatccttaacaaatcttttcacattttatttctttcacatgtagtcatcttcaaaaaggaaagatttggaattttagaaaaggggcaactcttctttttagcattctcatcagaaagtcacaaaaatcgatggaatcatttccactgggaagattgaccttttgtatttatttgtggggtaaattaataagcattccagatgcttgcagcttcctgcatccaggagatgctgtgttccccgtgatgcagctggaacccaagctgcagcaggagatgcaagtttcaggatgttccccactgagctggaggaatatctacagcagtgatgcttgaaatttttgtatgaattattttgtcgtcctacccttttcctccaaaacaaaaattagaggattattttaatactttggattcttcccccttttttgagaaataaagttttttatgaaaagcctgtgcgtga

SEQ ID NO: 106321 - DNA, 9569 bp, Homo sapiens
  Payload ID: 882
  Gene Symbol: ALDH2
  Gene Name: aldehyde dehydrogenase 2 family (mitochondrial)
  Uniprot ID: P05091
  ENST ID: ENST00000261733
  CDS Start-End: 62-1615
tcagtggccctgagaccctagctctgctctcggtccgctcgctgtccgctagcccgctgcgatgttgcgcgctgccgcccgcttcgggccccgcctgggccgccgcctcttgtcagccgccgccacccaggccgtgcctgcccccaaccagcagcccgaggtcttctgcaaccagattttcataaacaatgaatggcacgatgccgtcagcaggaaaacattccccaccgtcaatccgtccactggagaggtcatctgtcaggtagctgaaggggacaaggaagatgtggacaaggcagtgaaggccgcccgggccgccttccagctgggctcaccttggcgccgcatggacgcatcacacaggggccggctgctgaaccgcctggccgatctgatcgagcgggaccggacctacctggcggccttggagaccctggacaatggcaagccctatgtcatctcctacctggtggatttggacatggtcctcaaatgtctccggtattatgccggctgggctgataagtaccacgggaaaaccatccccattgacggagacttcttcagctacacacgccatgaacctgtgggggtgtgcgggcagatcattccgtggaatttcccgctcctgatgcaagcatggaagctgggcccagccttggcaactggaaacgtggttgtgatgaaggtagctgagcagacacccctcaccgccctctatgtggccaacctgatcaaggaggctggctttccccctggtgtggtcaacattgtgcctggatttggccccacggctggggccgccattgcctcccatgaggatgtggacaaagtggcattcacaggctccactgagattggccgcgtaatccaggttgctgctgggagcagcaacctcaagagagtgaccttggagctgggggggaagagccccaacatcatcatgtcagatgccgatatggattgggccgtggaacaggcccacttcgccctgttcttcaaccagggccagtgctgctgtgccggctcccggaccttcgtgcaggaggacatctatgatgagtttgtggagcggagcgttgcccgggccaagtctcgggtggtcgggaacccctttgatagcaagaccgagcaggggccgcaggtggatgaaactcagtttaagaagatcctcggctacatcaacacggggaagcaagagggggcgaagctgctgtgtggtgggggcattgctgctgaccgtggttacttcatccagcccactgtgtttggagatgtgcaggatggcatgaccatcgccaaggaggagatcttcgggccagtgatgcagatcctgaagttcaagaccatagaggaggttgttgggagagccaacaattccacgtacgggctggccgcagctgtcttcacaaaggatttggacaaggccaattacctgtcccaggccctccaggcgggcactgtgtgggtcaactgctatgatgtgtttggagcccagtcaccctttggtggctacaagatgtcggggagtggccgggagttgggcgagtacgggctgcaggcatacactgaagtgaaaactgtcacagtcaaagtgcctcagaagaactcataagaatcatgcaagcttcctccctcagccattgatggaaagttcagcaagatcagcaacaaaaccaagaaaaatgatccttgcgtgctgaatatctgaaaagagaaatttttcctacaaaatctcttgggtcaagaaagttctagaatttgaattgataaacatggtgggttggctgagggtaagagtatatgaggaaccttttaaacgacaacaatactgctagctttcaggatgatttttaaaaaatagattcaaatgtgttatcctctctctgaaacgcttcctataactcgagtttataggggaagaaaaagctattgtttacaattatatcaccattaaggcaactgctacaccctgctttgtattctgggctaagattcattaaaaactagctgctcttaacttactgggtaactctttgtccatctcaataaccaaaggaaggtgggcatggtggctcacgcctgtaatcccagcactttgggaagccgaggcgggtggatcactcgaggtcaggagtttgagaccagcctggccaacgtagtgaaaccctgtctctcactaaaaatacacaaattaggcagtcatggtggctggcacctgtaatcccagctacttgggaggctgaggcaggaaaattggttgaacctgggaggtggaggttgcagtgagtggagatcatgccactgcactccagcctgggagtcagagcgagactccatctcaaaaaaagtaaataaatgaaatagcctaaggaaatgctggcaggcagtaatgatatggcacactggatatgatttctgcccctcctctgctgtgggtaaacagcttctgtttcatgcatttacttttttattttaattacaccaataagaatgtgcttgaatgtttcatgcatttaatttgtttcatgcatttaacttctggcctgtttacctgtagcaggctctgagatgtgctctagagacagaacctaaacatgatgcccaagagaggggagagatactgaatgtccaatgttctcaaattttttttttttttttttttgagacagggtcttgctctgccatccaggctggagtgcagtggcacgatcatagctcactgctgcctcgacctcctgggctcaaatgatcctcctgcttcagcttcctgggctaatgtttgtattttttgtggagatgggactttgttatgttgcccaggctgttttcaaactcctggactcaagtgatcctcccgccttagcctcctaaggtgctgggattacaggtgtgagccactgtgcccaattcagttctcagtaaaaacttgatcaggccaaatgaaagtgacatgggccaatttcataatagattgatttggaaaccagatgtcaatttacttactttaagtgagatctgtatcttcagtaaccagacctcttgagtctcccacccagaacactatcttcctctagtcaagatacctggcaaaggccgggcacagtggctcacgcctataattccagcactttgggaggccaaggtgggtgggtcacctgaggttgggagttcgagaccagcctgaccaacagggagaaaccccatctctactgaaaatacaaaaaaaaaaaaaaaaactagccgggcatggtggctcatgcctgtaatcccagctactcaggaggctgaggcaggagaattgcttgaacctgggaggcagaggttgcagtgagccaagattgctccattgtactccagcctgggcaacaagagagaaactccgtctcaaaatataaataaataagaaaaagaagaaatggaagctgggttcaagagggcaatcagcagtctctaccatcatgtgaaacaccactctgtgatttgagtcttgacaatgtattttctttttttttttcttcttttttttttgagactgagtctcggtctgtcgcccaggctggagtgcagtgacgtgatcttggctcactgcaacctctgcctcctgggttggagcaattctcctgcctcagcctcctgagtagctgggattacaggtgtgcgccaccatgcctggctaatttttgtatttttagtagagacggggttttgccatgttggccaggctggtgttgaaggcctgacctcaggtaatccacccacctctgcctcccagagtactgggattacaagtgtgagccaccgtgcccggccaactgtagggaccagccccacagggtcggtgggtttttctccccatgtgcggagacgagagattgtagaaataaagacacaagacaaagaggtaaaagaaaagacagctgggcttgggggaccactaccaccaagaggcggagaccggtagaggccccgaatgtctggctgcactgttatttattggatacaaagcaaaaggggcagggtaaagagtgtgagtcatctccaatgacaggtaaggtcacgtgggtcacgtgtccactggacagggggcccttccctgcctggcagccaaggcagagatagacagggagagagagagacagcttacgccattatttctgcgtatcagagacttttagtactttcactaattttgctactgttatctaaaaggcagagccaggtgtacaggatggaacatgaaggcagactaggagcgtgaccactgaagcacagcaccacagggagacggttaggcctccggataactaatgattaatgatattcatatataatcatgtctgtgatctagatctagtataactcttgttgttttatatattttattatactggaacagctcgtgccctcggtctcttgcctcagcacctggatggcttgccgcccacagccaacaatgtgttttcaatatgctccccaaactacagcaaactcctcttaactcgggatttagggtgatgccctacttatgcctaactttatcaccagcttaaccctcatctcattatataggatgatattacttctaggaagattttctatgtatggagggtgcatcatttaagagtattttaggccaggcactgtggctcatgcctgtaatcccagcattttgggaagctgaggtgggtgatttgcttcagcccacgagttcaagatcagcctggccaatatggtgaaaccccatctctacaaaaaaatacaaaaattagctgagcgtggtgatgtgtgcctgtggtcccagttactctggaggctgatgtgggaggatcacttgagcccaggaggtcaaggctgcagtgagctgtgattgcaccacttcactccagcccagagtgagaccccatctctgaaaaaaacacaaaaaacaagaaaagaatactgcaaagaaccttggtaggggtgaattggaaaaagtagagaaatgtaatatttctttcctgctgtactcactgtaactgtgagaggatcggctcttttaaccaacagataagaaaggaaatattagctatgaagaaatgtctatcaagttgattttgacaacctagacacattaatctccttgcacttttagtgacaggaacccattagaaccttaagcagctgtctgaagtaaaaacaaagctctcaggtgatgaaccacctaatctccctgggtattcggatgtgggtcagtcacaggagtattaggtgtaaagccgctgcttctgggtagagcctccacttgtggctgcacagagggcacagagagcttttccttcagcccggagaagcttcctaagtgtgggcgccaccttgtgggacatacattgaactacgacgctatttctccaagaattaacaggacagcccctcccaccggtgtccttccaacgatgttgcatacaatttggctgtacatttggcaggcagtgtaatgagggaatcaaagaccaggatcacatactggaaagaattgaaaacagagactcccaacaaaaacttgtacacggacgttcacagcagcactattcacgacagctcagagatggaatcaacccaaatatcagtcaatagatgaatggacagacaaaatgtgacatatccatgcagtggaatattatttagccataaaaaggaaggaagtgctgatgcatgttgcgatgtggatgaaccttgaaaacatgatgctgagtgaaagaagccagacacaaaaggagaaggactgtatgatttcacttataggaaatatccagaacaggcaaatctatatagagagaaggtcgattgctgggggccctgggaagggaccaagggggagtgacttctaatggtggggtgcccttttggggtgatgaaaatgttttggaaccagatacaggtggtggttgtacaacattgtgaatttactaaatgcaaccaaattgctcacttaaaaacaacaaattcaggccaggtgcagtggctcacacccgtaatcccagcactttgggaggccgaggtgggcggatcacatgaggtcaagagttcgagactagcctggccaacatggtgaaatcccatctcggccgggcgcggtggctcacgcctgtaatcccagcactttgggaggctgaggcgggtggatcacgaggtcaggagatcgagaccatcctggctaacacggtgaaaccccgtctctactaaaaatacaaaaaattagccaggcgtggtggtgggcgcctgtagtcccagctgatcgggaggctaaggcaggagaatggtgtgaacccaggaggcggagcttgcagtgagccgagatcgcgccactgcactctatcctgggtgacagagtgagactctgtctccaaaaaaaaaaaaagaaaccccatctctacccaaaatacaaaaattagctgggcatggtggctggcacctgtaatcccagctactcaggaggctgaggcaggagaattggttgaacctgggaggcagaggttgcagtgagctaagatcgcaccactgcactccagcctgggtgacagaacgagactgtctcaaaaaaaaaaaaaaaaaaaagtggccaggtggtgccatggctcatgcctgtaatctcagcattttgggatactgaggcgggtggattacctgaggccaggagttcgagatcagcctggccaacatgatgaaaacccatctctgctaaaaatacaaaaaattggctgggcttggtagcatgtgcccagctacttgggaggctgagacaggagaatcgcttgaacctgggaggcagaggttgcggttagccaagattgtgccactgcactccatgggtgacacagagagactctgtctcaaaaaaaaaaaaaaaaaagtaaatgctatgttatgtgaatttcacctcaactgaaaaaaacagggtcccagagctggtcaggggaacttggacaaaccacacaacttctgagcttccatttcctcacaatctctgcagtcacttccaactctcatttggcttattctgtgaaggataaaacagagctgacatttgttcatttgtattgattttatttacatttttcaaaaggaaatagatgcagatggtatagaaagtttcagtgaaatgtaaatctgatgcccaatcctgtggccccaagaagtattaactgtgcacccactacatgccaggaactgtacttggagccttctcaagagcttcttaacaatattttcattttttatattttttaatgacagggtctaactccgtcgtccaggctggagtgcagtggtgcgatcatagctcactgcagcctctacctcctaggctcaggtgattcttctgcctcagcctcccaaatagctggtactacaagcatgtgccaccacagtcagctaattatttttggagagtcagggtttcactatgtagctcaggctggtcttcagctcctggcttgaagtgatcctcctgccttggcacatagaaggggttacaatatacatatattagagtgagagcatagatgtgatgcctggcgatatggcttacttatgagacagcacctgacctacagccatctatgactcctactgtatcttccatgccaggagtaagggtgaggatacctggcaataataaaaataataacctgagagtctaatggcttattttttgtagagatggggtctcactgtgttgtttaggctggtcttgaacttctgggctcaagtgatcctcccacctcagcctcctgagtagctgggattataggcgtgcactaccatgcatatatatatatatttttttttttttttgagagagagagagagagatggagtcttgctatgttgctcaggctggtctcgaactcctggcctcaagtcatcctgctggcttggcctctcaagtgctaggattacaggcatgagacactgggcacagccctaatagcttatttttaaagctatatcaaaatgtcatgcacctgaacatttgaagtaacctctctgatagtacggatatttatcccctcaaaatctcatgttaaaatgtaatcttcagtgttggaggtggggcaaggtgtgaggtgttaggatcatgggggtggatccctcatgaatggcttggtgtcctcccccatggtaatgagttcactcaagagctggttgtttaaaaggtgacgtggacctaatccctgttggactgaacaaaaggggacgaacacagcaataaagataaagaccaaagagtatatttggaagaaggggtcagggggctccttgcttctagtgaaaaagggccctgagctttagtgccctttgtatttattgggtaaaggagatagggagaagggggggtggttgtcggtcagcagcttgattcacagcaggctcacaagattgcattctttgaacagtaggctctagatgtctcagtagataacctcaaagagcatggcgccagggagtgattgccctcagcgaaccttctggcggctgaagcagaagtgagtttgcccacattctgcatttatgataaacagtttgctgtttgatcatatagcctcagtggaatgctgagttggtcacaacccatgggcattcagctctctacatttccccctttctgtttatgaattaattgaaagaatgtaaggccaggctgggcagctctcattttctgattggcagtccatccaattttacagactatgaacagaagacagagacaaaacaacattattccaaggactacatataagatgttaatgtggtgctttagacaggtccaagggttgaggctctccaggccttgctggaatttggtctagtcttctaaagaaggctgaaactcttgagtttgtttatttaaatcaagaattttgttttgtaattcaccgatatcaaaggtgatgttggatgtgcaagctccctgcaaatgggctttcacaaggtcccatggatactcactttggttatattctaagttggttacacaaatatgagtgtgattaaaatgatggtgcaattgctgttgcaattgcaagctttgtacttgttctcctaactgtagagccgtggatttcaacaatgccacttcagtttgtaactcagtgttaattttattctgaagtggccatgcttggttggctatacgcatccagttttccatgtactgagttgtttgaatagaactatgcaaagctacagaggacatcacaacggaagttattaatgtgaccaaggaaacaatagcaaaaattatcatgcctaaggctctatgggcacaatgagtaagttgagttagaagatgtttcatgaagtgcaaagcaggtgtggtagcccaaggctgggacagattaacaggaatccatagcccagggatgcgacccaaaattatcaaagtagagacattatgtgtttgcaatgtgctatgattaatgcagtgacataactggcaagatttacaggtcaattggatattgtttacctggagctggtccttcttagttgccaaaaaagacataaggattaaaaagacaaaccat

SEQ ID NO: 106322 - DNA, 1572 bp, Homo sapiens
  Payload ID: 882
  Gene Symbol: ALDH2
  Gene Name: aldehyde dehydrogenase 2 family (mitochondrial)
  Uniprot ID: P05091
  ENST ID: ENST00000416293
  CDS Start-End: 97-1509
attggctgccgcgcggggcggggagcggggtcggctcagtggccctgagaccctagctctgctctcggtccgctcgctgtccgctagcccgctgcgatgttgcgcgctgccgcccgcttcgggccccgcctgggccgccgcctcttgtcagccgccgccacccaggccgtgcctgcccccaaccagcagcccgaggtcttctgcaaccagattttcataaacaatgaatggcacgatgccgtcagcaggaaaacattccccaccgtcaatccgtccactggagaggtcatctgtcaggtagctgaaggggacaaggccttggagaccctggacaatggcaagccctatgtcatctcctacctggtggatttggacatggtcctcaaatgtctccggtattatgccggctgggctgataagtaccacgggaaaaccatccccattgacggagacttcttcagctacacacgccatgaacctgtgggggtgtgcgggcagatcattccgtggaatttcccgctcctgatgcaagcatggaagctgggcccagccttggcaactggaaacgtggttgtgatgaaggtagctgagcagacacccctcaccgccctctatgtggccaacctgatcaaggaggctggctttccccctggtgtggtcaacattgtgcctggatttggccccacggctggggccgccattgcctcccatgaggatgtggacaaagtggcattcacaggctccactgagattggccgcgtaatccaggttgctgctgggagcagcaacctcaagagagtgaccttggagctgggggggaagagccccaacatcatcatgtcagatgccgatatggattgggccgtggaacaggcccacttcgccctgttcttcaaccagggccagtgctgctgtgccggctcccggaccttcgtgcaggaggacatctatgatgagtttgtggagcggagcgttgcccgggccaagtctcgggtggtcgggaacccctttgatagcaagaccgagcaggggccgcaggtggatgaaactcagtttaagaagatcctcggctacatcaacacggggaagcaagagggggcgaagctgctgtgtggtgggggcattgctgctgaccgtggttacttcatccagcccactgtgtttggagatgtgcaggatggcatgaccatcgccaaggaggagatcttcgggccagtgatgcagatcctgaagttcaagaccatagaggaggttgttgggagagccaacaattccacgtacgggctggccgcagctgtcttcacaaaggatttggacaaggccaattacctgtcccaggccctccaggcgggcactgtgtgggtcaactgctatgatgtgtttggagcccagtcaccctttggtggctacaagatgtcggggagtggccgggagttgggcgagtacgggctgcaggcatacactgaagtgaaaactgtcacagtcaaagtgcctcagaagaactcataagaatcatgcaagcttcctccctcagccattgatggaaagttcagcaagatcagcaacaaaacc

SEQ ID NO: 106323 - DNA, 1760 bp, Homo sapiens
  Payload ID: 882
  Gene Symbol: ALDH2
  Gene Name: aldehyde dehydrogenase 2 family (mitochondrial)
  ENST ID: ENST00000548536
  CDS Start-End: 36-275
ctctcggtccgctcgctgtccgctagcccgctgcgatgttgcgcgctgccgcccgcttcgggccccgcctgggccgccgcctcttgtcagccgccgccacccaggccgtgcctgcccccaaccagcagcccgaggtcttctgcaaccagtctagattgaaaatgtcaactccagacatcactgtgcttctggaaactataaagaggaagtgggagctaggacatccccccaccacgccccgcccaagagcgtttacgtgtgttatattttcataaacaatgaatggcacgatgccgtcagcaggaaaacattccccaccgtcaatccgtccactggagaggtcatctgtcaggtagctgaaggggacaaggaagatgtggacaaggcagtgaaggccgcccgggccgccttccagctgggctcaccttggcgccgcatggacgcatcacacaggggccggctgctgaaccgcctggccgatctgatcgagcgggaccggacctacctggcggccttggagaccctggacaatggcaagccctatgtcatctcctacctggtggatttggacatggtcctcaaatgtctccggtattatgccggctgggctgataagtaccacgggaaaaccatccccattgacggagacttcttcagctacacacgccatgaacctgtgggggtgtgcgggcagatcattccgtggaatttcccgctcctgatgcaagcatggaagctgggcccagccttggcaactggaaacgtggttgtgatgaaggtagctgagcagacacccctcaccgccctctatgtggccaacctgatcaaggaggctggctttccccctggtgtggtcaacattgtgcctggatttggccccacggctggggccgccattgcctcccatgaggatgtggacaaagtggcattcacaggctccactgagattggccgcgtaatccaggttgctgctgggagcagcaacctcaagagagtgaccttggagctgggggggaagagccccaacatcatcatgtcagatgccgatatggattgggccgtggaacaggcccacttcgccctgttcttcaaccagggccagtgctgctgtgccggctcccggaccttcgtgcaggaggacatctatgatgagtttgtggagcggagcgttgcccgggccaagtctcgggtggtcgggaacccctttgatagcaagaccgagcaggggccgcaggtggatgaaactcagtttaagaagatcctcggctacatcaacacggggaagcaagagggggcgaagctgctgtgtggtgggggcattgctgctgaccgtggttacttcatccagcccactgtgtttggagatgtgcaggatggcatgaccatcgccaaggaggagatcttcgggccagtgatgcagatcctgaagttcaagaccatagaggaggttgttgggagagccaacaattccacgtacgggctggccgcagctgtcttcacaaaggatttggacaaggccaattacctgtcccaggccctccaggcgggcactgtgtgggtcaactgctatgatgtgtttggagcccagtcaccctttggtggctacaagatgtcggggagtggccgggagttgggcgagtacgggctgcaggcatacactgaagtgaaaactgtcacagtcaaagtgcctcagaagaactcataagaatcatgcaagcttcctccctcagccattgatggaaagttcagcaagatcagca

SEQ ID NO: 106324 - DNA, 580 bp, Homo sapiens
  Payload ID: 882
  Gene Symbol: ALDH2
  Gene Name: aldehyde dehydrogenase 2 family (mitochondrial)
  ENST ID: ENST00000549106
  CDS Start-End: 1-352
ggaacaggcccacttcgccctgttcttcaaccagggccagtgctgctgtgccggctcccggaccttcgtgcaggaggacatctatgatgagtttgtggagcggagcgttgcccgggccaagtctcgggtggtcgggaacccctttgatagcaagaccgagcaggggccgcaggtggatgaaactcagtttaagaagatcctcggctacatcaacacggggaagcaagagggggcgaagctgctgtgtggtgggggcattgctgctgaccgtggttacttcatccagcccactgtgtttggagatgtgcaggatggcatgaccatcgccaaggaggagggtcaactgctatgatgtgtttggagcccagtcaccctttggtggctacaagatgtcggggagtggccgggagttgggcgagtacgggctgcaggcatacactgaagtgaaaactgtcacagtcaaagtgcctcagaagaactcataagaatcatgcaagcttcctccctcagccattgatggaaagttcagcaagatcagcaacaaaaccaagaaaaatgatccttgcgtgctgaatatctg

SEQ ID NO: 106325 - DNA, 1779 bp, Homo sapiens
  Payload ID: 883
  Gene Symbol: ALDH3A1
  Gene Name: aldehyde dehydrogenase 3 family, member A1
  Uniprot ID: P30838
  ENST ID: ENST00000225740
  CDS Start-End: 181-1542
cagaggtccagaggacgccacaccccacatttgaatatttttttttcttgtcacgcaaacttcctgggcaggaactccaagggctcaatggacgggaagcagggtccttaaatacgtcccctcttggctcttgccgttccaggagccccagttaccgggagaggctgtgtcaaaggcgccatgagcaagatcagcgaggccgtgaagcgcgcccgcgccgccttcagctcgggcaggacccgtccgctgcagttccggatccagcagctggaggcgctgcagcgcctgatccaggagcaggagcaggagctggtgggcgcgctggccgcagacctgcacaagaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacctcaccatccagcccatggtgggcgccatcgctgcagggaactcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggcccctgactacatcctctgtgacccctcgatccagaaccaaattgtggagaagctcaagaagtcactgaaagagttctacggggaagatgctaagaaatcccgggactatggaagaatcattagtgcccggcacttccagagggtgatgggcctgattgagggccagaaggtggcttatgggggcaccggggatgccgccactcgctacatagcccccaccatcctcacggacgtggacccccagtccccggtgatgcaagaggagatcttcgggcctgtgctgcccatcgtgtgcgtgcgcagcctggaggaggccatccagttcatcaaccagcgtgagaagcccctggccctctacatgttctccagcaacgacaaggtgattaagaagatgattgcagagacatccagtggtggggtggcggccaacgatgtcatcgtccacatcaccttgcactctctgcccttcgggggcgtggggaacagcggcatgggatcctaccatggcaagaagagcttcgagactttctctcaccgccgctcttgcctggtgaggcctctgatgaatgatgaaggcctgaaggtcagataccccccgagcccggccaagatgacccagcactgaggaggggttgctccgcctggcctggccatactgtgtcccatcggagtgcggaccaccctcactggctctcctggccctgggagaatcgctcctgcagccccagcccagccccactcctctgctgacctgctgacctgtgcacaccccactcccacatgggcccaggcctcaccattccaagtctccacccctttctagaccaataaagagacgaatacaattttctaactcagcaaa

SEQ ID NO: 106326 - DNA, 1495 bp, Homo sapiens
  Payload ID: 883
  Gene Symbol: ALDH3A1
  Gene Name: aldehyde dehydrogenase 3 family, member A1
  ENST ID: ENST00000395555
  CDS Start-End: 89-1258
cgggaagcagggtccttaaatacgtcccctcttggctcttgccgttccaggagccccagttaccgggagaggctgtgtcaaaggcgccatgagcaagatcagcgaggccgtgaagcgcgcccgcgccgccttcagctcgggcaggacccgtccgctgcagttccggatccagcagctggaggcgctgcagcgcctgatccaggagcaggagcaggagctggtgggcgcgctggccgcagacctgcacaagaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacctcaccatccagcccatggtgggcgccatcgctgcagggaactcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggcccctgactacatcctctgtgacccctcgatccagaaccaaattgtggagaagctcaagaagtcactgaaagagatcttcgggcctgtgctgcccatcgtgtgcgtgcgcagcctggaggaggccatccagttcatcaaccagcgtgagaagcccctggccctctacatgttctccagcaacgacaaggtgattaagaagatgattgcagagacatccagtggtggggtggcggccaacgatgtcatcgtccacatcaccttgcactctctgcccttcgggggcgtggggaacagcggcatgggatcctaccatggcaagaagagcttcgagactttctctcaccgccgctcttgcctggtgaggcctctgatgaatgatgaaggcctgaaggtcagataccccccgagcccggccaagatgacccagcactgaggaggggttgctccgcctggcctggccatactgtgtcccatcggagtgcggaccaccctcactggctctcctggccctgggagaatcgctcctgcagccccagcccagccccactcctctgctgacctgctgacctgtgcacaccccactcccacatgggcccaggcctcaccattccaagtctccacccctttctagaccaataaagagacgaatacaattttctaactcagcaaa

SEQ ID NO: 106327 - DNA, 781 bp, Homo sapiens
  Payload ID: 883
  Gene Symbol: ALDH3A1
  Gene Name: aldehyde dehydrogenase 3 family, member A1
  ENST ID: ENST00000426645
  CDS Start-End: 5-781
cgccatgagcaagatcagcgaggccgtgaagcgcgcccgcgccgccttcagctcgggcaggacccgtccgctgcagttccggatccagcagctggaggcgctgcagcgcctgatccaggagcaggagcaggagctgaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacctcaccatccagcccatggtgggcgccatcgctgcagggaactcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggcccctgactacatcctctgtgacccctcgatccagaaccaaattgtggagaagctcaagaagtcactgaaa

SEQ ID NO: 106328 - DNA, 1771 bp, Homo sapiens
  Payload ID: 883
  Gene Symbol: ALDH3A1
  Gene Name: aldehyde dehydrogenase 3 family, member A1
  Uniprot ID: P30838
  ENST ID: ENST00000444455
  CDS Start-End: 176-1537
gctttttagaacaatggcttagccaggagggtggtgctgggtttttctttatcggcttgggtgtggaatcgcggactgcgcccctccaatctgatctggagagtggctgactgcgtgtgcagagctctgggggtgttggtctgggattgtgccatcagctttgcaagcaagcgccatgagcaagatcagcgaggccgtgaagcgcgcccgcgccgccttcagctcgggcaggacccgtccgctgcagttccggatccagcagctggaggcgctgcagcgcctgatccaggagcaggagcaggagctggtgggcgcgctggccgcagacctgcacaagaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacctcaccatccagcccatggtgggcgccatcgctgcagggaactcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggcccctgactacatcctctgtgacccctcgatccagaaccaaattgtggagaagctcaagaagtcactgaaagagttctacggggaagatgctaagaaatcccgggactatggaagaatcattagtgcccggcacttccagagggtgatgggcctgattgagggccagaaggtggcttatgggggcaccggggatgccgccactcgctacatagcccccaccatcctcacggacgtggacccccagtccccggtgatgcaagaggagatcttcgggcctgtgctgcccatcgtgtgcgtgcgcagcctggaggaggccatccagttcatcaaccagcgtgagaagcccctggccctctacatgttctccagcaacgacaaggtgattaagaagatgattgcagagacatccagtggtggggtggcggccaacgatgtcatcgtccacatcaccttgcactctctgcccttcgggggcgtggggaacagcggcatgggatcctaccatggcaagaagagcttcgagactttctctcaccgccgctcttgcctggtgaggcctctgatgaatgatgaaggcctgaaggtcagataccccccgagcccggccaagatgacccagcactgaggaggggttgctccgcctggcctggccatactgtgtcccatcggagtgcggaccaccctcactggctctcctggccctgggagaatcgctcctgcagccccagcccagccccactcctctgctgacctgctgacctgtgcacaccccactcccacatgggcccaggcctcaccattccaagtctccacccctttctagaccaataaagagacgaatacaattttctaactcagc

SEQ ID NO: 106329 - DNA, 1359 bp, Homo sapiens
  Payload ID: 883
  Gene Symbol: ALDH3A1
  Gene Name: aldehyde dehydrogenase 3 family, member A1
  ENST ID: ENST00000439102
  CDS Start-End: 244-1359
tgcgtctcccaggtgtggcacgcgtggtttacacaccaagcctggttcagctctgccaagaaaccagcgctttttagaacaatggcttagccaggagggtggtgctgggtttttctttatcggcttgggtgtggaatcgcggactgcgcccctccaatctgatctggagagtggctgactgcgtgtgcagagctctgggggtgttggtctgggattgtgccatcagctttgcaagcaagcgccatgagcaagatcagcgaggccgtgaagcgcgcccgcgccgccttcagctcgggcaggacccgtccgctgcagttccggatccagcagctggaggcgctgcagcgcctgatccaggagcaggagcaggagctggtgggcgcgctggccgcagacctgcacaagaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacctcaccatccagcccatggtgggcgccatcgctgcagggaactcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggcccctgactacatcctctgtgacccctcgatccagaaccaaattgtggagaagctcaagaagtcactgaaagagttctacggggaagatgctaagaaatcccgggactatggaagaatcattagtgcccggcacttccagagggtgatgggcctgattgagggccagaaggtggcttatgggggcaccggggatgccgccactcgctacatagcccccaccatcctcacggacgtggacccccagtccccggtgatgcaagaggagatcttcgggcctgtgctgcccatcgtgtgcgtgcgcagcctggaggaggccatccagttcatcaaccagcgtgagaagcccctggccctctacatgttctccagcaacgacaag

SEQ ID NO: 106330 - DNA, 1925 bp, Homo sapiens
  Payload ID: 883
  Gene Symbol: ALDH3A1
  Gene Name: aldehyde dehydrogenase 3 family, member A1
  Uniprot ID: P30838
  ENST ID: ENST00000457500
  CDS Start-End: 331-1692
atcagctttgcaagcaagtaagggagcggaaaaggccgggaaaggccctgccgcgagcacgctgccaagagcccccagcagcagttcggcttaggactcgggttgcggcgggtgtcaccttctcaggggctagcaaggcagccagggcccaggcgtctgagtgaggggcgggagaggaggcgaggcagaaagtggaccttccagcggaaaggccattttccccaaggccgagcccagggaagtcccttcctatagaattcaggcagggtgggaggcagggcgcgctcgtgcccctcagccagctgcaggtgctctctgtccccaggcgccatgagcaagatcagcgaggccgtgaagcgcgcccgcgccgccttcagctcgggcaggacccgtccgctgcagttccggatccagcagctggaggcgctgcagcgcctgatccaggagcaggagcaggagctggtgggcgcgctggccgcagacctgcacaagaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacctcaccatccagcccatggtgggcgccatcgctgcagggaactcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggcccctgactacatcctctgtgacccctcgatccagaaccaaattgtggagaagctcaagaagtcactgaaagagttctacggggaagatgctaagaaatcccgggactatggaagaatcattagtgcccggcacttccagagggtgatgggcctgattgagggccagaaggtggcttatgggggcaccggggatgccgccactcgctacatagcccccaccatcctcacggacgtggacccccagtccccggtgatgcaagaggagatcttcgggcctgtgctgcccatcgtgtgcgtgcgcagcctggaggaggccatccagttcatcaaccagcgtgagaagcccctggccctctacatgttctccagcaacgacaaggtgattaagaagatgattgcagagacatccagtggtggggtggcggccaacgatgtcatcgtccacatcaccttgcactctctgcccttcgggggcgtggggaacagcggcatgggatcctaccatggcaagaagagcttcgagactttctctcaccgccgctcttgcctggtgaggcctctgatgaatgatgaaggcctgaaggtcagataccccccgagcccggccaagatgacccagcactgaggaggggttgctccgcctggcctggccatactgtgtcccatcggagtgcggaccaccctcactggctctcctggccctgggagaatcgctcctgcagccccagcccagccccactcctctgctgacctgctgacctgtgcacaccccactcccacatgggcccaggcctcaccattccaagtctccacccctttctagaccaataaagagacgaatacaattttctaactcag

SEQ ID NO: 106331 - DNA, 1587 bp, Homo sapiens
  Payload ID: 883
  Gene Symbol: ALDH3A1
  Gene Name: aldehyde dehydrogenase 3 family, member A1
  ENST ID: ENST00000468746
  CDS Start-End: 89-1279
cgggaagcagggtccttaaatacgtcccctcttggctcttgccgttccaggagccccagttaccgggagaggctgtgtcaaaggcgccatgagcaagatcagcgaggccgtgaagcgcgcccgcgccgccttcagctcgggcaggacccgtccgctgcagttccggatccagcagctggaggcgctgcagcgcctgatccaggagcaggagcaggagctggtgggcgcgctggccgcagacctgcacaagaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacctcaccatccagcccatggtgggcgccatcgctgcagggaactcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggcccctgactacatcctctgtgacccctcgatccagaaccaaattgtggagaagctcaagaagtcactgaaagagttctacggggaagatgctaagaaatcccgggactatggaagaatcattagtgcccggcacttccagagggtgatgggcctgattgagggccagaaggtggcttatgggggcaccggggatgccgccactcgctacatagcccccaccatcctcacggacgtggacccccagtccccggtgatgcaagaggagatcttcgggcctgtgctgcccatcgtgtgcgtgcgcagcctggaggaggccatccagttcatcaaccagcgtgagaagcccctggccctctacatgttctccagcaacgacaagggaacagcggcatgggatcctaccatggcaagaagagcttcgagactttctctcaccgccgctcttgcctggtgaggcctctgatgaatgatgaaggcctgaaggtcagataccccccgagcccggccaagatgacccagcactgaggaggggttgctccgcctggcctggccatactgtgtcccatcggagtgcggaccaccctcactggctctcctggccctgggagaatcgctcctgcagccccagcccagccccactcctctgctgacctgctgacctgtgcacaccccactcccacatgggcccaggcctcaccattccaagtctccacccctttctagaccaataaagagacgaatacaattttctaactcagcaaa

SEQ ID NO: 106332 - DNA, 859 bp, Homo sapiens
  Payload ID: 883
  Gene Symbol: ALDH3A1
  Gene Name: aldehyde dehydrogenase 3 family, member A1
  ENST ID: ENST00000574162
  CDS Start-End: 466-859
gcttttccagactccttccttcccaagcatctctggttttcggtgaccacacagacccttggccctcttctcagctattcaacgagagagcagatttatggattggagacccccatcaaaagtccccagcctgtggctccccagggtggagtctgcactcagagccggggccctaagtgtcaagagtcctacatcatctctccagggggtccctgcctctgggaccatcatctctggagcatcctcctggacctctggcagctctgccatcccccaaaccaggaggcagaggtcccagggatccgcggagcagggacaccaaggtggccgtggagtgagaggccctgatgggccgtcagactccatgactggaaggaaggcagcagagccgagtgctaaaggcatgagctgctgacagagatgcatgtgggttcaaaccctgacatgccacctgctaactgcgccatgagcaagatcagcgaggccgtgaagcgcgcccgcgccgccttcagctcgggcaggacccgtccgctgcagttccggatccagcagctggaggcgctgcagcgcctgatccaggagcaggagcaggagctggtgggcgcgctggccgcagacctgcacaagaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacctcaccatccagcccatggtgggcgccatcgctgcag

SEQ ID NO: 106333 - DNA, 1572 bp, Homo sapiens
  Payload ID: 883
  Gene Symbol: ALDH3A1
  Gene Name: aldehyde dehydrogenase 3 family, member A1
  ENST ID: ENST00000494157
  CDS Start-End: 193-1335
ttttttcttgtcacgcaaacttcctgggcaggaactccaagggctcaatggacgggaagcagggtccttaaatacgtcccctcttggctcttgccgttccaggagccccagttaccgggagaggctgtgtcaaagaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacctcaccatccagcccatggtgggcgccatcgctgcagggaactcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggcccctgactacatcctctgtgacccctcgatccagaaccaaattgtggagaagctcaagaagtcactgaaagagttctacggggaagatgctaagaaatcccgggactatggaagaatcattagtgcccggcacttccagagggtgatgggcctgattgagggccagaaggtggcttatgggggcaccggggatgccgccactcgctacatagcccccaccatcctcacggacgtggacccccagtccccggtgatgcaagaggagatcttcgggcctgtgctgcccatcgtgtgcgtgcgcagcctggaggaggccatccagttcatcaaccagcgtgagaagcccctggccctctacatgttctccagcaacgacaaggtgattaagaagatgattgcagagacatccagtggtggggtggcggccaacgatgtcatcgtccacatcaccttgcactctctgcccttcgggggcgtggggaacagcggcatgggatcctaccatggcaagaagagcttcgagactttctctcaccgccgctcttgcctggtgaggcctctgatgaatgatgaaggcctgaaggtcagataccccccgagcccggccaagatgacccagcactgaggaggggttgctccgcctggcctggccatactgtgtcccatcggagtgcggaccaccctcactggctctcctggccctgggagaatcgctcctgcagccccagcccagccccactcctctgctgacctgctgacctgtgcacaccccactcccacatgggcccaggcctcaccattccaagtctccacccctttctagaccaataaagagacgaatacaattttctaactcagcaaa

SEQ ID NO: 106334 - DNA, 587 bp, Homo sapiens
  Payload ID: 883
  Gene Symbol: ALDH3A1
  Gene Name: aldehyde dehydrogenase 3 family, member A1
  ENST ID: ENST00000570414
  CDS Start-End: 364-587
aggagccccagttaccgggagaggctgtgtcaaaggtaatcctcttccctgcattccttattttttctcttgtctaggtggagtctgcactcagagccggggccctaagtgtcaagagtcctacatcatctctccagggggtccctgcctctgggaccatcatctctggagcatcctcctggacctctggcagctctgccatcccccaaaccaggaggcagaggtcccagggatccgcggagcagggacaccaaggtggccgtggagtgagaggccctgatgggccgtcagactccatgactggaaggaaggcagcagagccgagtgctaaaggcatgagctgctgacagagatgcatgcgccatgagcaagatcagcgaggccgtgaagcgcgcccgcgccgccttcagctcgggcaggacccgtccgctgcagttccggatccagcagctggaggcgctgcagcgcctgatccaggagcaggagcaggagctggtgggcgcgctggccgcagacctgcacaagaatgaatggaacgcctactatgaggaggtggtgtacgtcctagaggagatcgagtacatgat

SEQ ID NO: 106335 - DNA, 400 bp, Homo sapiens
  Payload ID: 883
  Gene Symbol: ALDH3A1
  Gene Name: aldehyde dehydrogenase 3 family, member A1
  ENST ID: ENST00000573368
  CDS Start-End: 42-400
ctgccgcgagcacgctgccaagagcccccagcagcagcgccatgagcaagatcagcgaggccgtgaagcgcgcccgcgccgccttcagctcgggcaggacccgtccgctgcagttccggatccagcagctggaggcgctgcagcgcctgatccaggagcaggagcaggagctggtgggcgcgctggccgcagacctgcacaagaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacct

SEQ ID NO: 106336 - DNA, 3928 bp, Homo sapiens
  Payload ID: 884
  Gene Symbol: ALDH3A2
  Gene Name: aldehyde dehydrogenase 3 family, member A2
  Uniprot ID: P51648
  ENST ID: ENST00000176643
  CDS Start-End: 447-1904
ccggggcgctctcagcaggatggccaacaccttccctccatccctacaccccgccgccccctggcccgtggccgcgctcggctcccgcactgctcactccaccccctacatcccagcccgctgccagagccggggagagggcgggggccgcgtgggcgaggccgtgaacagcggctgtcacgtgggccgcccaggccaataggggtgaggctttgggtcgagctcagtcctcccccggcgcctccgactggcagtgggactcagcgggcgtggaggtcgcggctgagcgagcgagccctgggcgagtgaattgtggctgtgggttgacggtggagacaccccccggagggaggcggagggaagggaggcgaggcctgcacctgcatgcttcccgcctcccactccccagcgcccccggaccgtgcagttctctgcaggaccaggccatggagctcgaagtccggcgggtccgacaggcgttcctgtccggccggtcgcgacctctgcggtttcggctgcagcagctggaggccctgcggaggatggtgcaggagcgcgagaaggatatcctgacggccatcgccgccgacctgtgcaagagtgaattcaatgtgtacagtcaggaagtcattactgtccttggggaaattgattttatgcttgagaatcttcctgaatgggttactgctaaaccagttaagaagaacgtgctcaccatgctggatgaggcctatattcagccacagcctctgggagtggtgctgataatcggagcttggaattaccccttcgttctcaccattcagccactgataggagccatcgctgcaggaaatgctgtgattataaagccttctgaactgagtgaaaatacagccaagatcttggcaaagcttctccctcagtatttagaccaggatctctatattgttattaatggtggtgttgaggaaaccacggagctcctgaagcagcgatttgaccacattttctatacgggaaacactgcggttggcaaaattgtcatggaagctgctgccaagcatctgacccctgtgactcttgaactgggagggaaaagtccatgttatattgataaagattgtgacctggacattgtttgcagacgcataacctggggaaaatacatgaattgtggccaaacctgcattgcacccgactatattctctgtgaagcatccctccaaaatcaaattgtatggaagattaaggaaacagtgaaggaattttatggagaaaatataaaagagtctcctgattatgaaaggatcatcaatcttcgtcattttaagaggatactaagtttgcttgaaggacaaaagatagcttttggtggggagactgatgaggccacacgctacatagccccaacagtacttaccgatgttgatcctaaaaccaaggtgatgcaagaagaaatttttggaccaattcttccaatagtgcctgtgaaaaatgtagatgaggccataaatttcataaatgaacgtgaaaagcctctggctctttatgtattttcgcataaccataagctcatcaaacggatgattgatgagacatccagtggaggtgtcacaggcaatgacgtcattatgcacttcacgctcaactctttcccatttggaggagtgggttccagtgggatgggagcttatcacggaaaacatagttttgatactttttctcatcagcgtccctgtttattaaaaagtttaaagagagaaggtgctaacaaactcagatatcctcccaacagccagtcaaaggtggattggggaaaattttttctcttgaaacggttcaacaaagaaaaactcggtctcctgttgctcactttcctgggtattgtagccgctgtgcttgtcaaggcagaatattactgaagaatgatcctgttcaacctcctagtgcctctactgaattattcctcttttaaatggttaatgaaccaataatttttaaatcataccaaaaatagtaagaaaatatgcaaacactctgtgatcaaacttaaaagtcattgccattcatcattaataaaagttgccatttcaactacgtcccaacattccctaatagggtattcagggaacctgtcttaaattgtgcttatctaaatcttggaactttgagctaggggaggagaatgtattagactaaatacaaactgcggggttgtaagggagtctcagaacctcactgaatccttcactccagttaatggcactgctcacttcctgcctctgctgccaccatcactgtgtgaagctttcaagagcttggtacttcccagggctaccggcagtcctctgtagtccagagaggtgagattagatcttcttggttccctgtgaggtttcaggcactaaaactctatgtggggaagggaggggttactcctcctccaatgggactcaaggacttgacctccaggagtaggcccctggtcagaagtgccatctcaccagtggtcttcattcttcctcattcattctttatcatcctgtgttctgtttagttgcaacaatctcttgtgactaatgtcactcaaagcatcttgtaaatcctagggcttcctggaagttagttgccaaagtcatgcaagcatcacctgtcattcttgtgttggagttatagaattctacatcttataaaacctaactggcatttaaaaaatactgtggccgggcgtggtggctcatgcctgtaatcccagcactttgggaggccgaggtgggaggattgcttgagtccaggaatttgagaccagcctggacaacacagtgagacctcatctctatcaaaaaataaaaattagctagatgtggtggcatgagcctgtgttcccagctgcttaggaggctgaagcaggaggattgattgagcctgcgaggccaaggctgcagcaggctgtgattgcaccactgcacttcagcttgggcaacagagcaagaccctgtctccgaaacaaataaaaaatactgtaataaaagtacttataaacatactaatcctctttcaggaccctaaagttgcaggttagtaggtcttcaaggacaaatctgtaagtttcttatttctgtagtgcaagtaaaatttcactttttgaaactatagagagatccctttctgattagcctacagaacttaaagtgagggaaccatttcctctcacagacaaagaggcctgggatattaggactttggggtttgagagcatcatggggcagacagatggtggatggtctggacaagaagcgagtaagccactgcggttggtcatactgaagggaattgatggcaagaggatcccctgagcaagtcagaagttactctcatcagtcgttcatggtcacaacctgaggtactctgctgagtgggcaaggctgaagaagaggcctgtggaatgcagcattacctgctggacagagcagggcaggcagttctatgccttggagctcctgactgcagggactctgtccccacactcaaaaagactcagctcactcaatgagagaatgtgatttactttatagaacgtataatcaactttgttgaataatttgttctattaaggctgtctaaagtatgtgatgtcttcatcatagtatgaagtgttgaaaattaataacgagcctagtttaggaaaaagctgcttaaaactgtggctctaagagagtaatcataaaataccttagataaaattgcactatggaattttcattgagtatgtttaaattattggcttgtctactaatacacatctgcttcaaaatgaacatatttcataaaattggcatcaattttaatgacgctcctggtatggaacctcagatataccctattggagacaatcctttgatcataaattctccccaactataaatcattttatgtctttatcata

SEQ ID NO: 106337 - DNA, 3828 bp, Homo sapiens
  Payload ID: 884
  Gene Symbol: ALDH3A2
  Gene Name: aldehyde dehydrogenase 3 family, member A2
  Uniprot ID: P51648
  ENST ID: ENST00000339618
  CDS Start-End: 222-1748
agtcctcccccggcgcctccgactggcagtgggactcagcgggcgtggaggtcgcggctgagcgagcgagccctgggcgagtgaattgtggctgtgggttgacggtggagacaccccccggagggaggcggagggaagggaggcgaggcctgcacctgcatgcttcccgcctcccactccccagcgcccccggaccgtgcagttctctgcaggaccaggccatggagctcgaagtccggcgggtccgacaggcgttcctgtccggccggtcgcgacctctgcggtttcggctgcagcagctggaggccctgcggaggatggtgcaggagcgcgagaaggatatcctgacggccatcgccgccgacctgtgcaagagtgaattcaatgtgtacagtcaggaagtcattactgtccttggggaaattgattttatgcttgagaatcttcctgaatgggttactgctaaaccagttaagaagaacgtgctcaccatgctggatgaggcctatattcagccacagcctctgggagtggtgctgataatcggagcttggaattaccccttcgttctcaccattcagccactgataggagccatcgctgcaggaaatgctgtgattataaagccttctgaactgagtgaaaatacagccaagatcttggcaaagcttctccctcagtatttagaccaggatctctatattgttattaatggtggtgttgaggaaaccacggagctcctgaagcagcgatttgaccacattttctatacgggaaacactgcggttggcaaaattgtcatggaagctgctgccaagcatctgacccctgtgactcttgaactgggagggaaaagtccatgttatattgataaagattgtgacctggacattgtttgcagacgcataacctggggaaaatacatgaattgtggccaaacctgcattgcacccgactatattctctgtgaagcatccctccaaaatcaaattgtatggaagattaaggaaacagtgaaggaattttatggagaaaatataaaagagtctcctgattatgaaaggatcatcaatcttcgtcattttaagaggatactaagtttgcttgaaggacaaaagatagcttttggtggggagactgatgaggccacacgctacatagccccaacagtacttaccgatgttgatcctaaaaccaaggtgatgcaagaagaaatttttggaccaattcttccaatagtgcctgtgaaaaatgtagatgaggccataaatttcataaatgaacgtgaaaagcctctggctctttatgtattttcgcataaccataagctcatcaaacggatgattgatgagacatccagtggaggtgtcacaggcaatgacgtcattatgcacttcacgctcaactctttcccatttggaggagtgggttccagtgggatgggagcttatcacggaaaacatagttttgatactttttctcatcagcgtccctgtttattaaaaagtttaaagagagaaggtgctaacaaactcagatatcctcccaacagccagtcaaaggtggattggggaaaattttttctcttgaaacggttcaacaaagaaaaactcggtctcctgttgctcactttcctgggtattgtagccgctgtgcttgtcaagaaataccaagctgtgctgaggagaaaggccctgttgatttttctggtagttcacagactgcgttggtccagtaagcagagatgaacaccagatttcaaaacccagccctgtctgttaagagtgaggcagaatattactgaagaatgatcctgttcaacctcctagtgcctctactgaattattcctcttttaaatggttaatgaaccaataatttttaaatcataccaaaaatagtaagaaaatatgcaaacactctgtgatcaaacttaaaagtcattgccattcatcattaataaaagttgccatttcaactacgtcccaacattccctaatagggtattcagggaacctgtcttaaattgtgcttatctaaatcttggaactttgagctaggggaggagaatgtattagactaaatacaaactgcggggttgtaagggagtctcagaacctcactgaatccttcactccagttaatggcactgctcacttcctgcctctgctgccaccatcactgtgtgaagctttcaagagcttggtacttcccagggctaccggcagtcctctgtagtccagagaggtgagattagatcttcttggttccctgtgaggtttcaggcactaaaactctatgtggggaagggaggggttactcctcctccaatgggactcaaggacttgacctccaggagtaggcccctggtcagaagtgccatctcaccagtggtcttcattcttcctcattcattctttatcatcctgtgttctgtttagttgcaacaatctcttgtgactaatgtcactcaaagcatcttgtaaatcctagggcttcctggaagttagttgccaaagtcatgcaagcatcacctgtcattcttgtgttggagttatagaattctacatcttataaaacctaactggcatttaaaaaatactgtggccgggcgtggtggctcatgcctgtaatcccagcactttgggaggccgaggtgggaggattgcttgagtccaggaatttgagaccagcctggacaacacagtgagacctcatctctatcaaaaaataaaaattagctagatgtggtggcatgagcctgtgttcccagctgcttaggaggctgaagcaggaggattgattgagcctgcgaggccaaggctgcagcaggctgtgattgcaccactgcacttcagcttgggcaacagagcaagaccctgtctccgaaacaaataaaaaatactgtaataaaagtacttataaacatactaatcctctttcaggaccctaaagttgcaggttagtaggtcttcaaggacaaatctgtaagtttcttatttctgtagtgcaagtaaaatttcactttttgaaactatagagagatccctttctgattagcctacagaacttaaagtgagggaaccatttcctctcacagacaaagaggcctgggatattaggactttggggtttgagagcatcatggggcagacagatggtggatggtctggacaagaagcgagtaagccactgcggttggtcatactgaagggaattgatggcaagaggatcccctgagcaagtcagaagttactctcatcagtcgttcatggtcacaacctgaggtactctgctgagtgggcaaggctgaagaagaggcctgtggaatgcagcattacctgctggacagagcagggcaggcagttctatgccttggagctcctgactgcagggactctgtccccacactcaaaaagactcagctcactcaatgagagaatgtgatttactttatagaacgtataatcaactttgttgaataatttgttctattaaggctgtctaaagtatgtgatgtcttcatcatagtatgaagtgttgaaaattaataacgagcctagtttaggaaaaagctgcttaaaactgtggctctaagagagtaatcataaaataccttagataaaattgcactatggaattttcattgagtatgtttaaattattggcttgtctactaatacacatctgcttcaaaatgaacatatttcataaaattggcatcaattttaatgacgctcctggtatggaacctcagatataccctattggagacaatcctttgatcataaattctccccaactataaatcattttatgtctttatcata

SEQ ID NO: 106338 - DNA, 3640 bp, Homo sapiens
  Payload ID: 884
  Gene Symbol: ALDH3A2
  Gene Name: aldehyde dehydrogenase 3 family, member A2
  Uniprot ID: P51648
  ENST ID: ENST00000395575
  CDS Start-End: 159-1616
aataggggtgaggctttgggtcgagctcagtcctcccccggcgcctccgactggcagtgggactcagcgggcgtggaggtcgcggctgagcgagcgagccctgggcgagtgaattgtggctcgcccccggaccgtgcagttctctgcaggaccaggccatggagctcgaagtccggcgggtccgacaggcgttcctgtccggccggtcgcgacctctgcggtttcggctgcagcagctggaggccctgcggaggatggtgcaggagcgcgagaaggatatcctgacggccatcgccgccgacctgtgcaagagtgaattcaatgtgtacagtcaggaagtcattactgtccttggggaaattgattttatgcttgagaatcttcctgaatgggttactgctaaaccagttaagaagaacgtgctcaccatgctggatgaggcctatattcagccacagcctctgggagtggtgctgataatcggagcttggaattaccccttcgttctcaccattcagccactgataggagccatcgctgcaggaaatgctgtgattataaagccttctgaactgagtgaaaatacagccaagatcttggcaaagcttctccctcagtatttagaccaggatctctatattgttattaatggtggtgttgaggaaaccacggagctcctgaagcagcgatttgaccacattttctatacgggaaacactgcggttggcaaaattgtcatggaagctgctgccaagcatctgacccctgtgactcttgaactgggagggaaaagtccatgttatattgataaagattgtgacctggacattgtttgcagacgcataacctggggaaaatacatgaattgtggccaaacctgcattgcacccgactatattctctgtgaagcatccctccaaaatcaaattgtatggaagattaaggaaacagtgaaggaattttatggagaaaatataaaagagtctcctgattatgaaaggatcatcaatcttcgtcattttaagaggatactaagtttgcttgaaggacaaaagatagcttttggtggggagactgatgaggccacacgctacatagccccaacagtacttaccgatgttgatcctaaaaccaaggtgatgcaagaagaaatttttggaccaattcttccaatagtgcctgtgaaaaatgtagatgaggccataaatttcataaatgaacgtgaaaagcctctggctctttatgtattttcgcataaccataagctcatcaaacggatgattgatgagacatccagtggaggtgtcacaggcaatgacgtcattatgcacttcacgctcaactctttcccatttggaggagtgggttccagtgggatgggagcttatcacggaaaacatagttttgatactttttctcatcagcgtccctgtttattaaaaagtttaaagagagaaggtgctaacaaactcagatatcctcccaacagccagtcaaaggtggattggggaaaattttttctcttgaaacggttcaacaaagaaaaactcggtctcctgttgctcactttcctgggtattgtagccgctgtgcttgtcaaggcagaatattactgaagaatgatcctgttcaacctcctagtgcctctactgaattattcctcttttaaatggttaatgaaccaataatttttaaatcataccaaaaatagtaagaaaatatgcaaacactctgtgatcaaacttaaaagtcattgccattcatcattaataaaagttgccatttcaactacgtcccaacattccctaatagggtattcagggaacctgtcttaaattgtgcttatctaaatcttggaactttgagctaggggaggagaatgtattagactaaatacaaactgcggggttgtaagggagtctcagaacctcactgaatccttcactccagttaatggcactgctcacttcctgcctctgctgccaccatcactgtgtgaagctttcaagagcttggtacttcccagggctaccggcagtcctctgtagtccagagaggtgagattagatcttcttggttccctgtgaggtttcaggcactaaaactctatgtggggaagggaggggttactcctcctccaatgggactcaaggacttgacctccaggagtaggcccctggtcagaagtgccatctcaccagtggtcttcattcttcctcattcattctttatcatcctgtgttctgtttagttgcaacaatctcttgtgactaatgtcactcaaagcatcttgtaaatcctagggcttcctggaagttagttgccaaagtcatgcaagcatcacctgtcattcttgtgttggagttatagaattctacatcttataaaacctaactggcatttaaaaaatactgtggccgggcgtggtggctcatgcctgtaatcccagcactttgggaggccgaggtgggaggattgcttgagtccaggaatttgagaccagcctggacaacacagtgagacctcatctctatcaaaaaataaaaattagctagatgtggtggcatgagcctgtgttcccagctgcttaggaggctgaagcaggaggattgattgagcctgcgaggccaaggctgcagcaggctgtgattgcaccactgcacttcagcttgggcaacagagcaagaccctgtctccgaaacaaataaaaaatactgtaataaaagtacttataaacatactaatcctctttcaggaccctaaagttgcaggttagtaggtcttcaaggacaaatctgtaagtttcttatttctgtagtgcaagtaaaatttcactttttgaaactatagagagatccctttctgattagcctacagaacttaaagtgagggaaccatttcctctcacagacaaagaggcctgggatattaggactttggggtttgagagcatcatggggcagacagatggtggatggtctggacaagaagcgagtaagccactgcggttggtcatactgaagggaattgatggcaagaggatcccctgagcaagtcagaagttactctcatcagtcgttcatggtcacaacctgaggtactctgctgagtgggcaaggctgaagaagaggcctgtggaatgcagcattacctgctggacagagcagggcaggcagttctatgccttggagctcctgactgcagggactctgtccccacactcaaaaagactcagctcactcaatgagagaatgtgatttactttatagaacgtataatcaactttgttgaataatttgttctattaaggctgtctaaagtatgtgatgtcttcatcatagtatgaagtgttgaaaattaataacgagcctagtttaggaaaaagctgcttaaaactgtggctctaagagagtaatcataaaataccttagataaaattgcactatggaattttcattgagtatgtttaaattattggcttgtctactaatacacatctgcttcaaaatgaacatatttcataaaattggcatcaattttaatgacgctcctggtatggaacctcagatataccctattggagacaatcctttgatcataaattctccccaactataaatcattttatgtctttatcata

SEQ ID NO: 106339 - DNA, 665 bp, Homo sapiens
  Payload ID: 884
  Gene Symbol: ALDH3A2
  Gene Name: aldehyde dehydrogenase 3 family, member A2
  ENST ID: ENST00000446398
  CDS Start-End: 168-665
gagaagctctgagtaacggacgtgcgaggatgatgcttgtgcaagaaggaaatgaccgctgtcccggctccgcgggagacgaaccccggcttcccgccctcagggactagctctccagggaactgggacgcgcccccggaccgtgcagttctctgcaggaccaggccatggagctcgaagtccggcgggtccgacaggcgttcctgtccggccggtcgcgacctctgcggtttcggctgcagcagctggaggccctgcggaggatggtgcaggagcgcgagaaggatatcctgacggccatcgccgccgacctgtgcaagagtgaattcaatgtgtacagtcaggaagtcattactgtccttggggaaattgattttatgcttgagaatcttcctgaatgggttactgctaaaccagttaagaagaacgtgctcaccatgctggatgaggcctatattcagccacagcctctgggagtggtgctgataatcggagcttggaattaccccttcgttctcaccattcagccactgataggagccatcgctgcaggaaatgctgtgattataaagccttctgaactgagtgaaaatacagccaagatcttggcaaagcttctccctcagtatttagaccaggatctctatattgttattaatggtggt

SEQ ID NO: 106340 - DNA, 3710 bp, Homo sapiens
  Payload ID: 884
  Gene Symbol: ALDH3A2
  Gene Name: aldehyde dehydrogenase 3 family, member A2
  ENST ID: ENST00000472059
  CDS Start-End: 122-670
gacggtggagacaccccccggagggaggcggagggaagggaggcgaggcctgcacctgcatgcttcccgcctcccactccccagcgcccccggaccgtgcagttctctgcaggaccaggccatggagctcgaagtccggcgggtccgacaggcgttcctgtccggccggtcgcgacctctgcggtttcggctgcagcagctggaggccctgcggaggatggtgcaggagcgcgagaaggatatcctgacggccatcgccgccgacctgtgcaagagtgaattcaatgtgtacagtcaggaagtcattactgtccttggggaaattgattttatgcttgagaatcttcctgaatgggttactgctaaaccagttaagaagaacgtgctcaccatgctggatgaggcctatattcagccacagcctctgggagtggtgctgataatcggagcttggaattaccccttcgttctcaccattcagccactgataggagccatcgctgcaggaaatgctgtgattataaagccttctgaactgagtgaaaatacagccaagatcttggcaaagcttctccctcagtatttagaccagccattttgttctaatagctgtgatgatccaatcaagaaagatgaaatggaagacagtgagatgtcaaggattgaataggacgtagaaccagaagatagaggttgaaggatctctatattgttattaatggtggtgttgaggaaaccacggagctcctgaagcagcgatttgaccacattttctatacgggaaacactgcggttggcaaaattgtcatggaagctgctgccaagcatctgacccctgtgactcttgaactgggagggaaaagtccatgttatattgataaagattgtgacctggacattgtttgcagacgcataacctggggaaaatacatgaattgtggccaaacctgcattgcacccgactatattctctgtgaagcatccctccaaaatcaaattgtatggaagattaaggaaacagtgaaggaattttatggagaaaatataaaagagtctcctgattatgaaaggatcatcaatcttcgtcattttaagaggatactaagtttgcttgaaggacaaaagatagcttttggtggggagactgatgaggccacacgctacatagccccaacagtacttaccgatgttgatcctaaaaccaaggtgatgcaagaagaaatttttggaccaattcttccaatagtgcctgtgaaaaatgtagatgaggccataaatttcataaatgaacgtgaaaagcctctggctctttatgtattttcgcataaccataagctcatcaaacggatgattgatgagacatccagtggaggtgtcacaggcaatgacgtcattatgcacttcacgctcaactctttcccatttggaggagtgggttccagtgggatgggagcttatcacggaaaacatagttttgatactttttctcatcagcgtccctgtttattaaaaagtttaaagagagaaggtgctaacaaactcagatatcctcccaacagccagtcaaaggtggattggggaaaattttttctcttgaaacggttcaacaaagaaaaactcggtctcctgttgctcactttcctgggtattgtagccgctgtgcttgtcaaggcagaatattactgaagaatgatcctgttcaacctcctagtgcctctactgaattattcctcttttaaatggttaatgaaccaataatttttaaatcataccaaaaatagtaagaaaatatgcaaacactctgtgatcaaacttaaaagtcattgccattcatcattaataaaagttgccatttcaactacgtcccaacattccctaatagggtattcagggaacctgtcttaaattgtgcttatctaaatcttggaactttgagctaggggaggagaatgtattagactaaatacaaactgcggggttgtaagggagtctcagaacctcactgaatccttcactccagttaatggcactgctcacttcctgcctctgctgccaccatcactgtgtgaagctttcaagagcttggtacttcccagggctaccggcagtcctctgtagtccagagaggtgagattagatcttcttggttccctgtgaggtttcaggcactaaaactctatgtggggaagggaggggttactcctcctccaatgggactcaaggacttgacctccaggagtaggcccctggtcagaagtgccatctcaccagtggtcttcattcttcctcattcattctttatcatcctgtgttctgtttagttgcaacaatctcttgtgactaatgtcactcaaagcatcttgtaaatcctagggcttcctggaagttagttgccaaagtcatgcaagcatcacctgtcattcttgtgttggagttatagaattctacatcttataaaacctaactggcatttaaaaaatactgtggccgggcgtggtggctcatgcctgtaatcccagcactttgggaggccgaggtgggaggattgcttgagtccaggaatttgagaccagcctggacaacacagtgagacctcatctctatcaaaaaataaaaattagctagatgtggtggcatgagcctgtgttcccagctgcttaggaggctgaagcaggaggattgattgagcctgcgaggccaaggctgcagcaggctgtgattgcaccactgcacttcagcttgggcaacagagcaagaccctgtctccgaaacaaataaaaaatactgtaataaaagtacttataaacatactaatcctctttcaggaccctaaagttgcaggttagtaggtcttcaaggacaaatctgtaagtttcttatttctgtagtgcaagtaaaatttcactttttgaaactatagagagatccctttctgattagcctacagaacttaaagtgagggaaccatttcctctcacagacaaagaggcctgggatattaggactttggggtttgagagcatcatggggcagacagatggtggatggtctggacaagaagcgagtaagccactgcggttggtcatactgaagggaattgatggcaagaggatcccctgagcaagtcagaagttactctcatcagtcgttcatggtcacaacctgaggtactctgctgagtgggcaaggctgaagaagaggcctgtggaatgcagcattacctgctggacagagcagggcaggcagttctatgccttggagctcctgactgcagggactctgtccccacactcaaaaagactcagctcactcaatgagagaatgtgatttactttatagaacgtataatcaactttgttgaataatttgttctattaaggctgtctaaagtatgtgatgtcttcatcatagtatgaagtgttgaaaattaataacgagcctagtttaggaaaaagctgcttaaaactgtggctctaagagagtaatcataaaataccttagataaaattgcactatggaattttcattgagtatgtttaaattattggcttgtctactaatacacatctgcttcaaaatgaacatatttcataaaattggcatcaattttaatgacgctcctggtatggaacctcagatataccctattggagacaatcctttgatcataaattctccccaactataaatcattttatgtctttatcata

SEQ ID NO: 106341 - DNA, 607 bp, Homo sapiens
  Payload ID: 884
  Gene Symbol: ALDH3A2
  Gene Name: aldehyde dehydrogenase 3 family, member A2
  ENST ID: ENST00000571537
  CDS Start-End: 1-489
accacggagctcctgaagcagcgatttgaccacattttctatacgggaaacactgcggttggcaaaattgtcatggaagctgctgccaagcatctgacccctgtgactcttgaactgggagggaaaagtccatgttatattgataaagattgtgacctggacattgtttgcagacgcataacctggggaaaatacatgaattgtggccaaacctgcattgcacccgactatattctctgtgaagcatccctccaaaatcaaattgtatggaagattaaggaaacagtgaaggaattttatggagaaaatataaaagagtctcctgattatgaaaggatcatcaatcttcgtcattttaagaggatactaagtttgcttgaaggacaaaagatagcttttggtggggagactgatgaggccacacgctacataggtaatggaaattctccttttcctatgggaagatggcaatttggcagtttttgctgacactacttattaacactagataaactattaaatatatagcatttaattgttaaagtactaaatcctgctttctggtatactgtacctgtagcttttgttataaactatttaaaatgtc

SEQ ID NO: 106342 - DNA, 590 bp, Homo sapiens
  Payload ID: 884
  Gene Symbol: ALDH3A2
  Gene Name: aldehyde dehydrogenase 3 family, member A2
  ENST ID: ENST00000571163
  CDS Start-End: 1-294
atgcaagaagaaatttttggaccaattcttccaatagtgcctgtgaaaaatgtagatgaggccataaatttcataaatgaacgtgaaaagcctctggctctttatgtattttcgcataaccataagctcatcaaacggatgattgatgagacatccagtggaggtgtcacaggcaatgacgtcattatgcacttcacgctcaactctttcccatttggaggagtgggcagaatattactgaagaatgatcctgttcaacctcctagtgcctctactgaattattcctcttttaaatggttaatgaaccaataatttttaaatcataccaaaaatagtaagaaaatatgcaaacactctgtgatcaaacttaaaagtcattgccattcatcattaataaaagttgccatttcaactacgtcccaacattccctaatagggtattcagggaacctgtcttaaattgtgcttatctaaatcttggaactttgagctaggggaggagaatgtattagactaaatacaaactgcggggttgtaagggagtctcagaacctcactgaatccttcactccagttaatggcactgctc

SEQ ID NO: 106343 - DNA, 450 bp, Homo sapiens
  Payload ID: 884
  Gene Symbol: ALDH3A2
  Gene Name: aldehyde dehydrogenase 3 family, member A2
  ENST ID: ENST00000575384
  CDS Start-End: 1-258
ttttctcatcagcgtccctgtttattaaaaagtttaaagagagaaggtgctaacaaactcagatatcctcccaacagccagtcaaaggtggattggggaaaattttttctcttgaaacggttcaacaaagaaaaactcggtctcctgttgctcactttcctgggtattgtagccgctgtgcttgtcaagttcacagactgcgttggtccagtaagcagagatgaacaccagatttcaaaacccagccctgtctgttaagagtgaggctgaatattactgaagaatgatcctgttcaacctcctagtgcctctactgaattattcctcttttaaatggttaatgaaccaataatttttaaatcataccaaaaatagtaagaaaatatgcaaacactctgtgatcaaacttaaaagtcattgccattcatcattaataaaagttgccatttc

SEQ ID NO: 106344 - DNA, 2785 bp, Homo sapiens
  Payload ID: 884
  Gene Symbol: ALDH3A2
  Gene Name: aldehyde dehydrogenase 3 family, member A2
  Uniprot ID: P51648
  ENST ID: ENST00000581518
  CDS Start-End: 250-1776
aataggggtgaggctttgggtcgagctcagtcctcccccggcgcctccgactggcagtgggactcagcgggcgtggaggtcgcggctgagcgagcgagccctgggcgagtgaattgtggctgtgggttgacggtggagacaccccccggagggaggcggagggaagggaggcgaggcctgcacctgcatgcttcccgcctcccactccccagcgcccccggaccgtgcagttctctgcaggaccaggccatggagctcgaagtccggcgggtccgacaggcgttcctgtccggccggtcgcgacctctgcggtttcggctgcagcagctggaggccctgcggaggatggtgcaggagcgcgagaaggatatcctgacggccatcgccgccgacctgtgcaagagtgaattcaatgtgtacagtcaggaagtcattactgtccttggggaaattgattttatgcttgagaatcttcctgaatgggttactgctaaaccagttaagaagaacgtgctcaccatgctggatgaggcctatattcagccacagcctctgggagtggtgctgataatcggagcttggaattaccccttcgttctcaccattcagccactgataggagccatcgctgcaggaaatgctgtgattataaagccttctgaactgagtgaaaatacagccaagatcttggcaaagcttctccctcagtatttagaccaggatctctatattgttattaatggtggtgttgaggaaaccacggagctcctgaagcagcgatttgaccacattttctatacgggaaacactgcggttggcaaaattgtcatggaagctgctgccaagcatctgacccctgtgactcttgaactgggagggaaaagtccatgttatattgataaagattgtgacctggacattgtttgcagacgcataacctggggaaaatacatgaattgtggccaaacctgcattgcacccgactatattctctgtgaagcatccctccaaaatcaaattgtatggaagattaaggaaacagtgaaggaattttatggagaaaatataaaagagtctcctgattatgaaaggatcatcaatcttcgtcattttaagaggatactaagtttgcttgaaggacaaaagatagcttttggtggggagactgatgaggccacacgctacatagccccaacagtacttaccgatgttgatcctaaaaccaaggtgatgcaagaagaaatttttggaccaattcttccaatagtgcctgtgaaaaatgtagatgaggccataaatttcataaatgaacgtgaaaagcctctggctctttatgtattttcgcataaccataagctcatcaaacggatgattgatgagacatccagtggaggtgtcacaggcaatgacgtcattatgcacttcacgctcaactctttcccatttggaggagtgggttccagtgggatgggagcttatcacggaaaacatagttttgatactttttctcatcagcgtccctgtttattaaaaagtttaaagagagaaggtgctaacaaactcagatatcctcccaacagccagtcaaaggtggattggggaaaattttttctcttgaaacggttcaacaaagaaaaactcggtctcctgttgctcactttcctgggtattgtagccgctgtgcttgtcaagaaataccaagctgtgctgaggagaaaggccctgttgatttttctggtagttcacagactgcgttggtccagtaagcagagatgaacaccagatttcaaaacccagccctgtctgttaagagtgaggctgaatattactgaagaatgatcctgttcaacctcctagtgcctctactgaattattcctcttttaaatggttaatgaaccaataatttttaaatcataccaaaaatagtaagaaaatatgcaaacactctgtgatcaaacttaaaagtcattgccattcatcattaataaaagttgccatttcaactacgtcccaacattccctaatagggtattcagggaacctgtcttaaattgtgcttatctaaatcttggaactttgagctaggggaggagaatgtattagactaaatacaaactgcggggttgtaagggagtctcagaacctcactgaatccttcactccagttaatggcactgctcacttcctgcctctgctgccaccatcactgtgtgaagctttcaagagcttggtacttcccagggctaccggcagtcctctgtagtccagagaggtgagattagatcttcttggttccctgtgaggtttcaggcactaaaactctatgtggggaagggaggggttactcctcctccaatgggactcaaggacttgacctccaggagtaggcccctggtcagaagtgccatctcaccagtggtcttcattcttcctcattcattctttatcatcctgtgttctgtttagttgcaacaatctcttgtgactaatgtcactcaaagcatcttgtaaatcctagggcttcctggaagttagttgccaaagtcatgcaagcatcacctgtcattcttgtgttggagttatagaattctacatcttataaaacctaactggcatttaaaaaatactgtggccgggcgtggtggctcatgcctgtaatcccagcactttgggaggccgaggtgggaggattgcttgagtccaggaatttgagaccagcctggacaacacagtgagacctcatctctatcaaaaaataaaaattagctagatgtggtggcatga

SEQ ID NO: 106345 - DNA, 572 bp, Homo sapiens
  Payload ID: 884
  Gene Symbol: ALDH3A2
  Gene Name: aldehyde dehydrogenase 3 family, member A2
  ENST ID: ENST00000573947
  CDS Start-End: 1-189
atttttggaccaattcttccaatagtgcctgtgaaaaatgtagatgaggccataaatttcataaatgaacgtgaaaagcctctggctctttatgtattttcgcataaccataaggttccagtgggatgggagcttatcacggaaaacatagttttgatactttttctcatcagcgtccctgtttattaaaaagtttaaagagagaaggtgctaacaaactcagatatcctcccaacagccagtcaaaggtggattggggaaaattttttctcttgaaacggttcaacaaagaaaaactcggtctcctgttgctcactttcctgggtattgtagccgctgtgcttgtcaaggcagaatattactgaagaatgatcctgttcaacctcctagtgcctctactgaattattcctcttttaaatggttaatgaaccaataatttttaaatcataccaaaaatagtaagaaaatatgcaaacactctgtgatcaaacttaaaagtcattgccattcatcattaataaaagttgccatttcaactacgtcccaacattccctaatagggtattcaggg

SEQ ID NO: 106346 - DNA, 540 bp, Homo sapiens
  Payload ID: 884
  Gene Symbol: ALDH3A2
  Gene Name: aldehyde dehydrogenase 3 family, member A2
  ENST ID: ENST00000580550
  CDS Start-End: 102-540
gtgcaagaaggaaatgaccgctgtcccggctccgcgggagacgaaccccggcttcccgccctcagggactagctctccagggaactgggacggaccaggccatggagctcgaagtccggcgggtccgacaggcgttcctgtccggccggtcgcgacctctgcggtttcggctgcagcagctggaggccctgcggaggatggtgcaggagcgcgagaaggatatcctgacggccatcgccgccgacctgtgcaagagtgaattcaatgtgtacagtcaggaagtcattactgtccttggggaaattgattttatgcttgagaatcttcctgaatgggttactgctaaaccagttaagaagaacgtgctcaccatgctggatgaggcctatattcagccacagcctctgggagtggtgctgataatcggagcttggaattaccccttcgttctcaccattcagccactgataggagccatcgctgcaggaaatgctgtgattataaagccttctgaactgagtgaaaatacagccaagatct

SEQ ID NO: 106347 - DNA, 527 bp, Homo sapiens
  Payload ID: 884
  Gene Symbol: ALDH3A2
  Gene Name: aldehyde dehydrogenase 3 family, member A2
  ENST ID: ENST00000578614
  CDS Start-End: 195-359
agtgggactcagcgggcgtggaggtcgcggctgagcgagcgagccctgggcgagtgaattgtggctgtgggttgacggtggagacaccccccggagggaggcggagggaagggaggcgaggcctgcacctgcatgcttcccgcctcccactccccagcgcccccggaccgtgcagttctctgcaggaccaggccatggagctcgaagtccggcgggtccgacaggcgttcctgtccggccggtcgcgacctctgcggtttcggctgcagcagctggaggccctgcggaggatggtgcaggagcgcgagaaggatatcctgacggccatcgccgccgacctgtgcaaggaaatgctgtgattataaagccttctgaactgagtgaaaatacagccaagatcttggcaaagcttctccctcagtatttagaccaggatctctatattgttattaatggtggtgttgaggaaaccacggagctcctgaagcagcgatttgaccacattttctatacgggaaacactgcgg

SEQ ID NO: 106348 - DNA, 3583 bp, Homo sapiens
  Payload ID: 884
  Gene Symbol: ALDH3A2
  Gene Name: aldehyde dehydrogenase 3 family, member A2
  Uniprot ID: P51648
  ENST ID: ENST00000579855
  CDS Start-End: 100-1557
agtcctcccccggcgcctccgactggcagtgggactcagcgggcgtggaggtcgcggctgagcgagcgagccctgggcgattctctgcaggaccaggccatggagctcgaagtccggcgggtccgacaggcgttcctgtccggccggtcgcgacctctgcggtttcggctgcagcagctggaggccctgcggaggatggtgcaggagcgcgagaaggatatcctgacggccatcgccgccgacctgtgcaagagtgaattcaatgtgtacagtcaggaagtcattactgtccttggggaaattgattttatgcttgagaatcttcctgaatgggttactgctaaaccagttaagaagaacgtgctcaccatgctggatgaggcctatattcagccacagcctctgggagtggtgctgataatcggagcttggaattaccccttcgttctcaccattcagccactgataggagccatcgctgcaggaaatgctgtgattataaagccttctgaactgagtgaaaatacagccaagatcttggcaaagcttctccctcagtatttagaccaggatctctatattgttattaatggtggtgttgaggaaaccacggagctcctgaagcagcgatttgaccacattttctatacgggaaacactgcggttggcaaaattgtcatggaagctgctgccaagcatctgacccctgtgactcttgaactgggagggaaaagtccatgttatattgataaagattgtgacctggacattgtttgcagacgcataacctggggaaaatacatgaattgtggccaaacctgcattgcacccgactatattctctgtgaagcatccctccaaaatcaaattgtatggaagattaaggaaacagtgaaggaattttatggagaaaatataaaagagtctcctgattatgaaaggatcatcaatcttcgtcattttaagaggatactaagtttgcttgaaggacaaaagatagcttttggtggggagactgatgaggccacacgctacatagccccaacagtacttaccgatgttgatcctaaaaccaaggtgatgcaagaagaaatttttggaccaattcttccaatagtgcctgtgaaaaatgtagatgaggccataaatttcataaatgaacgtgaaaagcctctggctctttatgtattttcgcataaccataagctcatcaaacggatgattgatgagacatccagtggaggtgtcacaggcaatgacgtcattatgcacttcacgctcaactctttcccatttggaggagtgggttccagtgggatgggagcttatcacggaaaacatagttttgatactttttctcatcagcgtccctgtttattaaaaagtttaaagagagaaggtgctaacaaactcagatatcctcccaacagccagtcaaaggtggattggggaaaattttttctcttgaaacggttcaacaaagaaaaactcggtctcctgttgctcactttcctgggtattgtagccgctgtgcttgtcaaggcagaatattactgaagaatgatcctgttcaacctcctagtgcctctactgaattattcctcttttaaatggttaatgaaccaataatttttaaatcataccaaaaatagtaagaaaatatgcaaacactctgtgatcaaacttaaaagtcattgccattcatcattaataaaagttgccatttcaactacgtcccaacattccctaatagggtattcagggaacctgtcttaaattgtgcttatctaaatcttggaactttgagctaggggaggagaatgtattagactaaatacaaactgcggggttgtaagggagtctcagaacctcactgaatccttcactccagttaatggcactgctcacttcctgcctctgctgccaccatcactgtgtgaagctttcaagagcttggtacttcccagggctaccggcagtcctctgtagtccagagaggtgagattagatcttcttggttccctgtgaggtttcaggcactaaaactctatgtggggaagggaggggttactcctcctccaatgggactcaaggacttgacctccaggagtaggcccctggtcagaagtgccatctcaccagtggtcttcattcttcctcattcattctttatcatcctgtgttctgtttagttgcaacaatctcttgtgactaatgtcactcaaagcatcttgtaaatcctagggcttcctggaagttagttgccaaagtcatgcaagcatcacctgtcattcttgtgttggagttatagaattctacatcttataaaacctaactggcatttaaaaaatactgtggccgggcgtggtggctcatgcctgtaatcccagcactttgggaggccgaggtgggaggattgcttgagtccaggaatttgagaccagcctggacaacacagtgagacctcatctctatcaaaaaataaaaattagctagatgtggtggcatgagcctgtgttcccagctgcttaggaggctgaagcaggaggattgattgagcctgcgaggccaaggctgcagcaggctgtgattgcaccactgcacttcagcttgggcaacagagcaagaccctgtctccgaaacaaataaaaaatactgtaataaaagtacttataaacatactaatcctctttcaggaccctaaagttgcaggttagtaggtcttcaaggacaaatctgtaagtttcttatttctgtagtgcaagtaaaatttcactttttgaaactatagagagatccctttctgattagcctacagaacttaaagtgagggaaccatttcctctcacagacaaagaggcctgggatattaggactttggggtttgagagcatcatggggcagacagatggtggatggtctggacaagaagcgagtaagccactgcggttggtcatactgaagggaattgatggcaagaggatcccctgagcaagtcagaagttactctcatcagtcgttcatggtcacaacctgaggtactctgctgagtgggcaaggctgaagaagaggcctgtggaatgcagcattacctgctggacagagcagggcaggcagttctatgccttggagctcctgactgcagggactctgtccccacactcaaaaagactcagctcactcaatgagagaatgtgatttactttatagaacgtataatcaactttgttgaataatttgttctattaaggctgtctaaagtatgtgatgtcttcatcatagtatgaagtgttgaaaattaataacgagcctagtttaggaaaaagctgcttaaaactgtggctctaagagagtaatcataaaataccttagataaaattgcactatggaattttcattgagtatgtttaaattattggcttgtctactaatacacatctgcttcaaaatgaacatatttcataaaattggcatcaattttaatgacgctcctggtatggaacctcagatataccctattggagacaatcctttgatcataaattctccccaactataaatcattttatgtctttatcataga

SEQ ID NO: 106349 - DNA, 577 bp, Homo sapiens
  Payload ID: 884
  Gene Symbol: ALDH3A2
  Gene Name: aldehyde dehydrogenase 3 family, member A2
  ENST ID: ENST00000573565
  CDS Start-End: 1-176
gtttaaagagagaaggtgctaacaaactcagatatcctcccaacagccagtcaaaggtggattggggaaaattttttctcttgaaacggttcaacaaagaaaaactcggtctcctgttgctcactttcctgggtattgtagccgctgtgcttgtcaagactgcgttggtccagtaagcagagatgaacaccagatttcaaaacccagccctgtctgttaagagtgaggcagaatattactgaagaatgatcctgttcaacctcctagtgcctctactgaattattcctcttttaaatggttaatgaaccaataatttttaaatcataccaaaaatagtaagaaaatatgcaaacactctgtgatcaaacttaaaagtcattgccattcatcattaataaaagttgccatttcaactacgtcccaacattccctaatagggtattcagggaacctgtcttaaattgtgcttatctaaatcttggaactttgagctaggggaggagaatgtattagactaaatacaaactgcggggttgtaagggagtctcagaacctcactgaatccttcactccagt

SEQ ID NO: 106350 - DNA, 2152 bp, Homo sapiens
  Payload ID: 884
  Gene Symbol: ALDH3A2
  Gene Name: aldehyde dehydrogenase 3 family, member A2
  ENST ID: ENST00000582991
  CDS Start-End: 250-1431
aataggggtgaggctttgggtcgagctcagtcctcccccggcgcctccgactggcagtgggactcagcgggcgtggaggtcgcggctgagcgagcgagccctgggcgagtgaattgtggctgtgggttgacggtggagacaccccccggagggaggcggagggaagggaggcgaggcctgcacctgcatgcttcccgcctcccactccccagcgcccccggaccgtgcagttctctgcaggaccaggccatggagctcgaagtccggcgggtccgacaggcgttcctgtccggccggtcgcgacctctgcggtttcggctgcagcagctggaggccctgcggaggatggtgcaggagcgcgagaaggatatcctgacggccatcgccgccgacctgtgcaagagtgaattcaatgtgtacagtcaggaagtcattactgtccttggggaaattgattttatgcttgagaatcttcctgaatgggttactgctaaaccagttaagaagaacgtgctcaccatgctggatgaggcctatattcagccacagcctctgggagtggtgctgataatcggagcttggaattaccccttcgttctcaccattcagccactgataggagccatcgctgcaggaaatgctgtgattataaagccttctgaactgagtgaaaatacagccaagatcttggcaaagcttctccctcagtatttagaccaggatctctatattgttattaatggtggtgttgaggaaaccacggagctcctgaagcagcgatttgaccacattttctatacgggaaacactgcggttggcaaaattgtcatggaagctgctgccaagcatctgacccctgtgactcttgaactgggagggaaaagtccatgttatattgataaagattgtgacctggacattgtttgcagacgcataacctggggaaaatacatgaattgtggccaaacctgcattgcacccgactatattctctgtgaagcatccctccaaaatcaaattgtatggaagattaaggaaacagtgaaggaattttatggagaaaatataaaagagtctcctgattatgaaaggatcatcaatcttcgtcattttaagaggatactaagtttgcttgaaggacaaaagatagcttttggtggggagactgatgaggccacacgctacatagccccaacagtacttaccgatgttgatcctaaaaccaaggtgatgcaagaagaaatttttggaccaattcttccaatagtgcctgtgaaaaatgtagatgaggccataaatttcataaatgaacgtgaaaagcctctggctctttatgtattttcgcataaccataaggttccagtgggatgggagcttatcacggaaaacatagttttgatactttttctcatcagcgtccctgtttattaaaaagtttaaagagagaaggtgctaacaaactcagatatcctcccaacagccagtcaaaggtggattggggaaaattttttctcttgaaacggttcaacaaagaaaaactcggtctcctgttgctcactttcctgggtattgtagccgctgtgcttgtcaaggctgaatattactgaagaatgatcctgttcaacctcctagtgcctctactgaattattcctcttttaaatggttaatgaaccaataatttttaaatcataccaaaaatagtaagaaaatatgcaaacactctgtgatcaaacttaaaagtcattgccattcatcattaataaaagttgccatttcaactacgtcccaacattccctaatagggtattcagggaacctgtcttaaattgtgcttatctaaatcttggaactttgagctaggggaggagaatgtattagactaaatacaaactgcggggttgtaagggagtctcagaacctcactgaatccttcactccagttaatggcactgctcacttcctgcctctgctgccaccatcactgtgtgaagctttcaagagcttggtacttcccagggctaccggcagtcctctgtagtccagagaggtgagattagatcttcttggttccctgtgaggtttcaggcactaaaactctatgtggggaagggaggggttactcctcctccaatgggactcaaggacttgacc

SEQ ID NO: 106351 - DNA, 400 bp, Homo sapiens
  Payload ID: 884
  Gene Symbol: ALDH3A2
  Gene Name: aldehyde dehydrogenase 3 family, member A2
  ENST ID: ENST00000578696
  CDS Start-End: 1-400
caagcatctgacccctgtgactcttgaactgggagggaaaagtccatgttatattgataaagattgtgacctggacattgtttgcagctgttctggatgttttcccctcagacgcataacctggggaaaatacatgaattgtggccaaacctgcattgcacccgactatattctctgtgaagcatccctccaaaatcaaattgtatggaagattaaggaaacagtgaaggaattttatggagaaaatataaaagagtctcctgattatgaaaggatcatcaatcttcgtcattttaagaggatactaagtttgcttgaaggacaaaagatagcttttggtggggagactgatgaggccacacgctacatagccccaacagtacttaccgatgttgatcct

SEQ ID NO: 106352 - DNA, 573 bp, Homo sapiens
  Payload ID: 884
  Gene Symbol: ALDH3A2
  Gene Name: aldehyde dehydrogenase 3 family, member A2
  ENST ID: ENST00000584332
  CDS Start-End: 194-573
agtcctcccccggcgcctccgactggcagtgggactcagcgggcgtggaggtcgcggctgagcgagcgagccctgggcgagtgaattgtggctgtgggttgacggtggagacaccccccggagggaggcgttcctgtccggccggtcgcgacctctgcggtttcggctgcagcagctggaggccctgcggaggatggtgcaggagcgcgagaaggatatcctgacggccatcgccgccgacctgtgcaagagtgaattcaatgtgtacagtcaggaagtcattactgtccttggggaaattgattttatgcttgagaatcttcctgaatgggttactgctaaaccagttaagaagaacgtgctcaccatgctggatgaggcctatattcagccacagcctctgggagtggtgctgataatcggagcttggaattaccccttcgttctcaccattcagccactgataggagccatcgctgcaggaaatgctgtgattataaagccttctgaactgagtgaaaatacagccaagatcttggcaaagcttctccctcagtatttagaccaggatct

SEQ ID NO: 106353 - DNA, 3822 bp, Homo sapiens
  Payload ID: 884
  Gene Symbol: ALDH3A2
  Gene Name: aldehyde dehydrogenase 3 family, member A2
  ENST ID: ENST00000631291
  CDS Start-End: 447-1628
ccggggcgctctcagcaggatggccaacaccttccctccatccctacaccccgccgccccctggcccgtggccgcgctcggctcccgcactgctcactccaccccctacatcccagcccgctgccagagccggggagagggcgggggccgcgtgggcgaggccgtgaacagcggctgtcacgtgggccgcccaggccaataggggtgaggctttgggtcgagctcagtcctcccccggcgcctccgactggcagtgggactcagcgggcgtggaggtcgcggctgagcgagcgagccctgggcgagtgaattgtggctgtgggttgacggtggagacaccccccggagggaggcggagggaagggaggcgaggcctgcacctgcatgcttcccgcctcccactccccagcgcccccggaccgtgcagttctctgcaggaccaggccatggagctcgaagtccggcgggtccgacaggcgttcctgtccggccggtcgcgacctctgcggtttcggctgcagcagctggaggccctgcggaggatggtgcaggagcgcgagaaggatatcctgacggccatcgccgccgacctgtgcaagagtgaattcaatgtgtacagtcaggaagtcattactgtccttggggaaattgattttatgcttgagaatcttcctgaatgggttactgctaaaccagttaagaagaacgtgctcaccatgctggatgaggcctatattcagccacagcctctgggagtggtgctgataatcggagcttggaattaccccttcgttctcaccattcagccactgataggagccatcgctgcaggaaatgctgtgattataaagccttctgaactgagtgaaaatacagccaagatcttggcaaagcttctccctcagtatttagaccaggatctctatattgttattaatggtggtgttgaggaaaccacggagctcctgaagcagcgatttgaccacattttctatacgggaaacactgcggttggcaaaattgtcatggaagctgctgccaagcatctgacccctgtgactcttgaactgggagggaaaagtccatgttatattgataaagattgtgacctggacattgtttgcagacgcataacctggggaaaatacatgaattgtggccaaacctgcattgcacccgactatattctctgtgaagcatccctccaaaatcaaattgtatggaagattaaggaaacagtgaaggaattttatggagaaaatataaaagagtctcctgattatgaaaggatcatcaatcttcgtcattttaagaggatactaagtttgcttgaaggacaaaagatagcttttggtggggagactgatgaggccacacgctacatagccccaacagtacttaccgatgttgatcctaaaaccaaggtgatgcaagaagaaatttttggaccaattcttccaatagtgcctgtgaaaaatgtagatgaggccataaatttcataaatgaacgtgaaaagcctctggctctttatgtattttcgcataaccataaggttccagtgggatgggagcttatcacggaaaacatagttttgatactttttctcatcagcgtccctgtttattaaaaagtttaaagagagaaggtgctaacaaactcagatatcctcccaacagccagtcaaaggtggattggggaaaattttttctcttgaaacggttcaacaaagaaaaactcggtctcctgttgctcactttcctgggtattgtagccgctgtgcttgtcaaggcagaatattactgaagaatgatcctgttcaacctcctagtgcctctactgaattattcctcttttaaatggttaatgaaccaataatttttaaatcataccaaaaatagtaagaaaatatgcaaacactctgtgatcaaacttaaaagtcattgccattcatcattaataaaagttgccatttcaactacgtcccaacattccctaatagggtattcagggaacctgtcttaaattgtgcttatctaaatcttggaactttgagctaggggaggagaatgtattagactaaatacaaactgcggggttgtaagggagtctcagaacctcactgaatccttcactccagttaatggcactgctcacttcctgcctctgctgccaccatcactgtgtgaagctttcaagagcttggtacttcccagggctaccggcagtcctctgtagtccagagaggtgagattagatcttcttggttccctgtgaggtttcaggcactaaaactctatgtggggaagggaggggttactcctcctccaatgggactcaaggacttgacctccaggagtaggcccctggtcagaagtgccatctcaccagtggtcttcattcttcctcattcattctttatcatcctgtgttctgtttagttgcaacaatctcttgtgactaatgtcactcaaagcatcttgtaaatcctagggcttcctggaagttagttgccaaagtcatgcaagcatcacctgtcattcttgtgttggagttatagaattctacatcttataaaacctaactggcatttaaaaaatactgtggccgggcgtggtggctcatgcctgtaatcccagcactttgggaggccgaggtgggaggattgcttgagtccaggaatttgagaccagcctggacaacacagtgagacctcatctctatcaaaaaataaaaattagctagatgtggtggcatgagcctgtgttcccagctgcttaggaggctgaagcaggaggattgattgagcctgcgaggccaaggctgcagcaggctgtgattgcaccactgcacttcagcttgggcaacagagcaagaccctgtctccgaaacaaataaaaaatactgtaataaaagtacttataaacatactaatcctctttcaggaccctaaagttgcaggttagtaggtcttcaaggacaaatctgtaagtttcttatttctgtagtgcaagtaaaatttcactttttgaaactatagagagatccctttctgattagcctacagaacttaaagtgagggaaccatttcctctcacagacaaagaggcctgggatattaggactttggggtttgagagcatcatggggcagacagatggtggatggtctggacaagaagcgagtaagccactgcggttggtcatactgaagggaattgatggcaagaggatcccctgagcaagtcagaagttactctcatcagtcgttcatggtcacaacctgaggtactctgctgagtgggcaaggctgaagaagaggcctgtggaatgcagcattacctgctggacagagcagggcaggcagttctatgccttggagctcctgactgcagggactctgtccccacactcaaaaagactcagctcactcaatgagagaatgtgatttactttatagaacgtataatcaactttgttgaataatttgttctattaaggctgtctaaagtatgtgatgtcttcatcatagtatgaagtgttgaaaattaataacgagcctagtttaggaaaaagctgcttaaaactgtggctctaagagagtaatcataaaataccttagataaaattgcactatggaattttcattgagtatgtttaaattattggcttgtctactaatacacatctgcttcaaaatgaacatatttcataaaattggcatcaattttaatgacgctcctggtatggaacctcagatataccctattggagacaatcctttgatcataaattctccccaactataaatcattttatgtcttt

SEQ ID NO: 106354 - DNA, 995 bp, Homo sapiens
  Payload ID: 884
  Gene Symbol: ALDH3A2
  Gene Name: aldehyde dehydrogenase 3 family, member A2
  ENST ID: ENST00000626500
  CDS Start-End: 447-995
ccggggcgctctcagcaggatggccaacaccttccctccatccctacaccccgccgccccctggcccgtggccgcgctcggctcccgcactgctcactccaccccctacatcccagcccgctgccagagccggggagagggcgggggccgcgtgggcgaggccgtgaacagcggctgtcacgtgggccgcccaggccaataggggtgaggctttgggtcgagctcagtcctcccccggcgcctccgactggcagtgggactcagcgggcgtggaggtcgcggctgagcgagcgagccctgggcgagtgaattgtggctgtgggttgacggtggagacaccccccggagggaggcggagggaagggaggcgaggcctgcacctgcatgcttcccgcctcccactccccagcgcccccggaccgtgcagttctctgcaggaccaggccatggagctcgaagtccggcgggtccgacaggcgttcctgtccggccggtcgcgacctctgcggtttcggctgcagcagctggaggccctgcggaggatggtgcaggagcgcgagaaggatatcctgacggccatcgccgccgacctgtgcaagagtgaattcaatgtgtacagtcaggaagtcattactgtccttggggaaattgattttatgcttgagaatcttcctgaatgggttactgctaaaccagttaagaagaacgtgctcaccatgctggatgaggcctatattcagccacagcctctgggagtggtgctgataatcggagcttggaattaccccttcgttctcaccattcagccactgataggagccatcgctgcaggaaatgctgtgattataaagccttctgaactgagtgaaaatacagccaagatcttggcaaagcttctccctcagtatttagaccagccattttgttctaatagctgtgatgatccaatcaagaaagatgaaatggaagacagtgagatgtcaaggattgaatag

SEQ ID NO: 106355 - DNA, 1558 bp, Homo sapiens
  Payload ID: 884
  Gene Symbol: ALDH3A2
  Gene Name: aldehyde dehydrogenase 3 family, member A2
  ENST ID: ENST00000630662
  CDS Start-End: 1148-1441
ggctgagcgagcgagccctgggcgagtgaattgtggctgtgggttgacggtggagacaccccccggagggaggcggagggaagggaggcgaggcctgcacctgcatgcttcccgcctcccactccccagcgcccccggaccgtgcagttctctgcaggaccaggccatggagctcgaagtccggcgggtccgacaggcgttcctgtccggccggtcgcgacctctgcggtttcggctgcagcagctggaggccctgcggaggatggtgcaggagcgcgagaaggatatcctgacggccatcgccgccgacctgtgcaagagtgaattcaatgtgtacagtcaggaagtcattactgtccttggggaaattgattttatgcttgagaatcttcctgaatgggttactgctaaaccagttaagaagaacgtgctcaccatgctggatgaggcctatattcagccacagcctctgggagtggtgctgataatcggagcttggaattaccccttcgttctcaccattcagccactgataggagccatcgctgcaggaaatgctgtgattataaagccttctgaactgagtgaaaatacagccaagatcttggcaaagcttctccctcagtatttagaccaggatctctatattgttattaatggtggtgttgaggaaaccacggagctcctgaagcagcgatttgaccacattttctatacgggaaacactgcggttggcaaaattgtcatggaagctgctgccaagcatctgacccctgtgactcttgaactgggagggaaaagtccatgttatattgataaagattgtgacctggacattgtttgcagacgcataacctggggaaaatacatgaattgtggccaaacctgcattgcacccgactatattctctgtgaagcatccctccaaaatcaaattgtatggaagattaaggaaacagtgaaggaattttatggagaaaatataaaagagtctcctgattatgaaaggatcatcaatcttcgtcattttaagaggatactaagtttgcttgaaggacaaaagatagcttttggtggggagactgatgaggccacacgctacatagccccaacagtacttaccgatgttgatcctaaaaccaaggtgatgcaagaagaaatttttggaccaattcttccaatagtgcctgtgaaaaatgtagatgaggccataaatttcataaatgaacgtgaaaagcctctggctctttatgtattttcgcataaccataagctcatcaaacggatgattgatgagacatccagtggaggtgtcacaggcaatgacgtcattatgcacttcacgctcaactctttcccatttggaggagtgggcagaatattactgaagaatgatcctgttcaacctcctagtgcctctactgaattattcctcttttaaatggttaatgaaccaataatttttaaatcataccaaaaatagtaagaaaatatgcaaacactctgtgatcaaacttaaaagtcattgccattcatcattaataaaagttgccatttc

SEQ ID NO: 106356 - DNA, 2786 bp, Homo sapiens
  Payload ID: 885
  Gene Symbol: ALDH3B1
  Gene Name: aldehyde dehydrogenase 3 family, member B1
  Uniprot ID: P43353
  ENST ID: ENST00000342456
  CDS Start-End: 43-1449
gcgggacagccaggaggaagggcagcttggcagagcctcaggatggacccccttggggacacgctgcggcgactgcgggaggccttccacgcggggcgcacgcggccagctgagttccgggctgcgcagctccaaggcctgggccgcttcctgcaagaaaacaagcagcttctgcacgacgcactggcccaggacctgcacaagtcagccttcgagtcggaggtgtctgaggttgccatcagccagggcgaggtcaccctggccctcaggaacctccgggcctggatgaaggacgagcgtgtgcccaagaacctggccacgcagctggactccgccttcatccggaaggagccctttggcctggtcctcatcattgcgccctggaactatccgctgaacctgacgctggtgcccctcgtgggagccctcgctgcagggaactgtgtggtgctgaagccatcggagattagcaagaacgtcgagaagatcctggccgaggtgctgccccaatacgtggaccagagctgctttgctgtggtgctgggcgggccccaggagacggggcagctgctagagcacaggttcgactacatcttcttcacagggagccctcgtgtgggcaagattgttatgactgctgccgccaagcacctgacacctgtcaccctggagctggggggcaagaacccttgctacgtggacgacaactgcgacccccagaccgtggccaaccgcgtggcctggttccgctacttcaacgccggccagacctgcgtggcccccgactacgtcctatgcagccctgagatgcaggagaggctgctgcctgccctgcagagcaccatcacccgtttctatggcgacgacccccagagctccccaaacctgggccgcatcatcaaccagaaacagttccagcggctgcgggcattgctgggctgcggccgtgtggccattgggggccagagcgatgagagcgatcgctacatcgcccccacggtgctggtggatgtgcaggagatggagcctgtgatgcaggaggagatcttcgggcccatcctgcccatcgtgaacgtgcagagcttggacgaggccatcgagttcatcaaccggcgggagaagcccctggccctgtacgccttctccaacagcagccaggtggtcaagcgggtgctgacccagaccagcagcgggggcttctgtgggaacgacggcttcatgcacatgaccctggccagcctgccttttggaggagtgggtgccagtgggatgggccggtaccatggcaagttctccttcgacaccttctcccaccatcgcgcctgcctcctgcgcagcccggggatggagaagctcaacgccctccgctacccgccgcaatcgccgcgccgcctgaggatgctgctggtggccatggaggcccaaggctgcagctgcacactgctctgagcccttccccaggcccaggctgtagaccaccatgacagctgtcgcctgcggctggtggagacggggcctgggctcccgggcccgaggaggaaaaggattgccaaggctccagggcacccctcaaagcagcgcctgcctcctccctcctgggtcttccctctccctgcctcagcctcctccctcagccgctcccaaccatgagagccgaggtgggaggcatgggaaacagtgcagtgactcaccccctgcccccgcaccaaccacccatattcaggagaagaggacagacacggcacctctgagtcacccctctcctgtggagcgggcgtccgaggggccctggcatctgactcaggccacaccatggaatcactgcatccaaggccattcctgccctctctgagtctcagtttttccatttgttcagtggagagaattaaccattgatacctcctggctgggtgaggcggctcacacctgtaatcccagcactttgggaggccgaggcaggcggatcacctgaaatcaggagttcaagatcagcctggctaacatggcgaaaccccgtctctactaaaaatacaaaaattagcctggcgtggtggcgcatgcctgtaatcccagctactcaggaggctaaggcaggagaatcgcttgaacccgggaggtggaggttgccgtgagctgagattgcgtcactgaactccggcctgggtgacagaaggaggctctgccttaaaaaaaaaaaaaaaaaaaacctcctgggactgttgcaaggatgaaatgaaggattgagggattgagggattgctgagctggagctccaggtgtcctatctttctcagtggggtggcacggagcggggccgcctccctcttctctccaggcaggtggggctgtggttatgcgatagggtctcccttccctccagcccatgccagaggagcttgtaactctttatcctcatggtgcccactacgagtcatactcttccccatgctgctcatcctcctgggccccatccactcagccaaagcagaatgcagggtttcctgcctgacaacccttctcacctcccaagtcccacttttgaacaagctgatgattctgaaactggcccaatttcctaacaagccggatgcttgagaaacctacatttggacaatgagaggctgctcctgcggcctgcgggccacctcctcttccttggctcctgctttctttttagactatatcaacctacaactttagtcgggaagagggacaggggtggacctgagtttcgtctcctgtctctctggctgatgtcacctgaataaagccttcttccctggcaa

SEQ ID NO: 106357 - DNA, 818 bp, Homo sapiens
  Payload ID: 885
  Gene Symbol: ALDH3B1
  Gene Name: aldehyde dehydrogenase 3 family, member B1
  ENST ID: ENST00000616697
  CDS Start-End: 1-201
ctggccctcaggaacctccgggcctggatgaaggacgagcgtgtgcccaagaacctggccacgcagctggactccgccttcatccggaaggagccctttggcctggtcctcatcattgcgccctggaactatccgctgaacctgacgctggtgcccctcgtgggagccctcgctgcaggttctgcatctgaaagtgggtgaggctgatgcctgccctgcaggtgtgtggagaccaggagctggctacgcctcctccagctctctccctgcactgccctgcagggaactgtgtggtgctgaagccatcggagattagcaagaacgtcgagaagatcctggccgaggtgctgccccaatacgtggaccagagctgctttgctgtggtgctgggcgggccccaggagacggggcagctgctagagcacaggttcgactacatcttcttcacagggagccctcgtgtgggcaagattgttatgactgctgccgccaagcacctgacacctgtcaccctggagctggggggcaagaacccttgctacgtggacgacaactgcgacccccagaccgtggccaaccgcgtggcctggttccgctacttcaacgccggccagacctgcgtggcccccgactacgtcctatgcagccctgagatgcaggagaggctgctgcctgccctgcagagcaccatcacccgtttctatggcgacgacccccagagctccccaaacctgggccgcatcatcaaccagaaacagttccagcggctgcgggcattgctgggctgcggccgtgtggccattgggggccagagcgat

SEQ ID NO: 106358 - DNA, 603 bp, Homo sapiens
  Payload ID: 885
  Gene Symbol: ALDH3B1
  Gene Name: aldehyde dehydrogenase 3 family, member B1
  ENST ID: ENST00000527514
  CDS Start-End: 1-216
cagagcgatgagagcgatcgctacatcgcccccacggtgctggtggatgtgcaggagatggagcctgtgatgcaggaggagatcttcgggcccatcctgcccatcgtgaacgtgcagagcttggacgaggccatcgagttcatcaaccggcgggagaagcccctggccctgtacgccttctccaacagcagccaggagagaatcccacagaggtgagcctgcctctcacaccacatctggggcacctgagatgcacacgtggctagtgagtggaaccttcactaccgggtcaggacggtatctgccagggtttccctgggaagctactattgtttgtttctttattatttggaagcaagtctctaagcctaccccaccctcaccaggtggaggtaattaagctgtatgctgctctatcatattgttagttattatctagttattttatacattcttttcttattccatttgtggtttggtggaattttgttgtattgccatttgatacctttctcttcctcctttgtatgattgttttatagggcctgtgagttttgtacttttgtgtgtattatggcaaataccaacttgtttttatgttaa

SEQ ID NO: 106359 - DNA, 2280 bp, Homo sapiens
  Payload ID: 885
  Gene Symbol: ALDH3B1
  Gene Name: aldehyde dehydrogenase 3 family, member B1
  Uniprot ID: P43353
  ENST ID: ENST00000614849
  CDS Start-End: 117-1523
ggggctccatcccacacagaggacaggggctctgcagtccttcacccccaccctaactatctaatcacgggccaccggtgtgggcatggtccagaagacctcaccgccctcccaggatggacccccttggggacacgctgcggcgactgcgggaggccttccacgcggggcgcacgcggccagctgagttccgggctgcgcagctccaaggcctgggccgcttcctgcaagaaaacaagcagcttctgcacgacgcactggcccaggacctgcacaagtcagccttcgagtcggaggtgtctgaggttgccatcagccagggcgaggtcaccctggccctcaggaacctccgggcctggatgaaggacgagcgtgtgcccaagaacctggccacgcagctggactccgccttcatccggaaggagccctttggcctggtcctcatcattgcgccctggaactatccgctgaacctgacgctggtgcccctcgtgggagccctcgctgcagggaactgtgtggtgctgaagccatcggagattagcaagaacgtcgagaagatcctggccgaggtgctgccccaatacgtggaccagagctgctttgctgtggtgctgggcgggccccaggagacggggcagctgctagagcacaggttcgactacatcttcttcacagggagccctcgtgtgggcaagattgttatgactgctgccgccaagcacctgacacctgtcaccctggagctggggggcaagaacccttgctacgtggacgacaactgcgacccccagaccgtggccaaccgcgtggcctggttccgctacttcaacgccggccagacctgcgtggcccccgactacgtcctatgcagccctgagatgcaggagaggctgctgcctgccctgcagagcaccatcacccgtttctatggcgacgacccccagagctccccaaacctgggccgcatcatcaaccagaaacagttccagcggctgcgggcattgctgggctgcggccgtgtggccattgggggccagagcgatgagagcgatcgctacatcgcccccacggtgctggtggatgtgcaggagatggagcctgtgatgcaggaggagatcttcgggcccatcctgcccatcgtgaacgtgcagagcttggacgaggccatcgagttcatcaaccggcgggagaagcccctggccctgtacgccttctccaacagcagccaggtggtcaagcgggtgctgacccagaccagcagcgggggcttctgtgggaacgacggcttcatgcacatgaccctggccagcctgccttttggaggagtgggtgccagtgggatgggccggtaccatggcaagttctccttcgacaccttctcccaccatcgcgcctgcctcctgcgcagcccggggatggagaagctcaacgccctccgctacccgccgcaatcgccgcgccgcctgaggatgctgctggtggccatggaggcccaaggctgcagctgcacactgctctgagcccttccccaggcccaggctgtagaccaccatgacagctgtcgcctgcggctggtggagacggggcctgggctcccgggcccgaggaggaaaaggattgccaaggctccagggcacccctcaaagcagcgcctgcctcctccctcctgggtcttccctctccctgcctcagcctcctccctcagccgctcccaaccatgagagccgaggtgggaggcatgggaaacagtgcagtgactcaccccctgcccccgcaccaaccacccatattcaggagaagaggacagacacggcacctctgagtcacccctctcctgtggagcgggcgtccgaggggccctggcatctgactcaggccacaccatggaatcactgcatccaaggccattcctgccctctctgagtctcagtttttccatttgttcagtggagagaattaaccattgatacctcctggctgggtgaggcggctcacacctgtaatcccagcactttgggaggccgaggcaggcggatcacctgaaatcaggagttcaagatcagcctggctaacatggcgaaaccccgtctctactaaaaatacaaaaattagcctggcgtggtggcgcatgcctgtaatcccagctactcaggaggctaaggcaggagaatcgcttgaacccgggaggtggaggttgccgtgagctgagattgcgtcactgaactccggcctgggtgacagaaggaggctctgccttaaaaaaaaaaaaaaaaaaaa

SEQ ID NO: 106360 - DNA, 1594 bp, Homo sapiens
  Payload ID: 885
  Gene Symbol: ALDH3B1
  Gene Name: aldehyde dehydrogenase 3 family, member B1
  ENST ID: ENST00000619675
  CDS Start-End: 52-561
ccaggcagagcgggacagccaggaggaagggcagcttggcagagcctcaggatggacccccttggggacacgctgcggcgactgcgggaggccttccacgcggggcgcacgcggccagctgagttccgggctgcgcagctccaaggcctgggccgcttcctgcaagaaaacaagcagcttctgcacgacgcactggcccaggacctgcacaagtcagccttcgagtcggaggtgtctgaggttgccatcagccagggcgaggtcaccctggccctcaggaacctccgggcctggatgaaggacgagcgtgtgcccaagaacctggccacgcagctggactccgccttcatccggaaggagccctttggcctggtcctcatcattgcgccctggaactatccgctgaacctgacgctggtgcccctcgtgggagccctcgctgcagggaactgtgtggtgctgaagccatcggagattagcaagaacgtcgagaagatcctggccgaggtgctgccccaatacgtggaccagggagccctcgtgtgggcaagattgttatgactgctgccgccaagcacctgacacctgtcaccctggagctggggggcaagaacccttgctacgtggacgacaactgcgacccccagaccgtggccaaccgcgtggcctggttccgctacttcaacgccggccagacctgcgtggcccccgactacgtcctatgcagccctgagatgcaggagaggctgctgcctgccctgcagagcaccatcacccgtttctatggcgacgacccccagagctccccaaacctgggccgcatcatcaaccagaaacagttccagcggctgcgggcattgctgggctgcggccgtgtggccattgggggccagagcgatgagagcgatcgctacatcgcccccacggtgctggtggatgtgcaggagatggagcctgtgatgcaggaggagatcttcgggcccatcctgcccatcgtgaacgtgcagagcttggacgaggccatcgagttcatcaaccggcgggagaagcccctggccctgtacgccttctccaacagcagccaggtggtcaagcgggtgctgacccagaccagcagcgggggcttctgtgggaacgacggcttcatgcacatgaccctggccagcctgccttttggaggagtgggtgccagtgggatgggccggtaccatggcaagttctccttcgacaccttctcccaccatcgcgcctgcctcctgcgcagcccggggatggagaagctcaacgccctccgctacccgccgcaatcgccgcgccgcctgaggatgctgctggtggccatggaggcccaaggctgcagctgcacactgctctgagcccttccccaggcccaggctgtagaccaccatgacagctgtcgcctgcggctggtggagacggggcctgggctcccgggcccgaggaggaaaaggattgccaaggctccagggcacccctcaaagcagcgcctgcctcctccctcctgggtcttccctctccctgcctcagcctcctccctcagccgctcccaaccatgagagccgaggtgggaggc

SEQ ID NO: 106361 - DNA, 1300 bp, Homo sapiens
  Payload ID: 885
  Gene Symbol: ALDH3B1
  Gene Name: aldehyde dehydrogenase 3 family, member B1
  ENST ID: ENST00000615463
  CDS Start-End: 72-764
atttcttaacagcagggccaccaggcagagcgggacagccaggaggaagggcagcttggcagagcctcaggatggacccccttggggacacgctgcggcgactgcgggaggccttccacgcggggcgcacgcggccagctgagttccgggctgcgcagctccaaggcctgggccgcttcctgcaagaaaacaagcagcttctgcacgacgcactggcccaggacctgcacaagtcagccttcgagtcggaggtgtctgaggttgccatcagccagggcgaggtcaccctggccctcaggaacctccgggcctggatgaaggacgagcgtgtgcccaagaacctggccacgcagctggactccgccttcatccggaaggagccctttggcctggtcctcatcattgcgccctggaactatccgctgaacctgacgctggtgcccctcgtgggagccctcgctgcagggaactgtgtggtgctgaagccatcggagattagcaagaacgtcgagaagatcctggccgaggtgctgccccaatacgtggaccagagctgctttgctgtggtgctgggcgggccccaggagacggggcagctgctagagcacaggttcgactacatcttcttcacagggagccctcgtgtgggcaagattgttatgactgctgccgccaagcacccctcaaagcagcgcctgcctcctccctcctgggtcttccctctccctgcctcagcctcctccctcagccgctcccaaccatgagagccgaggtgggaggcatgggaaacagtgcagtgactcaccccctgcccccgcaccaaccacccatattcaggagaagaggacagacacggcacctctgagtcacccctctcctgtggagcgggcgtccgaggggccctggcatctgactcaggccacaccatggaatcactgcatccaaggccattcctgccctctctgagtctcagtttttccatttgttcagtggagagaattaaccattgatacctcctggctgggtgaggcggctcacacctgtaatcccagcactttgggaggccgaggcaggcggatcacctgaaatcaggagttcaagatcagcctggctaacatggcgaaaccccgtctctactaaaaatacaaaaattagcctggcgtggtggcgcatgcctgtaatcccagctactcaggaggctaaggcaggagaatcgcttgaacccgggaggtggaggttgccgtgagctgagattgcgtcactgaactccggcctgggtgacagaaggaggctctgcctt

SEQ ID NO: 106362 - DNA, 2078 bp, Homo sapiens
  Payload ID: 885
  Gene Symbol: ALDH3B1
  Gene Name: aldehyde dehydrogenase 3 family, member B1
  Uniprot ID: P43353
  ENST ID: ENST00000617288
  CDS Start-End: 28-1323
ggaagggcagcttggcagagcctcaggatggacccccttggggacacgctgcggcgactgcgggaggccttccacgcggggcgcacgcggccagctgagttccgggctgcgcagctccaaggcctgggccgcttcctgcaagaaaacaagcagcttctgcacgacgcactggcccaggacctgcacaaggccacgcagctggactccgccttcatccggaaggagccctttggcctggtcctcatcattgcgccctggaactatccgctgaacctgacgctggtgcccctcgtgggagccctcgctgcagggaactgtgtggtgctgaagccatcggagattagcaagaacgtcgagaagatcctggccgaggtgctgccccaatacgtggaccagagctgctttgctgtggtgctgggcgggccccaggagacggggcagctgctagagcacaggttcgactacatcttcttcacagggagccctcgtgtgggcaagattgttatgactgctgccgccaagcacctgacacctgtcaccctggagctggggggcaagaacccttgctacgtggacgacaactgcgacccccagaccgtggccaaccgcgtggcctggttccgctacttcaacgccggccagacctgcgtggcccccgactacgtcctatgcagccctgagatgcaggagaggctgctgcctgccctgcagagcaccatcacccgtttctatggcgacgacccccagagctccccaaacctgggccgcatcatcaaccagaaacagttccagcggctgcgggcattgctgggctgcggccgtgtggccattgggggccagagcgatgagagcgatcgctacatcgcccccacggtgctggtggatgtgcaggagatggagcctgtgatgcaggaggagatcttcgggcccatcctgcccatcgtgaacgtgcagagcttggacgaggccatcgagttcatcaaccggcgggagaagcccctggccctgtacgccttctccaacagcagccaggtggtcaagcgggtgctgacccagaccagcagcgggggcttctgtgggaacgacggcttcatgcacatgaccctggccagcctgccttttggaggagtgggtgccagtgggatgggccggtaccatggcaagttctccttcgacaccttctcccaccatcgcgcctgcctcctgcgcagcccggggatggagaagctcaacgccctccgctacccgccgcaatcgccgcgccgcctgaggatgctgctggtggccatggaggcccaaggctgcagctgcacactgctctgagcccttccccaggcccaggctgtagaccaccatgacagctgtcgcctgcggctggtggagacggggcctgggctcccgggcccgaggaggaaaaggattgccaaggctccagggcacccctcaaagcagcgcctgcctcctccctcctgggtcttccctctccctgcctcagcctcctccctcagccgctcccaaccatgagagccgaggtgggaggcatgggaaacagtgcagtgactcaccccctgcccccgcaccaaccacccatattcaggagaagaggacagacacggcacctctgagtcacccctctcctgtggagcgggcgtccgaggggccctggcatctgactcaggccacaccatggaatcactgcatccaaggccattcctgccctctctgagtctcagtttttccatttgttcagtggagagaattaaccattgatacctcctggctgggtgaggcggctcacacctgtaatcccagcactttgggaggccgaggcaggcggatcacctgaaatcaggagttcaagatcagcctggctaacatggcgaaaccccgtctctactaaaaatacaaaaattagcctggcgtggtggcgcatgcctgtaatcccagctactcaggaggctaaggcaggagaatcgcttgaacccgggaggtggaggttgccgtgagctgagattgcgtcactgaactccggcctgggtgacagaaggaggctctgccttaaaaaaaaaaaaaaaaaa

SEQ ID NO: 106363 - DNA, 709 bp, Homo sapiens
  Payload ID: 885
  Gene Symbol: ALDH3B1
  Gene Name: aldehyde dehydrogenase 3 family, member B1
  ENST ID: ENST00000617449
  CDS Start-End: 77-709
cctgctcaccctcgggggctgtggtggagcagctgtccccaagcccacacccagtcctgcagccgcctccaggtccatggcagaggggagtggtgcgagggtcttcatgatggacccccttggggacacgctgcggcgactgcgggaggccttccacgcggggcgcacgcggccagctgagttccgggctgcgcagctccaaggcctgggccgcttcctgcaagaaaacaagcagcttctgcacgacgcactggcccaggacctgcacaagtcagccttcgagtcggaggtgtctgaggttgccatcagccagggcgaggtcaccctggccctcaggaacctccgggcctggatgaaggacgagcgtgtgcccaagaacctggccacgcagctggactccgccttcatccggaaggagccctttggcctggtcctcatcattgcgccctggaactatccgctgaacctgacgctggtgcccctcgtgggagccctcgctgcagggaactgtgtggtgctgaagccatcggagattagcaagaacgtcgagaagatcctggccgaggtgctgccccaatacgtggaccagagctgctttgctgtggtgctgggcgggccccaggagacggggcagctgctagagcacaggttcgactacatcttcttcacagggagccctcgtgtgggcaagattgttatgactgctgcc

SEQ ID NO: 106364 - DNA, 1231 bp, Homo sapiens
  Payload ID: 885
  Gene Symbol: ALDH3B1
  Gene Name: aldehyde dehydrogenase 3 family, member B1
  ENST ID: ENST00000612297
  CDS Start-End: 5-1060
caggatggacccccttggggacacgctgcggcgactgcgggaggccttccacgcggggcgcacgcggccagctgagttccgggctgcgcagctccaaggcctgggccgcttcctgcaagaaaacaagcagcttctgcacgacgcactggcccaggacctgcacaagtcagccttcgagtcggaggtgtctgaggttgccatcagccagggcgaggtcaccctggccctcaggaacctccgggcctggatgaaggacgagcgtgtgcccaagaacctggccacgcagctggactccgccttcatccggaaggagccctttggcctggtcctcatcattgcgccctggaactatccgctgaacctgacgctggtgcccctcgtgggagccctcgctgcagggaactgtgtggtgctgaagccatcggagattagcaagaacgtcgagaagatcctggccgaggtgctgccccaatacgtggaccagagctccccaaacctgggccgcatcatcaaccagaaacagttccagcggctgcgggcattgctgggctgcggccgtgtggccattgggggccagagcgatgagagcgatcgctacatcgcccccacggtgctggtggatgtgcaggagatggagcctgtgatgcaggaggagatcttcgggcccatcctgcccatcgtgaacgtgcagagcttggacgaggccatcgagttcatcaaccggcgggagaagcccctggccctgtacgccttctccaacagcagccaggtggtcaagcgggtgctgacccagaccagcagcgggggcttctgtgggaacgacggcttcatgcacatgaccctggccagcctgccttttggaggagtgggtgccagtgggatgggccggtaccatggcaagttctccttcgacaccttctcccaccatcgcgcctgcctcctgcgcagcccggggatggagaagctcaacgccctccgctacccgccgcaatcgccgcgccgcctgaggatgctgctggtggccatggaggcccaaggctgcagctgcacactgctctgagcccttccccaggcccaggctgtagaccaccatgacagctgtcgcctgcggctggtggagacggggcctgggctcccgggcccgaggaggaaaaggattgccaaggctccagggcacccctcaaagcagcgcctgcctcctccctcctgggtcttccctctccctgcctca

SEQ ID NO: 106365 - DNA, 2649 bp, Homo sapiens
  Payload ID: 886
  Gene Symbol: ALDH3B2
  Gene Name: aldehyde dehydrogenase 3 family, member B2
  Uniprot ID: P48448
  ENST ID: ENST00000349015
  CDS Start-End: 440-1597
accccattgattaccccattgccaggcgtgggcacgggagttggtttgggagctgccagtctcctgggaggatcgcagtcagcagagcagggctgaggcctgggggtaggagcagagcctgcgcatctggaggcagcatgtccaagaaagggagtggaggtgcagcgaaggacccaggggcagagcccacgctgggatggaccccttcgaggacacgctgcggcggctgcgtgaggccttcaactgagggcgcacgcggccggccgagttccgggctgcgcagctccagggcctgggccacttccttcaagaaaacaagcagcttctgcgcgacgtgctggcccaggacctgcataagccagctttcgaggcagacatatctgagctcatcctttgccagaacgaggttgactacgctctcaagaacctgcaggcctggatgaaggatgaaccacggtccacgaacctgttcatgaagctggactcggtcttcatctggaaggaaccctttggcctggtcctcatcatcgcaccctggaactacccactgaacctgaccctggtgctcctggtgggcgccctcgccgcagggagttgcgtggtgctgaagccgtcagaaatcagccagggcacagagaaggtcctggctgaggtgctgccccagtacctggaccagagctgctttgccgtggtgctgggcggaccccaggagacagggcagctgctagagcacaagttggactacatcttcttcacagggagccctcgtgtgggcaagattgtcatgactgctgccaccaagcacctgacgcctgtcaccctggagctggggggcaagaacccctgctacgtggacgacaactgcgacccccagaccgtggccaaccgcgtggcctggttctgctacttcaatgccggccagacctgcgtggcccctgactacgtcctgtgcagccccgagatgcaggagaggctgctgcccgccctgcagagcaccatcacccgtttctatggcgacgacccccagagctccccaaacctgggccacatcatcaaccagaaacagttccagcggctgcgggcattgctgggctgcagccgcgtggccattgggggccagagcaacgagagcgatcgctacatcgcccccacggtgctggtggacgtgcaggagacggagcctgtgatgcaggaggagatcttcgggcccatcctgcccatcgtgaacgtgcagagcgtggacgaggccatcaagttcatcaaccggcaggagaagcccctggccctgtacgccttctccaacagcagccaggttgtgaaccagatgctggagcggaccagcagcggcagctttggaggcaatgagggcttcacctacatatctctgctgtccgtgccattcgggggagtcggccacagtgggatgggccggtaccacggcaagttcaccttcgacaccttctcccaccaccgcacctgcctgctcgccccctccggcctggagaaattaaaggagatccactacccaccctataccgactggaaccagcagctgttacgctggggcatgggctcccagagctgcaccctcctgtgagcgtcccacccgcctccaacgggtcacacagagaaacctgagtctagccatgaggggcttatgctcccaactcacattgttcctccagaccgcaggttcccccagcctcaggttgctggagctgtcacatgactgcatcctgcctgccagggctgcaaagcaaggtcttgcttctatctgggggacgctgctcgagagaggccaagaggccgcagaacatgccaggtgtcctcactcaccccaccctccccaattccagccctttgccctctcggtcagggttggccagacccagtcacaggggcagtgtcaccctggaaaatacagtgccctgccttcttaggggcatcagccctgaacggttgagagcgtggagccctccaggcctttgctctcccctctaggcacacgcgcacttccatctctgccccatcccaactgcaccagcactgcctcccccagggatcctctcacatcccacactggtctctgcaccacccctctggttcacaccgcaccctgcactcacccacagcagctccatccactgggaaaactggggtttgcatcactccactgcacagtgttagtgggacctgggggcaagtcccttgacttctctgagcctcagtttccttatgtgaaagttgctggaaccaaaatggagtcacttatgccaaactctaataaaatggagtcggggggccacatagaagccctcacacacacatgcccgtaacaggatttatcacaagacacgcctgcatgtagaccagacacagggcgtatggaaagcacgtcctcaagactgtagtattccagatgagctgcagatgcttacctaccacggccgtctccaccagaaaaccatcgccaactcctgcgatcagcttgtgacttacaaaccttgtttaaaagctgcttacatggacttctgtcctttaaaagcttccccttggctgtggccctctgtgtatgcctgggatccttccaagcactcatagcccagataggaatcctctgctcctcccaaataaattcatctgttctgg

SEQ ID NO: 106366 - DNA, 2480 bp, Homo sapiens
  Payload ID: 886
  Gene Symbol: ALDH3B2
  Gene Name: aldehyde dehydrogenase 3 family, member B2
  Uniprot ID: P48448
  ENST ID: ENST00000530069
  CDS Start-End: 270-1427
ggttgcttccccttccaccataactgatggaccccttcgaggacacgctgcggcggctgcgtgaggccttcaactgagggcgcacgcggccggccgagttccgggctgcgcagctccagggcctgggccacttccttcaagaaaacaagcagcttctgcgcgacgtgctggcccaggacctgcataagccagctttcgaggcagacatatctgagctcatcctttgccagaacgaggttgactacgctctcaagaacctgcaggcctggatgaaggatgaaccacggtccacgaacctgttcatgaagctggactcggtcttcatctggaaggaaccctttggcctggtcctcatcatcgcaccctggaactacccactgaacctgaccctggtgctcctggtgggcgccctcgccgcagggagttgcgtggtgctgaagccgtcagaaatcagccagggcacagagaaggtcctggctgaggtgctgccccagtacctggaccagagctgctttgccgtggtgctgggcggaccccaggagacagggcagctgctagagcacaagttggactacatcttcttcacagggagccctcgtgtgggcaagattgtcatgactgctgccaccaagcacctgacgcctgtcaccctggagctggggggcaagaacccctgctacgtggacgacaactgcgacccccagaccgtggccaaccgcgtggcctggttctgctacttcaatgccggccagacctgcgtggcccctgactacgtcctgtgcagccccgagatgcaggagaggctgctgcccgccctgcagagcaccatcacccgtttctatggcgacgacccccagagctccccaaacctgggccacatcatcaaccagaaacagttccagcggctgcgggcattgctgggctgcagccgcgtggccattgggggccagagcaacgagagcgatcgctacatcgcccccacggtgctggtggacgtgcaggagacggagcctgtgatgcaggaggagatcttcgggcccatcctgcccatcgtgaacgtgcagagcgtggacgaggccatcaagttcatcaaccggcaggagaagcccctggccctgtacgccttctccaacagcagccaggttgtgaaccagatgctggagcggaccagcagcggcagctttggaggcaatgagggcttcacctacatatctctgctgtccgtgccattcgggggagtcggccacagtgggatgggccggtaccacggcaagttcaccttcgacaccttctcccaccaccgcacctgcctgctcgccccctccggcctggagaaattaaaggagatccactacccaccctataccgactggaaccagcagctgttacgctggggcatgggctcccagagctgcaccctcctgtgagcgtcccacccgcctccaacgggtcacacagagaaacctgagtctagccatgaggggcttatgctcccaactcacattgttcctccagaccgcaggttcccccagcctcaggttgctggagctgtcacatgactgcatcctgcctgccagggctgcaaagcaaggtcttgcttctatctgggggacgctgctcgagagaggccaagaggccgcagaacatgccaggtgtcctcactcaccccaccctccccaattccagccctttgccctctcggtcagggttggccagacccagtcacaggggcagtgtcaccctggaaaatacagtgccctgccttcttaggggcatcagccctgaacggttgagagcgtggagccctccaggcctttgctctcccctctaggcacacgcgcacttccatctctgccccatcccaactgcaccagcactgcctcccccagggatcctctcacatcccacactggtctctgcaccacccctctggttcacaccgcaccctgcactcacccacagcagctccatccactgggaaaactggggtttgcatcactccactgcacagtgttagtgggacctgggggcaagtcccttgacttctctgagcctcagtttccttatgtgaaagttgctggaaccaaaatggagtcacttatgccaaactctaataaaatggagtcggggggccacatagaagccctcacacacacatgcccgtaacaggatttatcacaagacacgcctgcatgtagaccagacacagggcgtatggaaagcacgtcctcaagactgtagtattccagatgagctgcagatgcttacctaccacggccgtctccaccagaaaaccatcgccaactcctgcgatcagcttgtgacttacaaaccttgtttaaaagctgcttacatggacttctgtcctttaaaagcttccccttggctgtggccctctgtgtatgcctgggatccttccaagcactcatagcccagataggaatcctctgctcctcccaaataaattcatctgttctgga

SEQ ID NO: 106367 - DNA, 561 bp, Homo sapiens
  Payload ID: 886
  Gene Symbol: ALDH3B2
  Gene Name: aldehyde dehydrogenase 3 family, member B2
  ENST ID: ENST00000528756
  CDS Start-End: 278-561
gagctgggatggtgggcagcagggtcacccgaggatggaccccttcgaggacacgctgcggcggctgcgtgaggccttcaactgagggcgcacgcggccggccgagttccgggctgcgcagctccagggcctgggccacttccttcaagaaaacaagcagcttctgcgcgacgtgctggcccaggacctgcataagccagctttcgaggcagacatatctgagctcatcctttgccagaacgaggttgactacgctctcaagaacctgcaggcctggatgaaggatgaaccacggtccacgaacctgttcatgaagctggactcggtcttcatctggaaggaaccctttggcctggtcctcatcatcgcaccctggaactacccactgaacctgaccctggtgctcctggtgggcgccctcgccgcagggagttgcgtggtgctgaagccgtcagaaatcagccagggcacagagaaggtcctggctgaggtgctgccccagtacctggaccagagctgctttgccgtggtgctgggcggaccccaggagacagggcagct

SEQ ID NO: 106368 - DNA, 726 bp, Homo sapiens
  Payload ID: 886
  Gene Symbol: ALDH3B2
  Gene Name: aldehyde dehydrogenase 3 family, member B2
  ENST ID: ENST00000525827
  CDS Start-End: 284-726
agacaccgagcagctataggtcctggcagtgagacaagggatggaccccttcgaggacacgctgcggcggctgcgtgaggccttcaactgagggcgcacgcggccggccgagttccgggctgcgcagctccagggcctgggccacttccttcaagaaaacaagcagcttctgcgcgacgtgctggcccaggacctgcataagccagctttcgaggcagacatatctgagctcatcctttgccagaacgaggttgactacgctctcaagaacctgcaggcctggatgaaggatgaaccacggtccacgaacctgttcatgaagctggactcggtcttcatctggaaggaaccctttggcctggtcctcatcatcgcaccctggaactacccactgaacctgaccctggtgctcctggtgggcgccctcgccgcagggagttgcgtggtgctgaagccgtcagaaatcagccagggcacagagaaggtcctggctgaggtgctgccccagtacctggaccagagctgctttgccgtggtgctgggcggaccccaggagacagggcagctgctagagcacaagttggactacatcttcttcacagggagccctcgtgtgggcaagattgtcatgactgctgccaccaagcacctgacgcctgtcaccctggagctggggggcaagaacccctgctacgtggacgacaactgcgacccccagaccgtggc

SEQ ID NO: 106369 - DNA, 492 bp, Homo sapiens
  Payload ID: 886
  Gene Symbol: ALDH3B2
  Gene Name: aldehyde dehydrogenase 3 family, member B2
  ENST ID: ENST00000531248
  CDS Start-End: 1-385
gagcgatcgctacatcgcccccacggtgctggtggacgtgcaggagacggagcctgtgatgcaggaggagatcttcgggcccatcctgcccatcgtgaacgtgcagagcgtggacgaggccatcaagttcatcaaccggcaggagaagcccctggccctgccacagtgggatgggccggtaccacggcaagttcaccttcgacaccttctcccaccaccgcacctgcctgctcgccccctccggcctggagaaattaaaggagatccactacccaccctataccgactggaaccagcagctgttacgctggggcatgggctcccagagctgcaccctcctgtgagcgtcccacccgcctccaacgggtcacacagagaaacctgagtctagccatgaggggcttatgctcccaactcacattgttcctccagaccgcaggttcccccagcctcaggttgctggagctgtcacatgactgcatcctgcctgcc

SEQ ID NO: 106370 - DNA, 2124 bp, Homo sapiens
  Payload ID: 887
  Gene Symbol: ALDH4A1
  Gene Name: aldehyde dehydrogenase 4 family, member A1
  Uniprot ID: P30038
  ENST ID: ENST00000290597
  CDS Start-End: 31-1722
tccagcgaacagccccgcttctaacccgagatgctgctgccggcgcccgcgctccgccgcgccctgctgtcccgcccctggaccggggccggcctgcggtggaagcacacctcctccctgaaggtggccaacgagcccgtcttagccttcacgcagggcagccctgagcgagatgccctgcaaaaggccttgaaggacctgaagggccggatggaagccatcccatgcgtggtgggggatgaggaggtgtggacgtcggacgtgcagtaccaagtgtcgccttttaaccatggacataaggtggccaagttctgttatgcagacaagagcctgctcaacaaagccattgaggctgccctggctgcccggaaagagtgggacctgaagcctattgcagaccgggcccagatcttcctgaaggcggcagacatgctgagtgggccgcgcagggctgagatcctcgccaagaccatggtgggacagggtaagaccgtgatccaagcggagattgacgctgcagcggaactcatcgacttcttccggttcaatgccaagtatgcggtggagctggaggggcagcagcccatcagcgtgcccccgagcaccaacagcacggtgtaccggggtctggagggcttcgtggcggccatctcgccctttaacttcactgcaatcggcggcaacctggcgggggcaccggccctgatgggcaacgtggtcctatggaagcccagtgacactgccatgctggccagctatgctgtctaccgcatccttcgggaggctggcctgccccccaacatcatccagtttgtgccagctgatgggcccctatttggggacactgtcaccagctcagagcacctctgtggcatcaacttcacaggcagtgtgcccaccttcaaacacctgtggaagcaggtggcccagaacctggaccggttccacaccttcccacgcctggctggagagtgcggcggaaagaacttccacttcgtgcaccgctcggccgacgtggagagcgtggtgagcgggaccctccgctcagccttcgagtacggtggccagaagtgttccgcgtgctcgcgtctctacgtgccgcactcgctgtggccgcagatcaaagggcggctgctggaggagcacagtcggatcaaagtgggcgaccctgcagaggattttgggaccttcttctctgcagtgattgatgccaagtcctttgcccgtatcaagaagtggctggagcacgcacgctcctcacccagcctcaccatcctggccgggggcaagtgtgatgactccgtgggctactttgtggagccctgcatcgtggagagcaaggaccctcaggagcccatcatgaaggaggagatcttcgggcctgtactgtctgtgtacgtctacccggatgacaagtacaaggagacgctgcagctggttgacagcaccaccagctatggcctcacgggggcagtgttctcccaggataaggacgtcgtgcaggaggccacaaaggtgctgaggaatgctgccggcaacttctacatcaacgacaagtccactggctcgatagtgggccagcagccctttgggggggcccgagcctctggaaccaatgacaagccagggggcccacactacatcctgcgctggacgtcgccgcaggtcatcaaggagacacataagcccctgggggactggagctacgcgtacatgcagtgagcccctctcgggctccaccgtccagctgtctgtccgtccagatgcctcctgcttggattctgagtggtcagagatctgtaaagcatgactttcaaggatggttcttaggggactgtgaaagtgttgggtcttcctccaggatgcctgcatgggaccccacccggagctggtgtggccattccccaagtgccactggcccatggatgggggtgggtgctggtgccagctgggctgggtgtgggttctgtgtccttccaggatatgtgtcatttcccatgaggggccggggcaggtggctgggtgggggcacaggctggagtattcttagttctactggttctacactgtgaggtggcaatgggatttgctcagatgccacccaataaaatgcctgttacttaa

SEQ ID NO: 106371 - DNA, 3363 bp, Homo sapiens
  Payload ID: 887
  Gene Symbol: ALDH4A1
  Gene Name: aldehyde dehydrogenase 4 family, member A1
  Uniprot ID: P30038
  ENST ID: ENST00000375341
  CDS Start-End: 259-1950
gggaaaacgcatgcatttcaggacttcgctttcgggttcccttgtcctgtgttgtgtaatgcccccgttatggcactagaaatattttttattagccgaagctaaatatagtgggactttggctgatcccgagctcggaggacagccggggtgatccgtttccccccgaggatcgaggtggtgcgctctggacggggttgtgcattctcgccgcgcccgggcggacgatccagcgaacagccccgcttctaacccgagatgctgctgccggcgcccgcgctccgccgcgccctgctgtcccgcccctggaccggggccggcctgcggtggaagcacacctcctccctgaaggtggccaacgagcccgtcttagccttcacgcagggcagccctgagcgagatgccctgcaaaaggccttgaaggacctgaagggccggatggaagccatcccatgcgtggtgggggatgaggaggtgtggacgtcggacgtgcagtaccaagtgtcgccttttaaccatggacataaggtggccaagttctgttatgcagacaagagcctgctcaacaaagccattgaggctgccctggctgcccggaaagagtgggacctgaagcctattgcagaccgggcccagatcttcctgaaggcggcagacatgctgagtgggccgcgcagggctgagatcctcgccaagaccatggtgggacagggtaagaccgtgatccaagcggagattgacgctgcagcggaactcatcgacttcttccggttcaatgccaagtatgcggtggagctggaggggcagcagcccatcagcgtgcccccgagcaccaacagcacggtgtaccggggtctggagggcttcgtggcggccatctcgccctttaacttcactgcaatcggcggcaacctggcgggggcaccggccctgatgggcaacgtggtcctatggaagcccagtgacactgccatgctggccagctatgctgtctaccgcatccttcgggaggctggcctgccccccaacatcatccagtttgtgccagctgatgggcccctatttggggacactgtcaccagctcagagcacctctgtggcatcaacttcacaggcagtgtgcccaccttcaaacacctgtggaagcaggtggcccagaacctggaccggttccacaccttcccacgcctggctggagagtgcggcggaaagaacttccacttcgtgcaccgctcggccgacgtggagagcgtggtgagcgggaccctccgctcagccttcgagtacggtggccagaagtgttccgcgtgctcgcgtctctacgtgccgcactcgctgtggccgcagatcaaagggcggctgctggaggagcacagtcggatcaaagtgggcgaccctgcagaggattttgggaccttcttctctgcagtgattgatgccaagtcctttgcccgtatcaagaagtggctggagcacgcacgctcctcacccagcctcaccatcctggccgggggcaagtgtgatgactccgtgggctactttgtggagccctgcatcgtggagagcaaggaccctcaggagcccatcatgaaggaggagatcttcgggcctgtactgtctgtgtacgtctacccggatgacaagtacaaggagacgctgcagctggttgacagcaccaccagctatggcctcacgggggcagtgttctcccaggataaggacgtcgtgcaggaggccacaaaggtgctgaggaatgctgccggcaacttctacatcaacgacaagtccactggctcgatagtgggccagcagccctttgggggggcccgagcctctggaaccaatgacaagccagggggcccacactacatcctgcgctggacgtcgccgcaggtcatcaaggagacacataagcccctgggggactggagctacgcgtacatgcagtgagcccctctcgggctccaccgtccagctgtctgtccgtccaggtggccgacctcactgcacagaccccactccagcccctccaccccttcttcatgcacagctgcctttctataatccgggcttgactcccttcttaccactgtattctggcctctcccatgcctcaggctctggtttgagatcgtgctggggaggaacatggccactaccccttatcccatcggccatgtgggaggtatgaccctggtgcctggcaggttctccctctgccctccactgggcccagtggctcagggacctggggaaaggagatggagcagctcttgggatcctttggggaaaaggaggccattctgggccccttggcaaacctcaccactcacagaggctcctggccttgatccctgcccctccaggtgtccagggtaaagtgtaactcagactgacctgtggggcacagggggcaccagctggccttgccctctctggtctgggctgtctaccttcctcactgtatctttgcccagacccacctgggccagtaggcccctgtccccagccacacaccttagatgctggcatgccttactccaggtgcctgtgtttggccgaggcctgtgtgattcccggtctgcaccacatggcggggttggggggccgctggaggccacctgccaaggcgtgggatgggatggtcctgccggtttaggccgtgattctggaaaaccttggatgggccttcgtcctatgtcagccttccctttgatcctcaggccctacctgtagagacctccactcctagagccagtctcagggtctgggatttccctgcaggagctcagccaccactgtgccatggtgacacaggccaaggcagacattggccctcccttctcccagcccccagaggcctggccttgggttcgtcagcatgggccgaggacgttgcctgtagaatcctcctctgcctgggagtggctctgtgtggaccagtccctcactggcccattctttttttgacgcagccaatctgtgaccacgattcctcccacagatgcctcctgcttggattctgagtggtcagagatctgtaaagcatgactttcaaggatggttcttaggggactgtgaaagtgttgggtcttcctccaggatgcctgcatgggaccccacccggagctggtgtggccattccccaagtgccactggcccatggatgggggtgggtgctggtgccagctgggctgggtgtgggttctgtgtccttccaggatatgtgtcatttcccatgaggggccggggcaggtggctgggtgggggcacaggctggagtattcttagttctactggttctacactgtgaggtggcaatgggatttgctcagatgccacccaataaaatgcctgttactt

SEQ ID NO: 106372 - DNA, 844 bp, Homo sapiens
  Payload ID: 887
  Gene Symbol: ALDH4A1
  Gene Name: aldehyde dehydrogenase 4 family, member A1
  ENST ID: ENST00000432718
  CDS Start-End: 202-844
aatgcccccgttatggcactagaaatattttttattagccgaagctaaatatagtgggactttggctgatcccgagctcggaggacagccggggtgatccgtttccccccgaggatcgaggtggtgcgctctggacggggttgtgcattctcgccgcgcccgggcggacgatccagcgaacagccccgcttctaacccgagatgctgctgccggcgcccgcgctccgccgcgccctgctgtcccgcccctggaccggggccggcctgcggtggaagcacacctcctccctgaaggtggccaacgagcccgtcttagccttcacgcagggcagccctgagcgagatgccctgcaaaaggccttgaaggacctgaagggccggatggaagccatcccatgcgtggtgggggatgaggaggtgtggacgtcggacgtgcagtaccaagtgtcgagcctgctcaacaaagccattgaggctgccctggctgcccggaaagagtgggacctgaagcctattgcagaccgggcccagatcttcctgaaggcggcagacatgctgagtgggccgcgcagggctgagatcctcgccaagaccatggtgggacagggtaagaccgtgatccaagcggagattgacgctgcagcggaactcatcgacttcttccggttcaatgccaagtatgcggtggagctggaggggcagcagcccatcagcgtgcccccgagcaccaacagcacggtgtaccggggtctggagggcttcgtggcggccatctcgccctttaacttcactgcaatcggcggcaacctggcgggggcaccggccctgatggtgagatgtgggc

SEQ ID NO: 106373 - DNA, 1940 bp, Homo sapiens
  Payload ID: 887
  Gene Symbol: ALDH4A1
  Gene Name: aldehyde dehydrogenase 4 family, member A1
  Uniprot ID: P30038
  ENST ID: ENST00000538309
  CDS Start-End: 317-1828
gtgccaaggggatctcagctggttcacattctgagactgtgttctggaatgtgctgccctttcagcttagagagaggagtttgggtctttttgggataaagcctgccttgtgggagaagaaagggagagtaacgctttgcatgtggaaaatacttcaacgtggttttgcatctgtgtgtttaaacttcaaacaaccgccctgcggtggaagcacacctcctccctgaaggtggccaacgagcccgtcttagccttcacgcagggcagccctgagcgagatgccctgcaaaaggccttgaaggacctgaagggccggatggaagccatcccatgcgtggtgggggatgaggaggtgtggacgtcggacgtgcagtaccaagtgtcgccttttaaccatggacataaggtggccaagttctgttatgcagacaagagcctgctcaacaaagccattgaggctgccctggctgcccggaaagagtgggacctgaagcctattgcagaccgggcccagatcttcctgaaggcggcagacatgctgagtgggccgcgcagggctgagatcctcgccaagaccatggtgggacagggtaagaccgtgatccaagcggagattgacgctgcagcggaactcatcgacttcttccggttcaatgccaagtatgcggtggagctggaggggcagcagcccatcagcgtgcccccgagcaccaacagcacggtgtaccggggtctggagggcttcgtggcggccatctcgccctttaacttcactgcaatcggcggcaacctggcgggggcaccggccctgatgggcaacgtggtcctatggaagcccagtgacactgccatgctggccagctatgctgtctaccgcatccttcgggaggctggcctgccccccaacatcatccagtttgtgccagctgatgggcccctatttggggacactgtcaccagctcagagcacctctgtggcatcaacttcacaggcagtgtgcccaccttcaaacacctgtggaagcaggtggcccagaacctggaccggttccacaccttcccacgcctggctggagagtgcggcggaaagaacttccacttcgtgcaccgctcggccgacgtggagagcgtggtgagcgggaccctccgctcagccttcgagtacggtggccagaagtgttccgcgtgctcgcgtctctacgtgccgcactcgctgtggccgcagatcaaagggcggctgctggaggagcacagtcggatcaaagtgggcgaccctgcagaggattttgggaccttcttctctgcagtgattgatgccaagtcctttgcccgtatcaagaagtggctggagcacgcacgctcctcacccagcctcaccatcctggccgggggcaagtgtgatgactccgtgggctactttgtggagccctgcatcgtggagagcaaggaccctcaggagcccatcatgaaggaggagatcttcgggcctgtactgtctgtgtacgtctacccggatgacaagtacaaggagacgctgcagctggttgacagcaccaccagctatggcctcacgggggcagtgttctcccaggataaggacgtcgtgcaggaggccacaaaggtgctgaggaatgctgccggcaacttctacatcaacgacaagtccactggctcgatagtgggccagcagccctttgggggggcccgagcctctggaaccaatgacaagccagggggcccacactacatcctgcgctggacgtcgccgcaggtcatcaaggagacacataagcccctgggggactggagctacgcgtacatgcagtgagcccctctcgggctccaccgtccagctgtctgtccgtccaggtggccgacctcactgcacagaccccactccagcccctccaccccttcttcatgcacagctgcctttctat

SEQ ID NO: 106374 - DNA, 2957 bp, Homo sapiens
  Payload ID: 887
  Gene Symbol: ALDH4A1
  Gene Name: aldehyde dehydrogenase 4 family, member A1
  Uniprot ID: P30038
  ENST ID: ENST00000538839
  CDS Start-End: 6-1544
ccgagatgctgctgccggcgcccgcgctccgccgcgccctgctgtcccgcccctggaccggggccggcctgcggtggaagcacacctcctccctgaaggtggccaacgagcccgtcttagccttcacgcagggcagccctgagcgagatgccctgcaaaaggccttgaaggacctgaagggccggatggaagccatcccatgcgtggtgggggatgaggaggtgtggacgtcggacgtgcagtaccaagtgtcgccttttaaccatggacataaggtggccaagttctgttatgcagacaagagcctgctcaacaaagccattgaggctgccctggctgcccggaaagagtgggacctgaagcctattgcagaccgggcccagatcttcctgaaggcggcagacatgctgagtgggccgcgcagggctgagatcctcgccaagaccatggtgggacagggtaagaccgtgatccaagcggagattgacgctgcagcggaactcatcgacttcttccggttcaatgccaagtatgcggtggagctggaggggcagcagcccatcagcgtgcccccgagcaccaacagcacggtgtaccggggtctggagggcttcgtggcggccatctcgccctttaacttcactgcaatcggcggcaacctggcgggggcaccggccctgatgggcaacgtggtcctatggaagcccagtgacactgccatgctggccagctatgctgtctaccgcatccttcgggaggctggcctgccccccaacatcatccagtttgtgccagctgatgggcccctatttggggacactgtcaccagctcagagcacctctgtggcatcaacttcacaggcagtgtgcccaccttcaaacacctgtggaagcaggtggcccagaacctggaccggttccacaccttcccacgcctggctggagagtgcggcggaaagaacttccacttcgtgcaccgctcggccgacgtggagagcgtggtgagcgggaccctccgctcagccttcgagtacggtggccagaagtgttccgcgtgctcgcgtctctacgtgccgcactcgctgtggccgcagatcaaagggcggctgctggaggagcacagtcggatcaaagtgggcgaccctgcagaggattttgggaccttcttctctgcagtgattgatgccaaggagatcttcgggcctgtactgtctgtgtacgtctacccggatgacaagtacaaggagacgctgcagctggttgacagcaccaccagctatggcctcacgggggcagtgttctcccaggataaggacgtcgtgcaggaggccacaaaggtgctgaggaatgctgccggcaacttctacatcaacgacaagtccactggctcgatagtgggccagcagccctttgggggggcccgagcctctggaaccaatgacaagccagggggcccacactacatcctgcgctggacgtcgccgcaggtcatcaaggagacacataagcccctgggggactggagctacgcgtacatgcagtgagcccctctcgggctccaccgtccagctgtctgtccgtccaggtggccgacctcactgcacagaccccactccagcccctccaccccttcttcatgcacagctgcctttctataatccgggcttgactcccttcttaccactgtattctggcctctcccatgcctcaggctctggtttgagatcgtgctggggaggaacatggccactaccccttatcccatcggccatgtgggaggtatgaccctggtgcctggcaggttctccctctgccctccactgggcccagtggctcagggacctggggaaaggagatggagcagctcttgggatcctttggggaaaaggaggccattctgggccccttggcaaacctcaccactcacagaggctcctggccttgatccctgcccctccaggtgtccagggtaaagtgtaactcagactgacctgtggggcacagggggcaccagctggccttgccctctctggtctgggctgtctaccttcctcactgtatctttgcccagacccacctgggccagtaggcccctgtccccagccacacaccttagatgctggcatgccttactccaggtgcctgtgtttggccgaggcctgtgtgattcccggtctgcaccacatggcggggttggggggccgctggaggccacctgccaaggcgtgggatgggatggtcctgccggtttaggccgtgattctggaaaaccttggatgggccttcgtcctatgtcagccttccctttgatcctcaggccctacctgtagagacctccactcctagagccagtctcagggtctgggatttccctgcaggagctcagccaccactgtgccatggtgacacaggccaaggcagacattggccctcccttctcccagcccccagaggcctggccttgggttcgtcagcatgggccgaggacgttgcctgtagaatcctcctctgcctgggagtggctctgtgtggaccagtccctcactggcccattctttttttgacgcagccaatctgtgaccacgattcctcccacagatgcctcctgcttggattctgagtggtcagagatctgtaaagcatgactttcaaggatggttcttaggggactgtgaaagtgttgggtcttcctccaggatgcctgcatgggaccccacccggagctggtgtggccattccccaagtgccactggcccatggatgggggtgggtgctggtgccagctgggctgggtgtgggttctgtgtccttccaggatatgtgtcatttcccatgaggggccggggcaggtggctgggtgggggcacaggctggagtattcttagttctactggttctacactgtgaggtggcaatgggatttgctcagatgccacccaataaaatgcctgttactt

SEQ ID NO: 106375 - DNA, 2266 bp, Homo sapiens
  Payload ID: 888
  Gene Symbol: ALDH5A1
  Gene Name: aldehyde dehydrogenase 5 family, member A1
  Uniprot ID: P51649
  ENST ID: ENST00000348925
  CDS Start-End: 29-1675
gtttcctgtcgccgtcgttgcccgggccatggcgacctgcatttggctgcggagctgtggggcccggcgcctcgggtcgacgtttccaggctgccgcctccgcccccgcgccggcggcctggtccctgcctccgggcctgcgcccggcccggcccagctccgctgctacgctgggcgcctggcgggcctctctgcggcgctgctgcgcaccgacagcttcgtgggcggccgctggctcccggccgccgccaccttccccgtgcaagacccggccagcggcgccgctctgggcatggtagccgactgcggggtgcgagaggcccgcgccgccgtgcgcgctgcctacgaggctttctgccgctggagggaggtctccgccaaggagaggagttcattacttcggaagtggtacaatttaatgatacaaaataaggatgaccttgccagaataatcacagctgaaagtggaaagccactgaaggaggcacatggagaaattctctattccgcctttttcctagagtggttctctgaggaagcccgccgtgtttacggagacattatccacaccccggcaaaggacaggcgggccctggtcctcaagcagcccataggcgtggctgcagtcatcaccccgtggaatttccccagtgccatgatcacccggaaggtgggggccgccctggcagccggctgtactgtcgtggtgaagcctgccgaagacacgcccttctccgccctggccctggctgaggtaaatcagggatttcttcttgatttggatccattgttgcttgcaagccaggctgggattccttcaggtgtatacaatgttattccctgttctcgaaagaatgccaaggaagtaggggaggcaatttgtactgatcctctggtgtccaaaatttcctttactggttcaacaactacaggaaagatcctgttgcaccacgcagcaaactctgtgaaaagggtctctatggagctgggcggccttgctccatttatagtatttgacagtgccaacgtggaccaggctgtagcaggggccatggcatctaaatttaggaacactggacagacttgtgtttgctcaaaccaattcttggtgcaaaggggcatccatgatgcctttgtaaaagcattcgccgaggccatgaagaagaacctgcgcgtaggtaatggatttgaggaaggaactactcagggcccattaattaatgaaaaagcggtagaaaaggtggagaaacaggtgaatgatgccgtttctaaaggtgccaccgttgtgacaggtggaaaacgacaccaacttggaaaaaatttctttgagcctaccctgctgtgcaatgtcacccaggacatgctgtgcactcatgaagagactttcgggcctctggcaccagttatcaagttcgatacagaggaggaggctatagcaatcgctaacgcagctgatgttgggttagcaggttatttttactctcaagacccagcccagatctggagagtggcagagcagctggaagtgggcatggttggcgtcaacgaaggattaatttcctctgtggagtgcccttttggtggagtgaagcagtccggccttgggcgagaggggtccaagtatggcattgatgagtatctggaactcaagtatgtgtgttacgggggcttgtaggattctttggttctttaaaaaaatttaaaaggagacttatctacatatataggtacatgccatccattattttaaataaactaataggttttcagaattatgaatttttcagaactcatccagtccttgtaatcttaaacagatgcaaatcctacccctgcccttaatgtaactagggaccaatatgtgccacgtgcctgtggctgcagactcccagagaaccagcactgggtttacagaatgaggccctggctccccaccacagccccagctgcctcagagcaggcacagcacaaggcaggcccagccccatgggccgtcacaaaggcttgatcactgcctgggcagtggcacaaccatcccccatgtcgctacagaacatgggcccagagcaccttgaaggagacccttgactgtgactggcaggcaggtgaggggcacagcacccctccccggcatctgccagctcagcacagaagacaccgaatgtgcatctggaggtgttgcggcagaggtttgagtgaaccctctttcaaagacaataaatagcacagaattgtccgtgcttctgtgaggcacgaaggagcacct

SEQ ID NO: 106376 - DNA, 5248 bp, Homo sapiens
  Payload ID: 888
  Gene Symbol: ALDH5A1
  Gene Name: aldehyde dehydrogenase 5 family, member A1
  Uniprot ID: P51649
  ENST ID: ENST00000357578
  CDS Start-End: 146-1753
tgtggctctgcaaccttccgccagctcccacgctttccccgcgcgtccccggcgcctcctcgctcctcttgcttccccgcgacccctgcgttcccgtgcgcgcgcgcccgcttgcctgtttcctgtcgccgtcgttgcccgggccatggcgacctgcatttggctgcggagctgtggggcccggcgcctcgggtcgacgtttccaggctgccgcctccgcccccgcgccggcggcctggtccctgcctccgggcctgcgcccggcccggcccagctccgctgctacgctgggcgcctggcgggcctctctgcggcgctgctgcgcaccgacagcttcgtgggcggccgctggctcccggccgccgccaccttccccgtgcaagacccggccagcggcgccgctctgggcatggtagccgactgcggggtgcgagaggcccgcgccgccgtgcgcgctgcctacgaggctttctgccgctggagggaggtctccgccaaggagaggagttcattacttcggaagtggtacaatttaatgatacaaaataaggatgaccttgccagaataatcacagctgaaagtggaaagccactgaaggaggcacatggagaaattctctattccgcctttttcctagagtggttctctgaggaagcccgccgtgtttacggagacattatccacaccccggcaaaggacaggcgggccctggtcctcaagcagcccataggcgtggctgcagtcatcaccccgtggaatttccccagtgccatgatcacccggaaggtgggggccgccctggcagccggctgtactgtcgtggtgaagcctgccgaagacacgcccttctccgccctggccctggctgagcttgcaagccaggctgggattccttcaggtgtatacaatgttattccctgttctcgaaagaatgccaaggaagtaggggaggcaatttgtactgatcctctggtgtccaaaatttcctttactggttcaacaactacaggaaagatcctgttgcaccacgcagcaaactctgtgaaaagggtctctatggagctgggcggccttgctccatttatagtatttgacagtgccaacgtggaccaggctgtagcaggggccatggcatctaaatttaggaacactggacagacttgtgtttgctcaaaccaattcttggtgcaaaggggcatccatgatgcctttgtaaaagcattcgccgaggccatgaagaagaacctgcgcgtaggtaatggatttgaggaaggaactactcagggcccattaattaatgaaaaagcggtagaaaaggtggagaaacaggtgaatgatgccgtttctaaaggtgccaccgttgtgacaggtggaaaacgacaccaacttggaaaaaatttctttgagcctaccctgctgtgcaatgtcacccaggacatgctgtgcactcatgaagagactttcgggcctctggcaccagttatcaagttcgatacagaggaggaggctatagcaatcgctaacgcagctgatgttgggttagcaggttatttttactctcaagacccagcccagatctggagagtggcagagcagctggaagtgggcatggttggcgtcaacgaaggattaatttcctctgtggagtgcccttttggtggagtgaagcagtccggccttgggcgagaggggtccaagtatggcattgatgagtatctggaactcaagtatgtgtgttacgggggcttgtaggattctttggttctttaaaaaaatttaaaaggagacttatctacatatataggtacatgccatccattattttaaataaactaataggttttcagaattatgaatttttcagaactcatccagtccttgtaatcttaaacagatgcaaatcctacccctgcccttaatgtaactagggaccaatatgtgccacgtgcctgtggctgcagactcccagagaaccagcactgggtttacagaatgaggccctggctccccaccacagccccagctgcctcagagcaggcacagcacaaggcaggcccagccccatgggccgtcacaaaggcttgatcactgcctgggcagtggcacaaccatcccccatgtcgctacagaacatgggcccagagcaccttgaaggagacccttgactgtgactggcaggcaggtgaggggcacagcacccctccccggcatctgccagctcagcacagaagacaccgaatgtgcatctggaggtgttgcggcagaggtttgagtgaaccctctttcaaagacaataaatagcacagaattgtccgtgcttctgtgaggcacgaaggagcacctctccctattcctgaaccatattttaattgatgcctttattgtcccaaatttaccacttaaagaattctattttcatttctgtcctgtttgccacttcatttcatttccttgagtaaatgagctgaagtgtaaagcaaagaatagcagaagcagcttggtaggatggaaggcacgcagtggcatggcctggctccttccctgagtggccttgttgccttgggcgtgtgttcagcacctcccatcccatggatacagtggagattccatacaggccttacttagctccttgcgatactgtgagccagagagaaagtaaaagcacttcacaaaaaaatgaaaattctaaggacatacaagagccattgttacgagcagcaccgcccagcccttccttgcctactgtcagtggctttgccaagatgggaggaggccagtgcccacttgcccaccgacctgagcctgagtaagtggctgtcacctgagcctgttctttctgtcctggtgtggtgctgctccctcacctccaaaagagcaaaagtactttcaccacagtcaacccaaaagggaaagaatttctgtaattgccaacccactttgtagaagaggcatgagcccttgaatttcaggcaccttttatctaatgagagtttttacagctcatcattcaaataacgcacaaaaaacaaaagccgctatgaccggcgttgcctctcactttgaaagaaagactccgtaatcttaaacagatgcaaatccaattaggcggccaagtaggtggagacgaagcaccttcctttccccatctctgtctgtgtagactccacttacatcttgtggttattctgggttgtggaaggaaaatgtgaatgaaagtagtgctggatgcaattactcctgaaccccacctaggatttaacatccctcattgagccactgggaagctatggttgagtaactaaaggtctggcaagaccctgggcacacagggagctgcctagcatctggcctggagtgtactagccacattcccaaggtcccaaggagaaggaagagctgaaattcatctcctagtgacagtgccccggccctgtcaagaatcacatactcagcattttgacagttaatgtcttctctttatttgtgtagtttttaggtggttttatataacattttaattacttgtgatttagatgtatccatcctttttctattaagaatacaaatgctgggctgggcacagtggctcacgcctgtaatcccaacaccttgggaggccaaggcaggcagatcacgacatcaggagatcgagaccatcctggctaacacggtgaaaccccgtctctactaaaaatacaaaaaaaattagtcggatgtggtggcaggtgcctgtagtcccagctactctggaggctgaggcaggagaatggcgtgaacccaggaggcggagcttgcagtgagcagagatcacgccactgcactccagcctggatgacagagcgagactccgcctcaaaaaaagaatacaaatgctccaacattattttttataactctggattaccgatgctgagatgtgtgcaggaatacttccaaataaatttttaacattgtaagccagtagattctttggctgggtggcaaattttgagtcttcttgcatatttggctcatgggttcataaattgaggccagagactcattgtatatccttgatcaattttctaattaaaggaaatagcttattgtttagtaaaatggcccttggttgtgggaagaaagagaattatttttaactgaacgtttttgttgttttttaaataaagtagccatatgtaacgggattttaaaaatatatacattttacaacatggactagaaaaggaccattagatcaggggttggcaaactatggcccacgaatcaaacctggcctgccacctgtttttatacaacctgtgagctaagaatggtttatatgttttcaaatgattgggcagaaaatcaaaagaagaacaatatttcatgacacctgaaaattctatgaaattcagatttcagtgtccataaacaaaatgttattagagcatagccacacccattcatttatggtattgtctgggactgctttcttggcagagttgaatagttgggacagggacagtatagcctgcaaagcctaaaagatttactacttgtctccttaaagaaaaagtttgccagctcctgatctagaccaagagggagatattgaccttacttgcatttatccggcattatttcaacacctcctgtgaagaaagtacttttctggcatagctaccgtgagttctcagcaggaacttcccagcgatgataatgtacatgaaattagccacgtaacaagagtctatttgccttgaaaaaacaattatccttgaacttcctccagctatgcagggattctcattaaagagctgatctgcatctgtttatccattttagtagcttttaaatatgattttatgtgaagtgccatttctttattctactaaagagagacagcagaaataaagatcagaagcaaatgtgagcaaatctgttttactgttaacttcaattatgaacttgaaattgtgccacatgactttttcctctaaaaactggatcctagtgttttaattacctgtgtgcagctattttaaatagcattttacttgaataatatgtatgttgtcattgtttcatgctatactttgtgggataaaacttgggaatgagtgtggtaagaaatttataaagttttgcttttaaaacgtggacataactcatttttctagtttttgacaattgtgtgttttagtgtctagtctgcagagagctgtgtgattaataaacgtggaattaacagaatttcctctccctgta

SEQ ID NO: 106377 - DNA, 1699 bp, Homo sapiens
  Payload ID: 888
  Gene Symbol: ALDH5A1
  Gene Name: aldehyde dehydrogenase 5 family, member A1
  ENST ID: ENST00000491546
  CDS Start-End: 131-1654
ttccgccagctcccacgctttccccgcgcgtccccggcgcctcctcgctcctcttgcttccccgcgacccctgcgttcccgtgcgcgcgcgcccgcttgcctgtttcctgtcgccgtcgttgcccgggccatggcgacctgcatttggctgcggagctgtggggcccggcgcctcgggtcgacgtttccaggctgccgcctccgcccccgcgccggcggcctggtccctgcctccgggcctgcgcccggcccggcccagctccgctgctacgctgggcgcctggcgggcctctctgcggcgctgctgcgcaccgacagcttcgtgggcggccgctggctcccggccgccgccaccttccccgtgcaagacccggccagcggcgccgctctgggcatggtagccgactgcggggtgcgagaggcccgcgccgccgtgcgcgctgcctacgaggctttctgccgctggagggaggtctccgccaagggaaagccactgaaggaggcacatggagaaattctctattccgcctttttcctagagtggttctctgaggaagcccgccgtgtttacggagacattatccacaccccggcaaaggacaggcgggccctggtcctcaagcagcccataggcgtggctgcagtcatcaccccgtggaatttccccagtgccatgatcacccggaaggtgggggccgccctggcagccggctgtactgtcgtggtgaagcctgccgaagacacgcccttctccgccctggccctggctgagcttgcaagccaggctgggattccttcaggtgtatacaatgttattccctgttctcgaaagaatgccaaggaagtaggggaggcaatttgtactgatcctctggtgtccaaaatttcctttactggttcaacaactacaggaaagatcctgttgcaccacgcagcaaactctgtgaaaagggtctctatggagctgggcggccttgctccatttatagtatttgacagtgccaacgtggaccaggctgtagcaggggccatggcatctaaatttaggaacactggacagacttgtgtttgctcaaaccaattcttggtgcaaaggggcatccatgatgcctttgtaaaagcattcgccgaggccatgaagaagaacctgcgcgtaggtaatggatttgaggaaggaactactcagggcccattaattaatgaaaaagcggtagaaaaggtggagaaacaggtgaatgatgccgtttctaaaggtgccaccgttgtgacaggtggaaaacgacaccaacttggaaaaaatttctttgagcctaccctgctgtgcaatgtcacccaggacatgctgtgcactcatgaagagactttcgggcctctggcaccagttatcaagttcgatacagaggaggaggctatagcaatcgctaacgcagctgatgttgggttagcaggttatttttactctcaagacccagcccagatctggagagtggcagagcagctggaagtgggcatggttggcgtcaacgaaggattaatttcctctgtggagtgcccttttggtggagtgaagcagtccggccttgggcgagaggggtccaagtatggcattgatgagtatctggaactcaagtatgtgtgttacgggggcttgtaggattctttggttctttaaaaaaatttaaaaggagacttatctaca

SEQ ID NO: 106378 - DNA, 1869 bp, Homo sapiens
  Payload ID: 889
  Gene Symbol: ALDH6A1
  Gene Name: aldehyde dehydrogenase 6 family, member A1
  Uniprot ID: Q02252
  ENST ID: ENST00000350259
  CDS Start-End: 54-1622
agtgcttctgggcagtagaggcgcggggtgcggagctagggcggccgagagccatggcggcgctattggcggcggcggcagtgcgagcccggatcctgcaggtttcttccaaggtgaaatccagtcccacctggtattcagcatcttccttctcttcttcagtgccaactgtaaagctcttcattggtgggaaattcgttgaatccaaaagtgacaaatggatcgatatccacaacccagccaccaatgaggtcattggtcgggtccctcaggccaccaaggcagaaatggatgcagccattgcttcctgcaaacgtgcttttcctgcatgggcagacacttcagtattaagccgccagcagaaagaaattgccaagttaatcacattggaacaagggaagaccctagctgatgctgaaggagatgtatttcgaggccttcaggtggttgagcatgcctgtagtgtgacatccctcatgatgggagagaccatgccatccatcaccaaagacatggacctttattcctaccgtctgcctctgggagtgtgtgcaggcattgctccattcaattttcctgccatgatccccctttggatgtttcccatggccatggtgtgtggaaataccttcctaatgaaaccatctgagcgagtccctggagcaactatgcttcttgctaagttgctccaggattctggtgcccctgatggaacattaaacatcatccatggacagcatgaagctgtaaattttatttgcgatcatccggacatcaaagcaatcagctttgtgggatccaacaaggcaggagagtatatcttcgagagaggatcaagacatggcaagagggttcaagccaatatgggagccaagaaccatggggtagtcatgccagatgccaataaggaaaataccctgaaccagctggttggggcagcatttggagctgctggtcagcgctgcatggctctttcaacagcagtccttgtgggagaagccaagaagtggctgccagagctggtggagcatgccaaaaacctgagagtcaatgcaggagatcagcctggagctgatcttggccctctgatcactccccaggccaaagagcgagtctgtaatctgattgatagtggaacaaaggagggagcttccatccttcttgatggacgaaaaattaaagtgaaaggctatgaaaatggcaactttgttggaccaaccatcatctcgaatgtcaagccaaatatgacctgttacaaagaggagatttttggtccagttcttgtggttctggagacagaaacattggatgaagccatccagattgtaaataacaacccatatggaaatggaactgccatcttcaccaccaatggagccactgctcggaaatatgcccacttggtggatgttggacaggtgggagtgaatgtccccattccagtgcctttgccaatgttctcattcaccggctctcgatcctccttcaggggagacaccaatttctatggcaaacagggcatccaattctacactcagttaaagaccattacttctcagtggaaagaagaagatgctactctttcctcacctgctgttgtcatgcctaccatgggccgttagaaacaagtttgtttaagactgactccatcctgagtaatctccctttatttttgaccagcttcatttgtcagctttgctcagatcagatcgatgggattggaatacattgtaactaaaatcttcctcaggactattaacccccgcaaagtttctatagggaactgcctagtgtaacaatgaaaccagatttctcacttgctcttcatacttctattttgaggtaactgttgtaactatgaaatgctta

SEQ ID NO: 106379 - DNA, 5499 bp, Homo sapiens
  Payload ID: 889
  Gene Symbol: ALDH6A1
  Gene Name: aldehyde dehydrogenase 6 family, member A1
  Uniprot ID: Q02252
  ENST ID: ENST00000553458
  CDS Start-End: 100-1707
ccaatgaggaagcctggcaggatggagggcgaggcctggcagctgtagtgcttctgggcagtagaggcgcggggtgcggagctagggcggccgagagccatggcggcgctattggcggcggcggcagtgcgagcccggatcctgcaggtttcttccaaggtgaaatccagtcccacctggtattcagcatcttccttctcttcttcagtgccaactgtaaagctcttcattggtgggaaattcgttgaatccaaaagtgacaaatggatcgatatccacaacccagccaccaatgaggtcattggtcgggtccctcaggccaccaaggcagaaatggatgcagccattgcttcctgcaaacgtgcttttcctgcatgggcagacacttcagtattaagccgccagcaggtcttgctccgctatcaacaacttattaaagaaaacttgaaagaaattgccaagttaatcacattggaacaagggaagaccctagctgatgctgaaggagatgtatttcgaggccttcaggtggttgagcatgcctgtagtgtgacatccctcatgatgggagagaccatgccatccatcaccaaagacatggacctttattcctaccgtctgcctctgggagtgtgtgcaggcattgctccattcaattttcctgccatgatccccctttggatgtttcccatggccatggtgtgtggaaataccttcctaatgaaaccatctgagcgagtccctggagcaactatgcttcttgctaagttgctccaggattctggtgcccctgatggaacattaaacatcatccatggacagcatgaagctgtaaattttatttgcgatcatccggacatcaaagcaatcagctttgtgggatccaacaaggcaggagagtatatcttcgagagaggatcaagacatggcaagagggttcaagccaatatgggagccaagaaccatggggtagtcatgccagatgccaataaggaaaataccctgaaccagctggttggggcagcatttggagctgctggtcagcgctgcatggctctttcaacagcagtccttgtgggagaagccaagaagtggctgccagagctggtggagcatgccaaaaacctgagagtcaatgcaggagatcagcctggagctgatcttggccctctgatcactccccaggccaaagagcgagtctgtaatctgattgatagtggaacaaaggagggagcttccatccttcttgatggacgaaaaattaaagtgaaaggctatgaaaatggcaactttgttggaccaaccatcatctcgaatgtcaagccaaatatgacctgttacaaagaggagatttttggtccagttcttgtggttctggagacagaaacattggatgaagccatccagattgtaaataacaacccatatggaaatggaactgccatcttcaccaccaatggagccactgctcggaaatatgcccacttggtggatgttggacaggtgggagtgaatgtccccattccagtgcctttgccaatgttctcattcaccggctctcgatcctccttcaggggagacaccaatttctatggcaaacagggcatccaattctacactcagttaaagaccattacttctcagtggaaagaagaagatgctactctttcctcacctgctgttgtcatgcctaccatgggccgttagaaacaagtttgtttaagactgactccatcctgagtaatctccctttatttttgaccagcttcatttgtcagctttgctcagatcagatcgatgggattggaatacattgtaactaaaatcttcctcaggactattaacccccgcaaagtttctatagggaactgcctagtgtaacaatgaaaccagatttctcacttgctcttcatacttctattttgaggtaactgttgtaactatgaaatgcttatctgaaagtagtgcttaaacctgatttctaaaaattatcccattttctgatgatttgaaggggagaaaagccagtgtatgtaaagaaaatgttccagccaggcgcggtggctcacgcctgtaattccatcattttgggaggccacagtgggcagattgcttgagcccaggagttgaagaacgtggcgaaaccccgtatctattatttaaaaaaattgaaaaagtaaaaaaagaaaagggaaaaaaaattttttaaagaagatgttccaataattgcaagaagaactcttagatggggaaacaggacagaaataactcaccgcttttggttgatcctcaaacatagcgctacctaaatgccactgggagagacctcctgcaaagttttctttagcccctcttttatcccacaatacacaagatataatccatttttatatatcccaaagttgtggcaacagcttctttcttttctgctcaatgccactttgtttcctagtaattcatgaccactattaattctatcattgtcactgctcctgcttaagatcacttctcaaggatacctcagtaagcaatggataaatcaactttttgttatatgtgccaagtactaagtttcagggttctcttcagcaatcattaattaatacttcagccattaattcagatgcaaataattttcttttttcttttttttgagatggagtttcactcttgttgcccaggctggagtgcaatggcgtgatctcagctcaccgcaacctccgcctcccaggttcaagcgattctcctgcctcagcccccctagtagctgggattacaggcatgcgccaccacacccagctaattttgtatttttagtagagacggggtttctccgtgttggtcaggctggtctcgaactcctgacctcaggtgatccgcctgcctcggcctcccaaagtgctgggattacaggcatgagccaccacacccagccagatgcaaataattttcttagaaaattatttcaaaagttattttaggcccagaaatcaaggattgttccaaccatgaaaatgggtaagacacctgccttaagcaaatctaacctgctattacttgccaaattttatatattcttttctcttgcctgtatttctaattagtgatttgtttaatgaagaactcttcatgtagagcaattaactgggcctaagaaatttcgaagctttccatgacataaagtggttaaaaaaaaatgctttgacagtcttcttctgccattagttcaactgcctttacgcttttttttttttttttttttttgagatggagtttcactcttgttgcccaggctagagtgcaatggcgtgatcttggctcactgcaacctctgcctcccgggttcaagcaattctcctgcctcagcctcctgagtagctgggatttcaggcatacgccaccatgcctggctaattttgtatttttagtagagacagggtttctccatgttggtcaggctggtctcgaactcccgacctcaggtgatctgcctgccttggcctcccaaagtgctgggattacaggtgtgagccaccacccccagccgcctctatgctttttgtttctttgatatatctaaacttaaggtcagaacagaaattcatgtgctgaacagaatggattctttttgcagtaccaatccaattgaatcctctttttattttcctgcgtccttaccagtcactttgatagtgctaactaacctacactatgggggttattcatgaattaagtatgataaaaaaaaaaaagaccttgaaaatgttgtgtaccctgtggatttgaggcttattactaccacctggctggataaaatgtcaaaaccttcaatcacttaaggtgactggaacttttgtaaaatacacttatgatcctactgggccttttttttttttttttctgctttcctaaatatgaggcaatagaaatttataatttgagactacagtaccccttgttttagctcttatcacagctggcaactggtagtgattttttttgttgttgttttgttttgttttgagatggagtctcgctctgttgcccagggtggagtgcagtggcacgatctcggctcactgcaacctccacctcctgggttcaagtaattctcctgcctcagtctcccgagtagctgggattacaggtgcatgcccccacacccggataattttttgtacttttagtagagacagggtttcaccatgttagccaggatggtctcaatctcctgacctaatgatccgcccacctcggcctcccaaagtgctgggattacaggcgtgaaccaccgcacctggccctggtagtgatatttaatccaatccaacaactataggctgggttaaataaaaggtcattattgtctatattccaagtggaattaaatgtagtcacagagattcctaacattttccttatatttaagggaaatcacttctaaaaaaacacactaatcagaactgtgatgctctaattagaaacaactcatctggccaactatttgctgctcagagtttcttatttcttagatgaaaaaaactcatcagttatattcatgtgatcgcggctaaaaagtcagtattttctttttgttctaatgtggcttcatttgaaatttctcagattctacattgtactaattatgaataacaaattataaattaaaaactcttaaagagaaaaacttggcttaaaaaaatcatttcatatctccttataagcctttgtcctctaggttgtaatgactctgacttcccacctgtgatggaaagctaagagtcacaaggtcactatgtttactcttacgtaaaagatagtacacattttggctaggctgtttacttcaaaaggcaacctataggtttctacacaaaaagaggcacacatttgcatttgcattagtataatatgcatttgtacggatattgctttaaaaatttatgtaatctactaatgctatttattactcattccactgatccctgaagtctctcaactagtagagaaaataaccgtgatttagcaagaagcgacatggggaagggtgacaacaatatacattgtttgattagatacagactccttactgtgtcagactcctgaggttcttttggaatagtgggtagcaccacttcaccagaagagtctgatattgcaatttgctgggtgatgaagattttatcttgaagcttactttcatccctgcaataatgacaaaataacagaaccgtcaacaactctacacacatgaaacctggtttagaataacagacttgtcatattactttcaattagcacattcaagatgcccacaagaaccatcgtgttgggctcatgtttattacttaagcaagagagctcttacccaaattcctttgtttccccactgtcagaaacaacatagtctggaactggaggcctagaactctggttgtatttcctgtagtgggtaaaagtcaacaaagataatgaatgaggcagtgtctcctcatgcct

SEQ ID NO: 106380 - DNA, 1382 bp, Homo sapiens
  Payload ID: 889
  Gene Symbol: ALDH6A1
  Gene Name: aldehyde dehydrogenase 6 family, member A1
  ENST ID: ENST00000555126
  CDS Start-End: 397-1155
ggtggtgggtgcctataatcccagctgcttgggaggctgaggcagagaattgcttgaacctgggaggcggaggttgcagtgagccgaaattgtgccactgcactccagcctgggcaacagagcgagactccgtctcaaaaaaaaaaaaaaaaaaaaagaaaaagtaaaagaaaaacacaggaaaacttcaaatccatagcagtggggaaaggggaaatttgccatgttgagaatccatttgctcctttgtgagtgatcatttattttcttcttaaagctgtaaattttatttgcgatcatccggacatcaaagcaatcagctttgtgggatccaacaaggcaggagagtatatcttcgagagaggatcaagacatggcaagagggttcaagccaatatgggagccaagaaccatggggtagtcatgccagatgccaataaggaaaataccctgaaccagctggttggggcagcatttggagctgctggtcagcgctgcatggctctttcaacagcagtccttgtgggagaagccaagaagtggctgccagagctggtggagcatgccaaaaacctgagagtcaatgcaggagatcagcctggagctgatcttggccctctgatcactccccaggccaaagagcgagtctgtaatctgattgatagtggaacaaaggagggagcttccatccttcttgatggacgaaaaattaaagtgaaaggctatgaaaatggcaactttgttggaccaaccatcatctcgaatgtcaagccaaatatgacctgttacaaagaggagatttttggtccagttcttgtggttctggagacagaaacattggatgaagccatccagattgtaaataacaacccatatggaaatggaactgccatcttcaccaccaatggagccactgctcggaaatatgcccacttggtggatgttggacaggtgggagtgaatgtccccattccagtgcctttgccaatgttctcattcaccggctctcgatcctccttcaggggagacaccaatttctatggcaaacagggcatccaattctacactcagttaaagaccattacttctcagtggaaagaagaagatgctactctttcctcacctgctgttgtcatgcctaccatgggccgttagaaacaagtttgtttaagactgactccatcctgagtaatctccctttatttttgaccagcttcatttgtcagctttgctcagatcagatcgatgggattggaatacattgtaactaaaatcttcctcaggactattaacccccgcaaagtttctatagggaactgcctagtgtaacaatgaaaccagatttctcacttgctcttcatacttctattttgaggtaactg

SEQ ID NO: 106381 - DNA, 4964 bp, Homo sapiens
  Payload ID: 890
  Gene Symbol: ALDH7A1
  Gene Name: aldehyde dehydrogenase 7 family, member A1
  Uniprot ID: P49419
  ENST ID: ENST00000409134
  CDS Start-End: 221-1840
accagatggcagcagcccactcctccctgtagcactcccattgttccaggcaggattcagccgcaggctcctccggaagaccaggggcagacggggcggtggcggggtcgtgcccagtgggaggggtcgggtctgcccaatgggttctcccgggcggggggcggggctctatttcagcagctctcagggccttgggctcatcccgagtcccgggctcagtatgtggcgccttcctcgcgcgctgtgtgtgcacgctgcaaagaccagcaagctctctggaccttggagcaggcctgccgccttcatgtccactctcctcatcaatcagccccagtatgcgtggctgaaagagctggggctccgcgaggaaaacgagggcgtgtataatggaagctggggaggccggggagaggttattacgacctattgccctgctaacaacgagccaatagcaagagtccgacaggccagtgtggcagactatgaagaaactgtaaagaaagcaagagaagcatggaaaatctgggcagatattcctgctccaaaacgaggagaaatagtaagacagattggcgatgccttgcgggagaagatccaagtactaggaagcttggtgtctttggagatggggaaaatcttagtggaaggtgtgggtgaagttcaggagtatgtggatatctgtgactatgctgttggtttatcaaggatgattggaggacctatcttgccttctgaaagatctggccatgcactgattgagcagtggaatcccgtaggcctggttggaatcatcacggcattcaatttccctgtggcagtgtatggttggaacaacgccatcgccatgatctgtggaaatgtctgcctctggaaaggagctccaaccacttccctcattagtgtggctgtcacaaagataatagccaaggttctggaggacaacaagctgcctggtgcaatttgttccttgacttgtggtggagcagatattggcacagcaatggccaaagatgaacgagtgaacctgctgtccttcactgggagcactcaggtgggaaaacaggtgggcctgatggtgcaggagaggtttgggagaagtctgttggaacttggaggaaacaatgccattattgcctttgaagatgcagacctcagcttagttgttccatcagctctcttcgctgctgtgggaacagctggccagaggtgtaccactgcgaggcgactgtttatacatgaaagcatccatgatgaggttgtaaacagacttaaaaaggcctatgcacagatccgagttgggaacccatgggaccctaatgttctctatgggccactccacaccaagcaggcagtgagcatgtttcttggagcagtggaagaagcaaagaaagaaggtggcacagtggtctatgggggcaaggttatggatcgccctggaaattatgtagaaccgacaattgtgacaggtcttggccacgatgcgtccattgcacacacagagacttttgctccgattctctatgtctttaaattcaagaatgaagaagaggtctttgcatggaataatgaagtaaaacagggactttcaagtagcatctttaccaaagatctgggcagaatctttcgctggcttggacctaaaggatcagactgtggcattgtaaatgtcaacattccaacaagtggggctgagattggaggtgcctttggaggagaaaagcacactggtggtggcagggagtctggcagtgatgcctggaaacagtacatgagaaggtctacttgtactatcaactacagtaaagaccttcctctggcccaaggaatcaagtttcagtaaaggtgttttagatgaacatcccttaatttgaggtgttccagcagctgtttttggagaagacaaagaaaattaaagttttccctgaataaatgcattattatgactgtgacagtgactaatccccctatgaccccaaagccctgattaaatcaagagattccttttttaaaaatcaaaataaaattgttacaacatagccatagttactaaaagatgagttaggtggatttttattatgtcaactagttgtacatggctttttaaaagttaatgattattttgtaattagaaaaaaatagtacgtaccagggtaggaatttgggaaaatacagaaccgaggagaaaacagaagtctttgcagtagatacagggtgtctcctgaccaagtgaaggattcaggggcggggggtgaatattgcttgacattacccacctatggcatgtgttggatgtcgtgtgattgaaagggggatgcattcccctgtatgcttggaccacagttcagtattcatgtggaataacttgcagtgcttaaaatgacaacaggcattcatcacagttatggctcttgcttatgaaggctgtgtcaacttggaagagatttctggggtagacagattttgttcctgtgctggagtctgccacctgctggaggactctgaggccaaaattgcccgtgcagagttgtatagaaaatgcgtctggaggctgggcaaggtggcttacgcctataatcccagcactttgagaggccgaggcgggtggatcagtagaggctaggagtttgagaccagcctggccgatatcgtgaaaccccgtctttaccaaaaaatacaaaaattagcccagtgtggtggcaggcacctgtaatcccagctattagggaggctgaggcaggagaattgtgtgaacccaggaggcagaggttgcagtgagcctagattgtgccactgcctgggcaacagtgagatcctgtctacaaaaaaaaaaaaaaaaaaaagtgcatctggatttttttatacaaccttagaccaccttctttagctttaggcgtctgcggttgcccttggatctgttctcaatcctcagtgtgtgtggcagcatgtggtcatagagagctgggcaaagttcactttctctttgctgacagtctcaccttttctcactgggaagctgcacaggagcctttgggctggttcagcccagaggcccctgttctcctgccttcctggcattctctgctccccttctgcatggcacccctctactcctgccaggttagaatggagcagaggcctttgaacaagatgacatttgtagacaacctgatccatcaggatgtggagagatctggacaaatggcaaataatttggggttgaattatggcccagagaagtaagcaaatgaaaaactaaacaattataaatgtatctgggaagcaaaggtattcataatatgtcccatggccagctgcgagcagtatttaactagacatgctgttgtcaatattgaacatgaatcaagccaaatactgatatagctattgagagaaggttggcaggaagaaatcatgggtgagggtatgtgggagtgataatcttagctatagattttaggtaaaactgattctgaaagctttctttgaaacaaatttataatttttcttctacatgtttctagcacaaggactcaattttttttggttataatgttcattaaaacatatgccttcaatttgttcctctttgttcttttttgctgatttagcagatataaatcacttgttagtatttttaactatccaagttaaaatgtacatttgtaagtgttattactggtcttatatttgaaggtgcaaggggtcttgtgctgctcattactggttatcttgagcatttcataactgctgcctcctcctaaatcctgtgttccaaccgctactgctggcaatgcccagcctccattgtggatgcggggaattgtgttcagcatgcttgcttctgccacggcactaaagcctaacttgcttaggatcttgctgtacttggagagagcatccattcgctgagcctagcagccaggctcttgtgactccctgggaagtgggtgaagacctggctcctggctgcagcagtgaggaggcaggccctccaggtgaagacttctcacaatggagggaaggcagttttctcaaaggaaattgagtgctattatgtactctgcttcctactttctctttcagggtgggaatctgttaagcctcctctctctcttgctctgcaaccacagaacacttctttttttttggtgtctcagttttgcccacactggagtgcagtggtgcaatagtggctcactgcagcctccaactcctgggctcaatctatccttccacctcatgctccccagtagctgggactacaggtgcatgccactgtgcccagctgattattatttttttttgtaaagattgggtcatactacattgctcatgctcgtcttgaacttgtggcctcaagcgatcctcctgcctcagcctcttgagttgttgggattacaggagtgtgccaccatgcccagctctgtggaaaattctctgtggcattctgtctcctgaaaatgctgaagggaccaagagggctctgtgtccttcctcttctcttccctggcactttcagaccattttcttgttgccttcattctaacaaaggttgcagattggaaagctgatttggaatgctttttaagtgttttcagtttcaatatttttatgaaattcctatggtctccaacaaacttttttttttttttttttttctacacctggagcttatcctgcagaagcttcctgccaatgattgttttggaggaaattaaaagaaaaccaaacgaaacctctcctatccaaggggaagaactttatccccatattgattgaatataggattctagatttaaaatgttgtaggcagttagagtttgctctttttttttttctattggaaaggtccacaaatgttttattgacatttttgtctttaatccatttggatttggggtacatgttacgatttgtctacgttaatttcccttttaaaaataaaaataattcctcaactccaa

SEQ ID NO: 106382 - DNA, 1031 bp, Homo sapiens
  Payload ID: 890
  Gene Symbol: ALDH7A1
  Gene Name: aldehyde dehydrogenase 7 family, member A1
  ENST ID: ENST00000458249
  CDS Start-End: 1-294
atgtggcgccttcctcgcgcgctgtgtgtgcacgctgcaaagaccagcaagctctctggaccttggagcaggcctgccgccttcatgtccactctcctcatcaatcagccccagtatgcgtggctgaaagagctggggctccgcgaggaaaacgagggcgtgtataatggaagctggggaggccggggagagtttgcaagcttggacgtgccgaaatcttgccatgttgtacgttgggctgtgaactcctttgaggactggattttcagcatttctccattgcccagggcttaacaccgcgcctgatacccattactgctcaaaacaatgttttatagaatacaatggaaaggttattacgacctattgccctgctaacaacgagccaatagcaagagtccgacaggccagtgtggcagactatgaagaaactgtaaagaaagcaagagaagcatggaaaatctgggcagatattcctgctccaaaacgaggagaaatagtaagacagattggcgatgccttgcgggagaagatccaagtactaggaagcttggtgtctttggagatggggaaaatcttagtggaaggtgtgggtgaagttcaggagtatgtggatatctgtgactatgctgttggtttatcaaggatgattggaggacctatcttgccttctgaaagatctggccatgcactgattgagcagtggaatcccgtaggcctggttggaatcatcacggcattcaatttccctgtggcagtgtatggttggaacaacgccatcgccatgatctgtggaaatgtctgcctctggaaaggagctccaaccacttccctcattagtgtggctgtcacaaagataatagccaaggttctggaggacaacaagctgcctggtgcaatttgttccttgacttgtggtggagcagatattggcacagcaatggccaaagatgaacgagtgaacctgctgtccttcactgggagcactcaggtgggaaaacaggtgggcctgatggtgcaggagaggtttg

SEQ ID NO: 106383 - DNA, 4742 bp, Homo sapiens
  Payload ID: 890
  Gene Symbol: ALDH7A1
  Gene Name: aldehyde dehydrogenase 7 family, member A1
  Uniprot ID: P49419
  ENST ID: ENST00000447989
  CDS Start-End: 112-1620
gtagcactcccattgttccaggcaggattcagccgcaggctcctccggaagaccaggggcagacggggcggtggcggggtcgtgcccagtgggaggggtcgggtctgcccaatgggttctcccgggcggggggcggggctctatttcagcagctctcagggccttgggctcatcccgagtcccgggctcagtatgtggcgccttcctcgcgcgctgtgtgtgcacgctgcaaagaccagcaagctctctggaccttggagcaggcctgccgccttcatgtccactctcctcatcaatcagccccagtatgcgtggctgaaagagctggggctccgcgaggaaaacgagggcgtgtataatggaagctggggaggccggggagaggttattacgacctattgccctgctaacaacgagccaatagcaagagtccgacaggccagtgtggcagactatgaagaaactgtaaagaaagcaagagaagcatggaaaatctgggcagatattcctgctccaaaacgaggagaaatagtaagacagattggcgatgccttgcgggagaagatccaagtactaggaagcttggtgtctttggagatggggaaaatcttagtggaaggtgtgggtgaagttcaggagtatgtggatatctgtgactatgctgttggtttatcaaggatgattggaggacctatcttgccttctgaaagatctggccatgcactgattgagcagtggaatcccgtaggcctggttggaatcatcacggcattcaatttccctgtggcagtgtatggttggaacaacgccatcgccatgatctgtggaaatgtctgcctctggaaaggagctccaaccacttccctcattagtgtggctgtcacaaagataatagccaaggttctggaggacaacaagctgcctggtgcaatttgttccttgacttgtggtggagcagatattggcacagcaatggccaaagatgaacgagtgaacctgctgtccttcactgggagcactcaggtgggaaaacaggtgggcctgatggtgcaggagaggtttgggagaagtctgttggaacttggaggaaacaatgccattattgcctttgaagatgcagacctcagcttagttgttccatcagctctcttcgctgctgtgggaacagctggccagaggtgtaccactgcgaggcgactggttatggatcgccctggaaattatgtagaaccgacaattgtgacaggtcttggccacgatgcgtccattgcacacacagagacttttgctccgattctctatgtctttaaattcaagaatgaagaagaggtctttgcatggaataatgaagtaaaacagggactttcaagtagcatctttaccaaagatctgggcagaatctttcgctggcttggacctaaaggatcagactgtggcattgtaaatgtcaacattccaacaagtggggctgagattggaggtgcctttggaggagaaaagcacactggtggtggcagggagtctggcagtgatgcctggaaacagtacatgagaaggtctacttgtactatcaactacagtaaagaccttcctctggcccaaggaatcaagtttcagtaaaggtgttttagatgaacatcccttaatttgaggtgttccagcagctgtttttggagaagacaaagaaaattaaagttttccctgaataaatgcattattatgactgtgacagtgactaatccccctatgaccccaaagccctgattaaatcaagagattccttttttaaaaatcaaaataaaattgttacaacatagccatagttactaaaagatgagttaggtggatttttattatgtcaactagttgtacatggctttttaaaagttaatgattattttgtaattagaaaaaaatagtacgtaccagggtaggaatttgggaaaatacagaaccgaggagaaaacagaagtctttgcagtagatacagggtgtctcctgaccaagtgaaggattcaggggcggggggtgaatattgcttgacattacccacctatggcatgtgttggatgtcgtgtgattgaaagggggatgcattcccctgtatgcttggaccacagttcagtattcatgtggaataacttgcagtgcttaaaatgacaacaggcattcatcacagttatggctcttgcttatgaaggctgtgtcaacttggaagagatttctggggtagacagattttgttcctgtgctggagtctgccacctgctggaggactctgaggccaaaattgcccgtgcagagttgtatagaaaatgcgtctggaggctgggcaaggtggcttacgcctataatcccagcactttgagaggccgaggcgggtggatcagtagaggctaggagtttgagaccagcctggccgatatcgtgaaaccccgtctttaccaaaaaatacaaaaattagcccagtgtggtggcaggcacctgtaatcccagctattagggaggctgaggcaggagaattgtgtgaacccaggaggcagaggttgcagtgagcctagattgtgccactgcctgggcaacagtgagatcctgtctacaaaaaaaaaaaaaaaaaaaagtgcatctggatttttttatacaaccttagaccaccttctttagctttaggcgtctgcggttgcccttggatctgttctcaatcctcagtgtgtgtggcagcatgtggtcatagagagctgggcaaagttcactttctctttgctgacagtctcaccttttctcactgggaagctgcacaggagcctttgggctggttcagcccagaggcccctgttctcctgccttcctggcattctctgctccccttctgcatggcacccctctactcctgccaggttagaatggagcagaggcctttgaacaagatgacatttgtagacaacctgatccatcaggatgtggagagatctggacaaatggcaaataatttggggttgaattatggcccagagaagtaagcaaatgaaaaactaaacaattataaatgtatctgggaagcaaaggtattcataatatgtcccatggccagctgcgagcagtatttaactagacatgctgttgtcaatattgaacatgaatcaagccaaatactgatatagctattgagagaaggttggcaggaagaaatcatgggtgagggtatgtgggagtgataatcttagctatagattttaggtaaaactgattctgaaagctttctttgaaacaaatttataatttttcttctacatgtttctagcacaaggactcaattttttttggttataatgttcattaaaacatatgccttcaatttgttcctctttgttcttttttgctgatttagcagatataaatcacttgttagtatttttaactatccaagttaaaatgtacatttgtaagtgttattactggtcttatatttgaaggtgcaaggggtcttgtgctgctcattactggttatcttgagcatttcataactgctgcctcctcctaaatcctgtgttccaaccgctactgctggcaatgcccagcctccattgtggatgcggggaattgtgttcagcatgcttgcttctgccacggcactaaagcctaacttgcttaggatcttgctgtacttggagagagcatccattcgctgagcctagcagccaggctcttgtgactccctgggaagtgggtgaagacctggctcctggctgcagcagtgaggaggcaggccctccaggtgaagacttctcacaatggagggaaggcagttttctcaaaggaaattgagtgctattatgtactctgcttcctactttctctttcagggtgggaatctgttaagcctcctctctctcttgctctgcaaccacagaacacttctttttttttggtgtctcagttttgcccacactggagtgcagtggtgcaatagtggctcactgcagcctccaactcctgggctcaatctatccttccacctcatgctccccagtagctgggactacaggtgcatgccactgtgcccagctgattattatttttttttgtaaagattgggtcatactacattgctcatgctcgtcttgaacttgtggcctcaagcgatcctcctgcctcagcctcttgagttgttgggattacaggagtgtgccaccatgcccagctctgtggaaaattctctgtggcattctgtctcctgaaaatgctgaagggaccaagagggctctgtgtccttcctcttctcttccctggcactttcagaccattttcttgttgccttcattctaacaaaggttgcagattggaaagctgatttggaatgctttttaagtgttttcagtttcaatatttttatgaaattcctatggtctccaacaaacttttttttttttttttttttctacacctggagcttatcctgcagaagcttcctgccaatgattgttttggaggaaattaaaagaaaaccaaacgaaacctctcctatccaaggggaagaactttatccccatattgattgaatataggattctagatttaaaatgttgtaggcagttagagtttgctctttttttttttctattggaaaggtccacaaatgttttattgacatttttgtctttaatccatttggatttggggtacatgttacgatttgtctacgttaatttcccttttaaaaataaaaataattcctcaactcc

SEQ ID NO: 106384 - DNA, 586 bp, Homo sapiens
  Payload ID: 890
  Gene Symbol: ALDH7A1
  Gene Name: aldehyde dehydrogenase 7 family, member A1
  ENST ID: ENST00000412186
  CDS Start-End: 165-398
tcagccgcaggctcctccggaagaccaggggcagacggggcggtggcggggtcgtgcccagtgggaggggtcgggtctgcccaatgggttctcccgggcggggggcggggctctatttcagcagctctcagggccttgggctcatcccgagtcccgggctcagtatgtggcgccttcctcgcgcgctgtgtgtgcacgctgcaaagaccagcaagctctctggaccttggagcaggcctgccgccttcatgtccactctcctcatcaatcagccccagtatgcgtggctgaaagagctggggctccgcgaggaaaacgagggcgtgtataatggaagctggggaggccggggagagggattacgttttctatacatgatcatcatccttttgttttaaggttattacgacctattgccctgctaacaacgagccaatagcaagagtccgacaggccagtgtggcagactatgaagaaactgtaaagaaagcaagagaagcatggaaaatctgggcagatattcctgctccaaaacgaggagaaatagtaagacagattggcgatgccttgcgggagaagatccaag

SEQ ID NO: 106385 - DNA, 719 bp, Homo sapiens
  Payload ID: 890
  Gene Symbol: ALDH7A1
  Gene Name: aldehyde dehydrogenase 7 family, member A1
  ENST ID: ENST00000510111
  CDS Start-End: 1-719
cgccttcctcgcgcgctgtgtgtgcacgctgcaaagaccagcaagctctctggaccttggagcaggcctgccgccttcatgtccactctcctcatcaatcagccccagtatgcgtggctgaaagagctggggctccgcgaggaaaacgagggcgtgtataatggaagctggggaggccggggagaggttattacgacctattgccctgctaacaacgagccaatagcaagagtccgacaggccagtgtggcagactatgaagaaactgtaaagaaagcaagagaagcatggaaaatctgggcagatgtgtctttggagatggggaaaatcttagtggaaggtgtgggtgaagttcaggagtatgtggatatctgtgactatgctgttggtttatcaaggatgattggaggacctatcttgccttctgaaagatctggccatgcactgattgagcagtggaatcccgtaggcctggttggaatcatcacggcattcaatttccctgtggcagtgtatggttggaacaacgccatcgccatgatctgtggaaatgtctgcctctggaaaggagctccaaccacttccctcattagtgtggctgtcacaaagataatagccaaggttctggaggacaacaagctgcctggtgcaatttgttccttgacttgtggtggagcagatattggcacagcaatggccaaagatgaacgagtgaacct

SEQ ID NO: 106386 - DNA, 1935 bp, Homo sapiens
  Payload ID: 890
  Gene Symbol: ALDH7A1
  Gene Name: aldehyde dehydrogenase 7 family, member A1
  ENST ID: ENST00000553117
  CDS Start-End: 139-1566
aggggcagacggggcggtggcggggtcgtgcccagtgggaggggtcgggtctgcccaatgggttctcccgggcggggggcggggctctatttcagcagctctcagggccttgggctcatcccgagtcccgggctcagtatgtggcgccttcctcgcgcgctgtgtgtgcacgctgcaaagaccagcaagctctctggaccttggagcaggcctgccgccttcatgtccactctcctcatcaatcagccccagtatgcgtggctgaaagagctggggctccgcgaggaaaacgagggcgtgtataatggaagctggggaggccggggagaggttattacgacctattgccctgctaacaacgagccaatagcaagagtccgacaggccagtgtggcagactatgaagaaactgtaaagaaagcaagagaagcatggaaaatctgggcagatattcctgctccaaaacgaggagaaatagtaagacagattggcgatgccttgcgggagaagatccaagtactaggaagcttggtgtctttggagatggggaaaatcttagtggaaggtgtgggtgaagttcaggagtatgtggatatctgtgactatgctgttggtttatcaaggatgattggaggacctatcttgccttctgaaagatctggccatgcactgattgagcagtggaatcccgtaggcctggttggaatcatcacggcattcaatttccctgtggcagtgtatggttggaacaacgccatcgccatgatctgtggaaatgtctgcctctggaaaggagctccaaccacttccctcattagtgtggctgtcacaaagataatagccaaggttctggaggacaacaagctgcctggtgcaatttgttccttgacttgtggtggagcagatattggcacagcaatggccaaagatgaacgagtgaacctgctgtccttcactgggagcactcaggtgggaaaacaggtgggcctgatggtgcaggagaggtttgggagaagtctgttggaacttggaggaaacaatgccattattgcctttgaagatgcagacctcagcttagttgttccatcagctctcttcgctgctgtgggaacagctggccagaggtgtaccactgcgaggcgactggttatggatcgccctggaaattatgtagaaccgacaattgtgacaggtcttggccacgatgcgtccattgcacacacagagacttttgctccgattctctatgtctttaaattcaagaatgaagaagaggtctttgcatggaataatgaagtaaaacagggactttcaagtagcatctttaccaaagatctgggcagaatctttcgctggcttggacctaaaggatcagactgtggcattgtaaatgtcaacattccaacaagtggggctgagattggaggtgcctttggaggagaaaagcacactggtggtggcagggagtctggcagtgatgcctggaaacagtacatgagaaggtctacttgtactatcaactacagtaaagaccttcctctggcccaaggaatcaagtttcagtaaaggtgttttagatgaacatcccttaatttgaggtgttccagcagctgtttttggagaagacaaagaaaattaaagttttccctgaataaatgcattattatgactgtgacagtgactaatccccctatgaccccaaagccctgattaaatcaagagattccttttttaaaaatcaaaataaaattgttacaacatagccatagttactaaaagatgagttaggtggatttttattatgtcaactagttgtacatggctttttaaaagttaatgattattttgtaattagaaaaaaatagtacgtaccagggtaggaatttgggaaaatacagaaccgaggagaaaacagaagtctttgcagtagataca

SEQ ID NO: 106387 - DNA, 446 bp, Homo sapiens
  Payload ID: 890
  Gene Symbol: ALDH7A1
  Gene Name: aldehyde dehydrogenase 7 family, member A1
  ENST ID: ENST00000509270
  CDS Start-End: 22-446
atcccgagtcccgggctcagtatgtggcgccttcctcgcgcgctgtgtgtgcacgctgcaaagaccagcaagctctctggaccttggagcaggcctgccgccttcatgtccactctcctcatcaatcagccccagtatgcgtggctgaaagagctggggctccgcgaggaaaacgagggcgtgtataatggaagctggggaggccggggagagattcctgctccaaaacgaggagaaatagtaagacagattggcgatgccttgcgggagaagatccaagtactaggaagcttggtgtctttggagatggggaaaatcttagtggaaggtgtgggtgaagttcaggagtatgtggatatctgtgactatgctgttggtttatcaaggatgattggaggacctatcttgccttctgaaagatctggccatgcactgattgagcagtg

SEQ ID NO: 106388 - DNA, 970 bp, Homo sapiens
  Payload ID: 890
  Gene Symbol: ALDH7A1
  Gene Name: aldehyde dehydrogenase 7 family, member A1
  ENST ID: ENST00000413020
  CDS Start-End: 21-905
tcccgagtcccgggctcagtatgtggcgccttcctcgcgcgctgtgtgtgcacgctgcaaagaccagcaagctctctggaccttggagcaggcctgccgccttcatgtccactctcctcatcaatcagccccagtatgcgtggctgaaagagctggggctccgcgaggaaaacgagggcgtgtataatggaagctggggaggccggggagaggttattacgacctattgccctgctaacaacgagccaatagcaagagtccgacaggccagtgtggcagactatgaagaaactgtaaagaaagcaagagaagcatggaaaatctgggcagatattcctgctccaaaacgaggagaaatagtaagacagattggcgatgccttgcgggagaagatccaagtactaggaagcttggtgtctttggagatggggaaaatcttagtggaaggtgtgggtgaagttcaggagtatgtggatatctgtgactatgctgttggtttatcaaggatgattggaggacctatcttgccttctgaaagatctggccatgcactgattgagcagtggaatcccgtaggcctggttggaatcatcacggcattcaatttccctgtggcagtgtatggttggaacaacgccatcgccatgatctgtggaaatgtctgcctctggaaaggagctccaaccacttccctcattagtgtggctgtcacaaagataatagccaaggttctggaggacaacaagctgcctggtgcaatttgttccttgacttgtggtggagcagatattggcacagcaatggccaaagatgaacgagtgaacctgctgtccttcactgggagcactcaggtgggaaaacaggtgggcctgatggtgcaggagaggtttgagcaatggaaatgagaagatactctgctgttgtcacatatgctcctgatatcacaaatgaataaaagttattcacatgg

SEQ ID NO: 106389 - DNA, 526 bp, Homo sapiens
  Payload ID: 890
  Gene Symbol: ALDH7A1
  Gene Name: aldehyde dehydrogenase 7 family, member A1
  ENST ID: ENST00000509459
  CDS Start-End: 1-83
aagagctggggctccgcgaggaaaacgagggcgtgtataatggaagctggggaggccggggagaggatctggccatgcactgattgagcagtggaatcccgtaggcctggttggaatcatcacggcattcaatttccctgtggcagtgtatggttggaacaacgccatcgccatgatctgtggaaatgtctgcctctggaaaggagctccaaccacttccctcattagtgtggctgtcacaaagataatagccaaggttctggaggacaacaagctgcctggtgcaatttgttccttgacttgtggtggagcagatattggcacagcaatggccaaagatgaacgagtgaacctgctgtccttcactgggagcactcaggtgggaaaacaggtgggcctgatggtgcaggagaggtttgggagaagtctgttggaacttggaggaaacaatgccattattgctctcttcgctgctgtgggaacagctggccagaggtgtaccactgcgaggcgactgtttatacat

SEQ ID NO: 106390 - DNA, 906 bp, Homo sapiens
  Payload ID: 890
  Gene Symbol: ALDH7A1
  Gene Name: aldehyde dehydrogenase 7 family, member A1
  ENST ID: ENST00000503281
  CDS Start-End: 1-124
gtccactctcctcatcaatcagccccagtatgcgtggctgaaagagctggggctccgcgaggaaaacgagggcgtgtataatggaagctggggaggccggggagaggatctggccatgcactgattgagcagtggaatcccgtaggcctggttggaatcatcacggcattcaatttccctgtggcagtgtatggttggaacaacgccatcgccatgatctgtggaaatgtctgcctctggaaaggagctccaaccacttccctcattagtgtggctgtcacaaagataatagccaaggttctggaggacaacaagctgcctggtgcaatttgttccttgacttgtggtggagcagatattggcacagcaatggccaaagatgaacgagtgaacctgctgtccttcactgggagcactcaggtgggaaaacaggtgggcctgatggtgcaggagaggtttgggagaagtctgttggaacttggaggaaacaatgccattattgcctttgaagatgcagacctcagcttagttgttccatcagctctcttcgctgctgtgggaacagctggccagaggtgtaccactgcgaggcgactgtttatacatgaaagcatccatgatgaggttgtaaacagacttaaaaaggcctatgcacagatccgagttgggaacccatgggaccctaatgttctctatgggccactccacaccaagcaggcagtgagcatgtttcttggagcagtggaagaagcaaagaaagaaggtggcacagtggtctatgggggcaaggttatggatcgccctggaaattatgtagaaccgacaattgtgacaggtcttggccacgatgcgtccattgcacacacagagacttttgctccgattctctatgtctttaaattcaag

SEQ ID NO: 106391 - DNA, 2558 bp, Homo sapiens
  Payload ID: 891
  Gene Symbol: ALDH8A1
  Gene Name: aldehyde dehydrogenase 8 family, member A1
  Uniprot ID: Q9H2A2
  ENST ID: ENST00000265605
  CDS Start-End: 70-1533
agtccagacagtggtggggacaacctgagtgctcagtcgtaaagaggaaaggcagaatttttccttgctatggctggaacaaacgcacttttgatgctggaaaacttcatagatggaaaatttttaccttgtagctcatatatagattcttacgacccatcaacaggggaagtgtattgcagagtgccaaatagtggaaaagacgagatcgaagccgcggtcaaggccgccagagaagcctttcccagctggtcatcccgcagcccccaggagcgctcacgggtcctgaaccaggtggcggatttgctggagcagtccctggaggagtttgcccaggccgagtctaaagaccaagggaaaaccttagcactggcaagaaccatggacattccccggtctgtgcagaacttcaggttcttcgcttcctccagcctgcaccacacgtcagagtgcacgcagatggaccacctgggctgcatgcactacacggtgcgggccccggtgggagtcgctggtctgatcagcccctggaatttgccactctacttgctgacctggaagatagctccagcgatggctgcagggaacactgtgatagccaagcccagtgagctgacttcagtgactgcgtggatgttgtgcaaactcctggataaagcaggtgttccaccaggtgtggtcaatattgtgtttggaaccgggcccagggtgggtgaggccctggtgtcccacccagaggtgcccctgatctccttcaccgggagccagcccaccgctgagcggatcacccagctgagcgctccccactgcaaaaagctctccctggagctggggggcaagaatcctgccatcatctttgaggacgccaacctggatgagtgcattccggcaaccgtcaggtccagctttgccaaccagggtgaaatctgtctctgtaccagcaggatctttgtccagaagagcatctatagtgaatttttaaagagatttgtagaagctaccagaaagtggaaagtcggcattccctctgatccactggtgagcataggtgctctgataagtaaagcacatttggagaaagtcagaagttacgtcaagagagctcttgctgaaggtgcccaaatttggtgcggtgagggagtggataagttgagcctccctgccaggaaccaggcaggctactttatgcttcccacggtgataacagacattaaggatgaatcctgctgcatgacggaagagatatttggtccagtgacgtgtgtcgtcccctttgatagtgaagaggaggtgattgaaagagccaacaacgttaagtatgggctggcggctaccgtgtggtccagcaatgtggggcgcgtccaccgggtggctaagaagctgcagtctggcttggtctggaccaactgctggctcatcagggagctgaaccttcctttcggggggatgaagagttctggaataggtagagagggagccaaggactcttacgacttcttcactgagatcaaaaccatcaccgttaaacactgatctttgctaatggtggagccactatggccaatgcctggctgcaggcatcagttgttcaatgtggtagatgaaaatcatggcatgaattccagctatgccttgacttggcagaaggttatctctagcttatcctcagttcttagtaactttacccactagtgaagagatactgtctattttcaatgtggactcggaaaaaaagacttataagtaggaagatagaacaatgatgccagttgtcaggctcctcccaggttatgttttcatagtgtttctttcatcatcttcattgaactcttgggaatctccagataatcagattatttcatttggtaaattttaaaaaatatgcaatcaggcacagtgcctcatgcctataatcccagcactttgggaggccaaggtgggtggatcacttgagttcaggagttcgagatcagcctaggcaacatggtgaaatcctgtctttaccaaaagtttaaaaattagcttggtgtggtgccctctgcctatagccccagctacttgggaggctgaggtgggaggatcgcttgagcccaggcggttgaggctgcagtgagccatgatcattccactgcatttcagcctgggggatacagtgagaccttgtctttaaaaaaaaaatgctgcaaaaccaaaaataaatagccataatttgccatctttggagagattatggagataatctccttgtctattagccactagcatggctaattgatcattgattggacctcattacataagggggctgtggacgtctttggaatttgttaggggaaggctatgtggtaagctctactaaatgtatctgtacaaggatgaagaaaaacaaaataactactacttttggaggaaacttggaacaagaagagtacatagtttgatccattcctacggtcgagtctaatcaattccatttcttagtgtatgcatctaatgaggcttacaacttgctaaccccaaaagaagcaataaatgttaagcaattttagtaaccagta

SEQ ID NO: 106392 - DNA, 1634 bp, Homo sapiens
  Payload ID: 891
  Gene Symbol: ALDH8A1
  Gene Name: aldehyde dehydrogenase 8 family, member A1
  Uniprot ID: Q9H2A2
  ENST ID: ENST00000349305
  CDS Start-End: 37-519
cagtcgtaaagaggaaaggcagaatttttccttgctatggctggaacaaacgcacttttgatgctggaaaacttcatagatggaaaatttttaccttgtagctcatatatagattcttacgacccatcaacaggggaagtgtattgcagagtgccaaatagtggaaaagacgagatcgaagccgcggtcaaggccgccagagaagcctttcccagctggtcatcccgcagcccccaggagcgctcacgggtcctgaaccaggtggcggatttgctggagcagtccctggaggagtttgcccaggccgagtctaaagaccaagggaaaaccttagcactggcaagaaccatggacattccccggtctgtgcagaacttcaggttcttcgcttcctccagcctgcaccacacgtcagagtgcacgcagatggaccacctgggctgcatgcactacacggtgcgggccccggtgggagtcgttccagggtacacgtgcaggacgtgcaggtttgttacatagctggtctgatcagcccctggaatttgccactctacttgctgacctggaagatagctccagcgatggctgcagggaacactgtgatagccaagcccagtgagctgacttcagtgactgcgtggatgttgtgcaaactcctggataaagcaggtgttccaccaggtgtggtcaatattgtgtttggaaccgggcccagggtgggtgaggccctggtgtcccacccagaggtgcccctgatctccttcaccgggagccagcccaccgctgagcggatcacccagctgagcgctccccactgcaaaaagctctccctggagctggggggcaagaatcctgccatcatctttgaggacgccaacctggatgagtgcattccggcaaccgtcaggtccagctttgccaaccaggtcagaagttacgtcaagagagctcttgctgaaggtgcccaaatttggtgcggtgagggagtggataagttgagcctccctgccaggaaccaggcaggctactttatgcttcccacggtgataacagacattaaggatgaatcctgctgcatgacggaagagatatttggtccagtgacgtgtgtcgtcccctttgatagtgaagaggaggtgattgaaagagccaacaacgttaagtatgggctggcggctaccgtgtggtccagcaatgtggggcgcgtccaccgggtggctaagaagctgcagtctggcttggtctggaccaactgctggctcatcagggagctgaaccttcctttcggggggatgaagagttctggaataggtagagagggagccaaggactcttacgacttcttcactgagatcaaaaccatcaccgttaaacactgatctttgctaatggtggagccactatggccaatgcctggctgcaggcatcagttgttcaatgtggtagatgaaaatcatggcatgaattccagctatgccttgacttggcagaaggttatctctagcttatcctcagttcttagtaactttacccactagtgaagagatactgtctattttcaatgtggactcggaaaaaaagacttataagtaggaagatagaacaatgatgccagttgtcaggctcctcccagg

SEQ ID NO: 106393 - DNA, 2383 bp, Homo sapiens
  Payload ID: 891
  Gene Symbol: ALDH8A1
  Gene Name: aldehyde dehydrogenase 8 family, member A1
  Uniprot ID: Q9H2A2
  ENST ID: ENST00000367845
  CDS Start-End: 63-1364
acagtggtggggacaacctgagtgctcagtcgtaaagaggaaaggcagaatttttccttgctatggctggaacaaacgcacttttgatgctggaaaacttcatagatggaaaatttttaccttgtagctcatatatagattcttacgacccatcaacaggggaagtgtattgcagagtgccaaatagtggaaaagacgagatcgaagccgcggtcaaggccgccagagaagcctttcccagctggtcatcccgcagcccccaggagcgctcacgggtcctgaaccaggtggcggatttgctggagcagtccctggaggagtttgcccaggccgagtctaaagaccaagggaaaaccttagcactggcaagaaccatggacattccccggtctgtgcagaacttcaggttcttcgcttcctccagcctgcaccacacgtcagagtgcacgcagatggaccacctgggctgcatgcactacacggtgcgggccccggtgggagtcgctggtctgatcagcccctggaatttgccactctacttgctgacctggaagatagctccagcgatggctgcagggaacactgtgatagccaagcccagtgagctgacttcagtgactgcgtggatgttgtgcaaactcctggataaagcaggtgttccaccaggtgtggtcaatattgtgtttggaaccgggcccagggtgggtgaggccctggtgtcccacccagaggtgcccctgatctccttcaccgggagccagcccaccgctgagcggatcacccagctgagcgctccccactgcaaaaagctctccctggagctggggggcaagaatcctgccatcatctttgaggacgccaacctggatgagtgcattccggcaaccgtcaggtccagctttgccaaccaggtcagaagttacgtcaagagagctcttgctgaaggtgcccaaatttggtgcggtgagggagtggataagttgagcctccctgccaggaaccaggcaggctactttatgcttcccacggtgataacagacattaaggatgaatcctgctgcatgacggaagagatatttggtccagtgacgtgtgtcgtcccctttgatagtgaagaggaggtgattgaaagagccaacaacgttaagtatgggctggcggctaccgtgtggtccagcaatgtggggcgcgtccaccgggtggctaagaagctgcagtctggcttggtctggaccaactgctggctcatcagggagctgaaccttcctttcggggggatgaagagttctggaataggtagagagggagccaaggactcttacgacttcttcactgagatcaaaaccatcaccgttaaacactgatctttgctaatggtggagccactatggccaatgcctggctgcaggcatcagttgttcaatgtggtagatgaaaatcatggcatgaattccagctatgccttgacttggcagaaggttatctctagcttatcctcagttcttagtaactttacccactagtgaagagatactgtctattttcaatgtggactcggaaaaaaagacttataagtaggaagatagaacaatgatgccagttgtcaggctcctcccaggttatgttttcatagtgtttctttcatcatcttcattgaactcttgggaatctccagataatcagattatttcatttggtaaattttaaaaaatatgcaatcaggcacagtgcctcatgcctataatcccagcactttgggaggccaaggtgggtggatcacttgagttcaggagttcgagatcagcctaggcaacatggtgaaatcctgtctttaccaaaagtttaaaaattagcttggtgtggtgccctctgcctatagccccagctacttgggaggctgaggtgggaggatcgcttgagcccaggcggttgaggctgcagtgagccatgatcattccactgcatttcagcctgggggatacagtgagaccttgtctttaaaaaaaaaatgctgcaaaaccaaaaataaatagccataatttgccatctttggagagattatggagataatctccttgtctattagccactagcatggctaattgatcattgattggacctcattacataagggggctgtggacgtctttggaatttgttaggggaaggctatgtggtaagctctactaaatgtatctgtacaaggatgaagaaaaacaaaataactactacttttggaggaaacttggaacaagaagagtacatagtttgatccattcctacggtcgagtctaatcaattccatttcttagtgtatgcatctaatgaggcttacaacttgctaaccccaaaagaagcaataaatgttaagcaattttagtaa

SEQ ID NO: 106394 - DNA, 1587 bp, Homo sapiens
  Payload ID: 891
  Gene Symbol: ALDH8A1
  Gene Name: aldehyde dehydrogenase 8 family, member A1
  Uniprot ID: Q9H2A2
  ENST ID: ENST00000367847
  CDS Start-End: 32-1345
gtaaagaggaaaggcagaatttttccttgctatggctggaacaaacgcacttttgatgctggaaaacttcatagatggaaaatttttaccttgtagctcatatatagattcttacgacccatcaacaggggaagtgtattgcagagtgccaaatagtggaaaagacgagatcgaagccgcggtcaaggccgccagagaagcctttcccagctggtcatcccgcagcccccaggagcgctcacgggtcctgaaccaggtggcggatttgctggagcagtccctggaggagtttgcccaggccgagtctaaagaccaagggaaaaccttagcactggcaagaaccatggacattccccggtctgtgcagaacttcaggttcttcgcttcctccagcctgcaccacacgtcagagtgcacgcagatggaccacctgggctgcatgcactacacggtgcgggccccggtgggagtcggtgttccaccaggtgtggtcaatattgtgtttggaaccgggcccagggtgggtgaggccctggtgtcccacccagaggtgcccctgatctccttcaccgggagccagcccaccgctgagcggatcacccagctgagcgctccccactgcaaaaagctctccctggagctggggggcaagaatcctgccatcatctttgaggacgccaacctggatgagtgcattccggcaaccgtcaggtccagctttgccaaccagggtgaaatctgtctctgtaccagcaggatctttgtccagaagagcatctatagtgaatttttaaagagatttgtagaagctaccagaaagtggaaagtcggcattccctctgatccactggtgagcataggtgctctgataagtaaagcacatttggagaaagtcagaagttacgtcaagagagctcttgctgaaggtgcccaaatttggtgcggtgagggagtggataagttgagcctccctgccaggaaccaggcaggctactttatgcttcccacggtgataacagacattaaggatgaatcctgctgcatgacggaagagatatttggtccagtgacgtgtgtcgtcccctttgatagtgaagaggaggtgattgaaagagccaacaacgttaagtatgggctggcggctaccgtgtggtccagcaatgtggggcgcgtccaccgggtggctaagaagctgcagtctggcttggtctggaccaactgctggctcatcagggagctgaaccttcctttcggggggatgaagagttctggaataggtagagagggagccaaggactcttacgacttcttcactgagatcaaaaccatcaccgttaaacactgatctttgctaatggtggagccactatggccaatgcctggctgcaggcatcagttgttcaatgtggtagatgaaaatcatggcatgaattccagctatgccttgacttggcagaaggttatctctagcttatcctcagttcttagtaactttacccactagtgaagagatactgtctattttcaatgtggactcggaaaaaaagacttataagtaggaagatagaacaatgatgccagttgtca

SEQ ID NO: 106395 - DNA, 489 bp, Homo sapiens
  Payload ID: 891
  Gene Symbol: ALDH8A1
  Gene Name: aldehyde dehydrogenase 8 family, member A1
  ENST ID: ENST00000534012
  CDS Start-End: 444-489
attagctgggcatggtggcacatgcctgtaatcccagctgctcaggaggctgaggtgggagaatcacttgaaccccggaggcagaggttgcagtgagccaaaattgcgccactgccctccaggctgggctacagagtgagaatccatctaaaaaacaaaacaaaacaaaacaaaaatgaggtgtgtggagacctgaggattctggttttgtccatcccccaaggactaacagctttaaggtgaccctttctcccatttgctcctcaaagatcgaagccgcggtcaaggccgccagagaagcctttcccagctggtcatcccgcagcccccaggagcgctcacgggtcctgaaccaggtggcggatttgctggagcagtccctggaggagtttgcccaggccgagtctaaagaccaagggaaaaccttagcactggcaagaaccatggacattccccggtctgtgcagaacttcaggttcttcgcttcct

SEQ ID NO: 106396 - DNA, 404 bp, Homo sapiens
  Payload ID: 891
  Gene Symbol: ALDH8A1
  Gene Name: aldehyde dehydrogenase 8 family, member A1
  ENST ID: ENST00000460753
  CDS Start-End: 1-404
gaatttttaaagagatttgtagaagctaccagaaagtggaaagtcggcattccctctgatccactggtcagaagttacgtcaagagagctcttgctgaaggtgcccaaatttggtgcggtgagggagtggataagttgagcctccctgccaggaaccaggcaggctactttatgcttcccacggtgataacagacattaaggatgaatcctgctgcatgacggaagagatatttggtccagtgacgtgtgtcgtcccctttgatagtgaagaggaggtgattgaaagagccaacaacgttaagtatgggctggcggctaccgtgtggtccagcaatgtggggcgcgtccaccgggtggctaagaagctgcagtctggcttggtctggaccaactgctggctcat

SEQ ID NO: 106397 - DNA, 2696 bp, Homo sapiens
  Payload ID: 892
  Gene Symbol: ALDH9A1
  Gene Name: aldehyde dehydrogenase 9 family, member A1
  Uniprot ID: P49189
  ENST ID: ENST00000354775
  CDS Start-End: 306-1862
ggatcctaggatgcttacatgcaatgatgaacccgaaaacacttgcaaagtgctacgcaaatattgatcacgaagaaggaagtcctcttcccgcctggagactgtgtggggtatggcggggtggtggggagaatgtggtgtcttgctccaccctcctggcgaggggagggcctggcctggaccgcagaggaatcgagtgactgcccctaaaatctcctagaaccgatcccgcggccccgcccctcccgcggccccgcccctcccgcggcccgtcagcctctgccgcggagctgcgtccgccactcatgtttctccgagcaggcctggccgcgctctccccgcttcttcgcagtcttcggccctctcctgtcgccgccatgagcactggcaccttcgtcgtgtcgcagccgctcaattaccgcggcggggcccgcgtggagccggcggacgcctccggtaccgagaaagctttcgagccagcaaccggccgagtgatagctactttcacatgttcaggagaaaaggaagtaaatttggctgttcaaaatgcaaaggctgcttttaaaatatggagtcaaaaatctggcatggagcgttgccgaatccttttggaggctgccaggataataagggaacgggaggatgaaattgctactatggagtgcatcaacaatggcaagtccatctttgaggcccgcttggacattgacatttcctggcagtgcctggagtattatgcgggcttggctgcatccatggctggtgaacacatccagctcccaggtggatcgtttggttataccagaagagaaccacttggggtatgtgtgggaataggagcatggaactacccctttcagattgcctcttggaagtcggctccagcattagcctgtggtaatgccatggtctttaaaccttctccctttacacctgtttctgcattgctactggctgaaatctacagtgaggctggtgtacctcctgggctcttcaatgtggtgcagggaggggctgccacaggccagtttctgtgtcagcatcccgatgtggccaaagtctccttcactggaagtgtgcccactggcatgaagatcatggagatgtcagctaaaggaatcaaacctgttaccttggaacttggaggcaaatctccactcatcatcttctcagactgtgatatgaacaatgctgtaaagggggcgctgatggccaacttcctcacacaaggccaggtttgctgtaatggcacaagagtatttgtgcagaaagaaattcttgataaatttacagaggaagtggtgaaacagacccaaaggattaaaattggagatccccttctggaagatacaaggatgggtccactcatcaaccgaccacacctggagcgagtccttgggtttgtcaaagtggcaaaggagcagggtgctaaagtgttatgtggtggagatatatatgtacctgaagatcccaaattaaaggatggatattacatgagaccttgtgtattaactaattgcagagacgacatgacctgtgtgaaggaagagatctttgggcctgttatgtccattttatcatttgacactgaagctgaggttctagaaagagccaatgataccacttttggactagcagctggcgtctttaccagggacatccaacgggctcatagagtggtagctgagcttcaggctgggacgtgcttcattaacaactataacgtcagcccagtggagttgccctttggtggatataagaagtcaggatttggcagagagaacggccgtgtgacaatcgaatattattcacagctgaagactgtgtgtgtggagatgggtgatgtggaatctgctttttgaaaacctgcagtgaaacctattgacatggccacgctgtggaatgatgtgaattggccctgtttacagaggcagtacaactgaatgttattttacatccagaattttggcgttcagtataagagaatggttcatgttactctttctctctccatcagcttcctcactgaaaatgtgcattaagtgccttgtagatactaatcaagaaagctgtgattctcctcaaagcgtatttttgtgaaatcttttaagagccagtaacatacttctagagaacaggaaaagagactaggataatacatcttccacacatttggcccactgataatgttaattctctggcgtatttcaaagaacttgttcctggctgatccaagtgcagtggtatttacaactaattgatcacaaccagtttgtagatttctttgttccttctccattcccactgcttcacttgcctagtcttgaagaaaaaaaacaaaaaacaaaaaaaaaccttgttcctttataggttcctggtagaatcagtagagatgatttcagctcattgacatttttttaagctatatccccttgtcattccattgagaaagctgacaactgggatagggaggggattagataatagatggggtcaaattctgtgtgaatgtgaacttgcctagtaagcactttgtctctgttcactactgcgatagaggaaatctatctccctatcttgggtccttgaactacagcctgctgtcttacaccagtggagctaccctttaaatgtacaaattatttgtatgctaatgtaatatggtgaaattaaaataaatcacactgttaattgtt

SEQ ID NO: 106398 - DNA, 580 bp, Homo sapiens
  Payload ID: 893
  Gene Symbol: AOX1
  Gene Name: aldehyde oxidase 1
  ENST ID: ENST00000260930
  CDS Start-End: 1-580
agcaagaatcctaaaggaacttggaaagactgggcacagactgcttttgatgaaagcattaacctttcagctgttggatacttcagaggttatgagtcagacatgaactgggagaaaggcgaaggccagcccttcgaatactttgtttatggagctgcctgttccgaggttgaaatagactgcctgacgggggatcataagaacatcagaacagacattgtcatggatgttggctgcagtataaatccagccattgacataggccagggcattctgcacactcgtggtccagaccaatataaaatccctgccatctgtgacatgcccacggagttgcacattgctttgttgcctccttctcaaaactcaaatactctttattcatctaagggtctgggagagtcgggggtgttcctggggtgttccgtgtttttcgctatccatgacgcagtgagtgcagcacgacaggagagaggcctgcatggacccttgacccttaatagtccactgaccccggagaagattaggatggcctgtgaagacaagttcacaaaaatgattccgagagatgaacctggat

SEQ ID NO: 106399 - DNA, 5074 bp, Homo sapiens
  Payload ID: 893
  Gene Symbol: AOX1
  Gene Name: aldehyde oxidase 1
  Uniprot ID: Q06278
  ENST ID: ENST00000374700
  CDS Start-End: 242-4258
acatagagggcgccagtgacgcccacacacgtgctggtgtcccgggaagagttcctggcaaagagctcaggaacgttggatcttaatcaaggctttctccgtcggggtggatgggttggactttaggctccagcaagccccgccccactcggcgggtcggtgccgccgggtcccaggtgcccgctacttcccagaacctccgcctcccgctccgggccctcgaaccagcgcggacaccacaatggaccgggcgtccgagctgctcttctacgtgaacggccgcaaggtgatagaaaaaaatgtcgatcctgaaacaatgctgttgccttatttgaggaagaagcttcgactcacaggaactaagtatggctgtggaggaggaggctgtggtgcttgtacagtgatgatatcacgatacaaccccatcaccaagaggataaggcatcacccagccaatgcctgtctgattcccatctgttctctgtatggtgctgccgtcaccacagtagaaggcataggaagcacccacaccagaattcatcctgttcaggagaggattgccaagtgtcatggcacccagtgtggcttctgcacacctgggatggtgatgtccatctacacgctgctcaggaaccacccagagcccactctggatcagttaactgatgcccttggtggtaacctgtgccgttgcactggatacaggcccataattgatgcatgcaagactttctgtaaaacttcgggctgctgtcaaagtaaagaaaatggggtttgctgtttggatcaaggaatcaatggattgccagaatttgaggaaggaagtaagacaagtccaaaactcttcgcagaagaggagtttctgccattggatccaacccaggaactgatatttcctcctgagctaatgataatggctgagaaacagtcgcaaaggaccagggtgtttggcagtgagagaatgatgtggttttcccccgtgaccctgaaggaactgctggaatttaaattcaagtatccccaggctcctgttatcatgggaaacacctctgtggggcctgaagtgaaatttaaaggcgtctttcacccagttataatttctcctgatagaattgaagaactgagtgttgtaaaccatgcatataatggactcacccttggtgctggtctcagcctagcccaggtgaaggacattttggctgatgtagtccagaagcttccagaggagaagacacagatgtaccatgctctcctgaagcatttgggaactctggctgggtcccagatcaggaacatggcttctttagggggacacatcattagcaggcatccagattcagatctgaatcccatcctggctgtgggtaactgtaccctcaacttgctatcaaaagaaggaaaacgacagattcctttaaatgagcaattcctcagcaagtgccctaatgcagatcttaagcctcaagaaatcttggtctcagtgaacatcccctactcaaggaagtgggaatttgtgtcagccttccgacaagcccagcgacaggagaatgcgctagcgatagtcaattcaggaatgagagtcttttttggagaaggggatggcattattagagagttatgcatctcatatggaggcgttggtccagccaccatctgtgccaagaattcctgccagaaactcattggaaggcactggaacgaacagatgctggatatagcctgcaggcttattctgaatgaagtctcccttttgggctcggcgccaggtgggaaagtggagttcaagaggactctcatcatcagcttcctcttcaagttctacctggaagtgtcacagattttgaaaaagatggatccagttcactatcctagccttgcagacaagtatgaaagtgctttagaagatcttcattccaaacatcactgcagtacattaaagtaccagaatataggcccaaagcagcatcctgaagacccaattggccaccccatcatgcatctgtctggtgtgaagcatgccacgggggaggccatctactgtgatgacatgcctctggtggaccaggaacttttcttgacttttgtgactagttcaagagctcatgctaagattgtgtctattgatctgtcagaagctctcagcatgcccggtgtggtggacatcatgacagcagaacatcttagtgacgtcaactccttctgcttttttactgaagctgagaaatttctggcgacagataaggtgttctgtgtgggtcagcttgtctgtgctgtgcttgccgattctgaggttcaggcaaagcgagctgctaagcgagtgaagattgtctatcaagacttggagccgctgatactaacaattgaggaaagtatacaacacaactcctccttcaagccagaaaggaaactggaatatggaaatgttgacgaagcatttaaagtggttgatcaaattcttgaaggtgaaatacatatgggaggtcaagaacatttttatatggaaacccaaagcatgcttgtcgttcccaagggagaggatcaagaaatggatgtctacgtgtccacacagtttcccaaatatatacaggacattgttgcctcaaccttgaagctcccagctaacaaggtcatgtgccatgtaaggcgtgttggtggagcgtttggagggaaggtgttaaaaaccggaatcattgcagccgtcactgcatttgccgcaaacaaacatggccgtgcagttcgctgtgttctggaacgaggagaagacatgttaataactggaggccgccatccttaccttggaaagtacaaagctggattcatgaacgatggcagaatcttggccctggacatggagcattacagcaatgcaggcgcctccttggatgaatcattattcgtgatagaaatgggacttctgaaaatggacaatgcttacaagtttcccaatctccgctgccggggttgggcatgcagaaccaaccttccatccaacacagcttttcgtgggtttggctttcctcaggcagcgctgatcaccgaatcttgtatcacggaagttgcagccaaatgtggactatcccctgagaaggtgcgaatcataaacatgtacaaggaaattgatcaaacaccctacaaacaagagatcaatgccaagaacctaatccagtgttggagagaatgtatggccatgtcttcctactccttgaggaaagttgctgtggaaaagttcaatgcagagaattattggaagaagaaaggactggccatggtccccctgaagtttcctgttggccttggctcacgtgctgctggtcaggctgctgccttggttcacatttatcttgatggctctgtgctggtcactcacggtggaattgaaatggggcagggggtccacactaaaatgattcaggtggtcagccgtgaattaagaatgccaatgtcgaatgtccacctgcgtggaacaagcacagaaactgtccctaatgcaaatatctctggaggttctgtggtggcagatctcaacggtttggcagtaaaggatgcctgtcaaactcttctaaaacgcctcgaacccatcatcagcaagaatcctaaaggaacttggaaagactgggcacagactgcttttgatgaaagcattaacctttcagctgttggatacttcagaggttatgagtcagacatgaactgggagaaaggcgaaggccagcccttcgaatactttgtttatggagctgcctgttccgaggttgaaatagactgcctgacgggggatcataagaacatcagaacagacattgtcatggatgttggctgcagtataaatccagccattgacataggccagattgaaggtgcatttattcaaggcatgggactttatacaatagaggaactgaattattctccccagggcattctgcacactcgtggtccagaccaatataaaatccctgccatctgtgacatgcccacggagttgcacattgctttgttgcctccttctcaaaactcaaatactctttattcatctaagggtctgggagagtcgggggtgttcctggggtgttccgtgtttttcgctatccatgacgcagtgagtgcagcacgacaggagagaggcctgcatggacccttgacccttaatagtccactgaccccggagaagattaggatggcctgtgaagacaagttcacaaaaatgattccgagagatgaacctggatcctacgttccttggaatgtacccatctgaatcaaatgcaaacttctggagaaaacagagtgcctcttcccagatggcaatctgtcctatctctgtgctggaagatgctagatctgaaagacagagtttccacagttcagaaatcatcccacagtgttgcttttctatggagctgatttaaagtattccatttagatttgatagatatgcttaagcaatctataaatcattttcaatgttataaacactaattggtttcctctagggtgatatccgtcattactctgtctcttcaatccatccagctaaatggaataggtgatgacttgcatgtgactcctacttggcttctatccaccaacagaaattataccatatagtgaaaggcaattttctaaataatttcattactaatatgaactgtgaagttgtcattttttcatttgtccttttctgctatcaccttcctcttgtcagaatgaatatagacactgtatctaagtgggaccaaagaaaaaatagcgaactttcaccaaagttttcatgaaaacccaaaagctttaaaagttactatcaagaaattgaaaggaaacccacagaataggataaaatatttgtaaatcatatatttgataaaagtcttgtaaccagatacataaagagctcttacaactcaataaaaggcaagtaatttaaaaataggcaaaagaattgctggatggtatggtagttctatttttagtttttaccctaactactctgacttgatcatttaacattctgtgtatgtaacaaaatatcacatgcataaatattatgtatcaataaaattttttaatgggcaaa

SEQ ID NO: 106400 - DNA, 581 bp, Homo sapiens
  Payload ID: 893
  Gene Symbol: AOX1
  Gene Name: aldehyde oxidase 1
  ENST ID: ENST00000454629
  CDS Start-End: 128-581
tttgagcagtgactgggatgcagtgaggagcaagccatgcaaacatctggggagacagcatccaggcagtgggaatggcaggtgcaaaggtcctgaggtgatagaaaaaaatgtcgatcctgaaacaatgctgttgccttatttgaggaagaagcttcgactcacaggaactaagtatggctgtggaggaggaggctgtggtgcttgtacagtgatgatatcacgatacaaccccatcaccaagaggataaggcatcacccagccaatgcctgtctgattcccatctgttctctgtatggtgctgccgtcaccacagtagaaggcataggaagcacccacaccagaattcatcctgttcaggagaggattgccaagtgtcatggcacccagtgtggcttctgcacacctgggatggtgatgtccatctacacgctgctcaggaaccacccagagcccactctggatcagttaactgatgcccttggtggtaacctgtgccgttgcactggatacaggcccataattgatgcatgcaagactttctgtaaaacttcgggctgctgtcaaagtaaagaaaatg

SEQ ID NO: 106401 - DNA, 673 bp, Homo sapiens
  Payload ID: 893
  Gene Symbol: AOX1
  Gene Name: aldehyde oxidase 1
  ENST ID: ENST00000439380
  CDS Start-End: 1-573
tactttgtttatggagctgcctgttccgaggttgaaatagactgcctgacgggggatcataagaacatcagaacagacattgtcatggatgttggctgcagtataaatccagccattgacataggccagattgaaggtgcatttattcaaggcatgggactttatacaatagaggaactgaattattctccccagggcattctgcacactcgtggtccagaccaatataaaatccctgccatctgtgacatgcccacggagttgcacattgctttgttgcctccttctcaaaactcaaatactctttattcatctaagggtctgggagagtcgggggtgttcctggggtgttccgtgtttttcgctatccatgacgcagtgagtgcagcacgacaggagagaggcctgcatggacccttgacccttaatagtccactgaccccggagaagattaggatggcctgtgaagacaagttcacaaaaatgggagcacatggcaagcctgtcaggcggacacaggaacaggtgcttttgatacaacttcacaagattcagccaatgctggtggcataatgtcacattccaaggcgtcagatgaacttggtttgtttgtatgtgaatggaagaacagtaagttttctacattattaataaattcatataaagaaagaaa

SEQ ID NO: 106402 - DNA, 1166 bp, Homo sapiens
  Payload ID: 894
  Gene Symbol: AKR1A1
  Gene Name: aldo-keto reductase family 1, member A1 (aldehyde reductase)
  Uniprot ID: P14550
  ENST ID: ENST00000351829
  CDS Start-End: 96-1073
acttaagctgaggatcgttggatctctggcggggtgcagaactgagcccaggccacagtaccctattcacgctctgtgcttgtgccaagggggcaatggcggcttcctgtgttctactgcacactgggcagaagatgcctctgattggtctgggtacctggaagagtgagcctggtcaggtaaaagcagctgttaagtatgcccttagcgtaggctaccgccacattgattgtgctgctatctacggcaatgagcctgagattggggaggccctgaaggaggacgtgggaccaggcaaggcggtgcctcgggaggagctgtttgtgacatccaagctgtggaacaccaagcaccaccccgaggatgtggagcctgccctccggaagactctggctgacctccagctggagtatctggacctgtacctgatgcactggccttatgcctttgagcggggagacaaccccttccccaagaatgctgatgggactatatgctacgactccacccactacaaggagacttggaaggctctggaggcactggtggctaaggggctggtgcaggcgctgggcctgtccaacttcaacagtcggcagattgatgacatactcagtgtggcctccgtgcgtccagctgtcttgcaggtggaatgccacccatacttggctcaaaatgagctaattgcccactgccaagcacgtggcctggaggtaactgcttatagccctttgggctcctctgatcgtgcatggcgtgatcctgatgagcctgtcctgctggaggaaccagtagtcctggcattggctgaaaagtatggccgatctccagctcagatcttgctcaggtggcaggtccagcggaaagtgatctgcatccccaaaagtatcactccttctcgaatccttcagaacatcaaggtgtttgacttcacctttagcccagaagagatgaagcagctaaatgccctgaacaaaaattggagatatattgtgcctatgcttacggtggatgggaagagagtcccaagggatgcagggcatcctctgtacccctttaatgacccgtactgagaccacagcttcttggcctcccttccagctctgcagctaatgaggtcctgccacaacggaaagagggagttaataaagccattggagcatcca

SEQ ID NO: 106403 - DNA, 1818 bp, Homo sapiens
  Payload ID: 894
  Gene Symbol: AKR1A1
  Gene Name: aldo-keto reductase family 1, member A1 (aldehyde reductase)
  Uniprot ID: P14550
  ENST ID: ENST00000372070
  CDS Start-End: 748-1725
tcttggtgttgcagctgctctctgggcctcagtttgcttgaactaaatgtaacggggccaacttaggtgaactttgggaatccagccaacctgactttagggagagtatggagccacggatggcattgtgaatccggagggccgacaccagaagaacctgcaacgtggcatctgctaccttacttcccccggaaaagcgcctgcggcggcgcctaggcgcgcggtgcaatgtgggccagcaaaaggcgaggctggccccgccccttgcaccgcccacgtggccagcgccacctgcctcattgtgcccaggagttctccaaacccgcgctgcggagtgagtgaccaagttccggccagttcgacctcgaggatccagaggtggagacggtactacctcccagctctgttttccatccccttcaggtccttcctcgggaggcggcgaaggcggtccaccctgcgcgtgatcctttatgcccggcccctgcccctccctccgggtggaacttccccctcaccgccagacttaagctgaggatcgttggatctctggcggggtgcagaactgagcccaggccacagtaccctattcacgctctgtgcttgtgccaaggtttcaagtgatcctcccgcctcagcctgcccaggtgctgagattacatgtatgagccactgcacctggaaaggagccagaaatgtgaagtgctagctgaaggatgagcagcagctagccaggcaaagggggcaatggcggcttcctgtgttctactgcacactgggcagaagatgcctctgattggtctgggtacctggaagagtgagcctggtcaggtaaaagcagctgttaagtatgcccttagcgtaggctaccgccacattgattgtgctgctatctacggcaatgagcctgagattggggaggccctgaaggaggacgtgggaccaggcaaggcggtgcctcgggaggagctgtttgtgacatccaagctgtggaacaccaagcaccaccccgaggatgtggagcctgccctccggaagactctggctgacctccagctggagtatctggacctgtacctgatgcactggccttatgcctttgagcggggagacaaccccttccccaagaatgctgatgggactatatgctacgactccacccactacaaggagacttggaaggctctggaggcactggtggctaaggggctggtgcaggcgctgggcctgtccaacttcaacagtcggcagattgatgacatactcagtgtggcctccgtgcgtccagctgtcttgcaggtggaatgccacccatacttggctcaaaatgagctaattgcccactgccaagcacgtggcctggaggtaactgcttatagccctttgggctcctctgatcgtgcatggcgtgatcctgatgagcctgtcctgctggaggaaccagtagtcctggcattggctgaaaagtatggccgatctccagctcagatcttgctcaggtggcaggtccagcggaaagtgatctgcatccccaaaagtatcactccttctcgaatccttcagaacatcaaggtgtttgacttcacctttagcccagaagagatgaagcagctaaatgccctgaacaaaaattggagatatattgtgcctatgcttacggtggatgggaagagagtcccaagggatgcagggcatcctctgtacccctttaatgacccgtactgagaccacagcttcttggcctcccttccagctctgcagctaatgaggtcctgccacaacggaaagagggagttaataaagccattggagcatcca

SEQ ID NO: 106404 - DNA, 840 bp, Homo sapiens
  Payload ID: 894
  Gene Symbol: AKR1A1
  Gene Name: aldo-keto reductase family 1, member A1 (aldehyde reductase)
  ENST ID: ENST00000434299
  CDS Start-End: 398-840
cccttgcaccgcccacgtggccagcgccacctgcctcattgtgcccaggagttctccaaacccgcgctgcggagtccttcctcgggaggcggcgaaggcggtccaccctgcgcgtgatcctttatgcccggcccctgcccctccctccgggtggaacttccccctcaccgccagacttaagctgaggatcgttggatctctggcggggtgcagaactgagcccaggccacagtaccctattcacgctctgtgcttgtgccaaggtttcaagtgatcctcccgcctcagcctgcccaggtgctgagattacatgtatgagccactgcacctggaaaggagccagaaatgtgaagtgctagctgaaggatgagcagcagctagccaggcaaagggggcaatggcggcttcctgtgttctactgcacactgggcagaagatgcctctgattggtctgggtacctggaagagtgagcctggtcaggtaaaagcagctgttaagtatgcccttagcgtaggctaccgccacattgattgtgctgctatctacggcaatgagcctgagattggggaggccctgaaggaggacgtgggaccaggcaaggcggtgcctcgggaggagctgtttgtgacatccaagctgtggaacaccaagcaccaccccgaggatgtggagcctgccctccggaagactctggctgacctccagctggagtatctggacctgtacctgatgcactggccttatgcctttgagcggggagacaaccccttccccaagaatgctgatgggactatatgctacgactccacccactacaaggagacttggaaggctctgga

SEQ ID NO: 106405 - DNA, 1018 bp, Homo sapiens
  Payload ID: 894
  Gene Symbol: AKR1A1
  Gene Name: aldo-keto reductase family 1, member A1 (aldehyde reductase)
  ENST ID: ENST00000471651
  CDS Start-End: 95-454
cttaagctgaggatcgttggatctctggcggggtgcagaactgagcccaggccacagtaccctattcacgctctgtgcttgtgccaagggggcaatggcggcttcctgtgttctactgcacactgggcagaagatgcctctgattggtctgggtacctggaagagtgagcctggtcaggtaaaagcagctgttaagtatgcccttagcgtaggctaccgccacattgattgtgctgctatctacggcaatgagcctgagattggggaggccctgaaggaggacgtgggaccaggcaaggcggtgcctcgggaggagctgtttgtgacatccaagctgtggaacaccaagcaccaccccgaggatgtggagcctgccctccggaagactctggctgacctccagctggagtatctggacctgtacctgatgcactggccttatgcctttgagtgagccttgccagagcctcatctggggaatcagggggttgagcaggatggtgttagtaacttattgtaagtcacagcagcagagcaggataggaacactcatttgcatgccaagctgaggagcttgacatgggatcttagcctcttctgctacagcagcttagctgtagctacaggagtttaactctggaaaaaggaaggcagtctcacatggtgtgtaccccagggtatgcacctgtaaccctcctgctccctttattcatttagaaaaggtgctgacttttctgttgagcacctggggttacagtaataagtaagtctcagcagaagatgtgagaagagctcaccattagtgccgtgccctgtgctggaagaagggtggataactccctgaggatgagttaaggaagacttcctaggggagaggagatatctacgtctaggaagaggagggggcataggcattccatgtaaacttaacacctgggttacgatctggaaggatgaaaaagcatggctttttttggccaggcgcggtggctcacgcctgtaatcccagcactttggg

SEQ ID NO: 106406 - DNA, 516 bp, Homo sapiens
  Payload ID: 894
  Gene Symbol: AKR1A1
  Gene Name: aldo-keto reductase family 1, member A1 (aldehyde reductase)
  ENST ID: ENST00000481885
  CDS Start-End: 96-516
acttaagctgaggatcgttggatctctggcggggtgcagaactgagcccaggccacagtaccctattcacgctctgtgcttgtgccaagggggcaatggcggcttcctgtgttctactgcacactgggcagaagatgcctctgattggtctgggtacctggaagagtgagcctggtcaggtaaaagcagctgttaagtatgcccttagcgtaggctaccgccacattgattgtgctgctatctacggcaatgagcctgagattggggaggccctgaaggaggacgtgggaccaggcaaggcggtgcctcgggaggagctgtttgtgacatccaagctgtggaacaccaagcaccaccccgaggatgtggagcctgccctccggaagactctggctgacctccagctggagtatctggacctgtacctgatgcactggccttatgcctttgagtggggctgtctctcactcaggcggggagacaaccccttccccaagaatgctgatgggactatat

SEQ ID NO: 106407 - DNA, 1360 bp, Homo sapiens
  Payload ID: 894
  Gene Symbol: AKR1A1
  Gene Name: aldo-keto reductase family 1, member A1 (aldehyde reductase)
  Uniprot ID: P14550
  ENST ID: ENST00000621846
  CDS Start-End: 291-1268
aaaaggcgaggctggccccgccccttgcaccgcccacgtggccagcgccacctgcctcattgtgcccaggagttctccaaacccgcgctgcggagtccttcctcgggaggcggcgaaggcggtccaccctgcgcgtgatcctttatgcccggcccctgcccctccctccgggtggaacttccccctcaccgccagacttaagctgaggatcgttggatctctggcggggtgcagaactgagcccaggccacagtaccctattcacgctctgtgcttgtgccaagggggcaatggcggcttcctgtgttctactgcacactgggcagaagatgcctctgattggtctgggtacctggaagagtgagcctggtcaggtaaaagcagctgttaagtatgcccttagcgtaggctaccgccacattgattgtgctgctatctacggcaatgagcctgagattggggaggccctgaaggaggacgtgggaccaggcaaggcggtgcctcgggaggagctgtttgtgacatccaagctgtggaacaccaagcaccaccccgaggatgtggagcctgccctccggaagactctggctgacctccagctggagtatctggacctgtacctgatgcactggccttatgcctttgagcggggagacaaccccttccccaagaatgctgatgggactatatgctacgactccacccactacaaggagacttggaaggctctggaggcactggtggctaaggggctggtgcaggcgctgggcctgtccaacttcaacagtcggcagattgatgacatactcagtgtggcctccgtgcgtccagctgtcttgcaggtggaatgccacccatacttggctcaaaatgagctaattgcccactgccaagcacgtggcctggaggtaactgcttatagccctttgggctcctctgatcgtgcatggcgtgatcctgatgagcctgtcctgctggaggaaccagtagtcctggcattggctgaaaagtatggccgatctccagctcagatcttgctcaggtggcaggtccagcggaaagtgatctgcatccccaaaagtatcactccttctcgaatccttcagaacatcaaggtgtttgacttcacctttagcccagaagagatgaagcagctaaatgccctgaacaaaaattggagatatattgtgcctatgcttacggtggatgggaagagagtcccaagggatgcagggcatcctctgtacccctttaatgacccgtactgagaccacagcttcttggcctcccttccagctctgcagctaatgaggtcctgccacaacggaaagagggagttaataaagccattggagcatcc

SEQ ID NO: 106408 - DNA, 1409 bp, Homo sapiens
  Payload ID: 895
  Gene Symbol: AKR1B1
  Gene Name: aldo-keto reductase family 1, member B1 (aldose reductase)
  Uniprot ID: P15121
  ENST ID: ENST00000285930
  CDS Start-End: 81-1031
gacctcacgggctatttaaaggtacgcgccgcggccaaggccgcaccgtactgggcgggggtctggggagcgcagcagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcggctctcctgacaggccctgggccaagcccgaggacccttctctcctggaggatcccaggatcaaggcgatcgcagccaagcacaataaaactacagcccaggtcctgatccggttccccatgcagaggaacttggtggtgatccccaagtctgtgacaccagaacgcattgctgagaactttaaggtctttgactttgaactgagcagccaggatatgaccaccttactcagctacaacaggaactggagggtctgtgccttgttgagctgtacctcccacaaggattaccccttccatgaagagttttgaagctgtggttgcctgctcgtccccaagtgacctatacctgtgtttcttgcctcatttttttccttgcaaatgtagtatggcctgtgtcactcagcagtgggacagcaacctgtagagtggccagcgagggcgtgtctagcttgatgttggatctcaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttctctttgcctcaaataaaaagtgcttttgtgagcttgg

SEQ ID NO: 106409 - DNA, 521 bp, Homo sapiens
  Payload ID: 895
  Gene Symbol: AKR1B1
  Gene Name: aldo-keto reductase family 1, member B1 (aldose reductase)
  ENST ID: ENST00000426422
  CDS Start-End: 37-345
accgtactgggcgggggtctggggagcgcagcagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagccaggaagctgccttgtggctggcaatgatgacatgtgccctctcgctggcttagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcgg

SEQ ID NO: 106410 - DNA, 1852 bp, Homo sapiens
  Payload ID: 895
  Gene Symbol: AKR1B1
  Gene Name: aldo-keto reductase family 1, member B1 (aldose reductase)
  ENST ID: ENST00000434222
  CDS Start-End: 41-832
ccgcaccgtactgggcgggggtctggggagcgcagcagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcggctctcctgacaggccctgggccaagcccgaggacccttctctcctggaggatcccaggatcaaggcgatcgcagccaagcacaataaaactacagcccaggtacagccacttcaggtgttgctgaccgtccacaactgcctgcattcctgacagtcctgttagccaagaggaggaagtgactgagcctgttacaccctcacaggaagtatggttaggggtcctcaagtacagagtggaaagggcacagatcggggttttagaagactctggcatgggctcttagattaatagtgcctgcccccactactgcaagggtgactgccacgagggccagcgcttgttcattcatgtggaacctcatctgtacaaatgtaagagctcttagccgtgcagggaatgttctttctcctgagtggtagtgtgcatttctagccagtggagggcctcatgtggtctcatgatatgcctgagacactgaagcgtgtggcacagtggctagcgcaggactctggagtcagatctggacctgaatgcgtcgcctacctgttgctagctgtgacctgacatcttggagcccctctctgatcacctgtggagttctagcacgtccttctgcaggtcctgatccggttccccatgcagaggaacttggtggtgatccccaagtctgtgacaccagaacgcattgctgagaactttaaggtctttgactttgaactgagcagccaggatatgaccaccttactcagctacaacaggaactggagggtctgtgccttgttgagctgtacctcccacaaggattaccccttccatgaagagttttgaagctgtggttgcctgctcgtccccaagtgacctatacctgtgtttcttgcctcatttttttccttgcaaatgtagtatggcctgtgtcactcagcagtgggacagcaacctgtagagtggccagcgagggcgtgtctagcttgatgttggatctcaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttct

SEQ ID NO: 106411 - DNA, 1590 bp, Homo sapiens
  Payload ID: 896
  Gene Symbol: AKR1B10
  Gene Name: aldo-keto reductase family 1, member B10 (aldose reductase)
  Uniprot ID: O60218
  ENST ID: ENST00000359579
  CDS Start-End: 321-1271
acagtagctcacacctgtaatcccagcactttggaaggccgaggtgggcggatcacctgagctcaggagtttgagaccagcctgtctctactaacaatataaaaattagctgggagtcacggtgggcgcctgtaatcccagctactcgggaggctgaggcaggagaattgcttgaacccaggagacagaggttgtagtgagctgagatcgcaccactgcactctagccttggcaacagtgcaagactgtctcaaaaacagcaacagagagcaggacgtgagacttctacctgctcactcagaatcatttctgcaccaaccatggccacgtttgtggagctcagtaccaaagccaagatgcccattgtgggcctgggcacttggaagtctcctcttggcaaagtgaaagaagcagtgaaggtggccattgatgcaggatatcggcacattgactgtgcctatgtctatcagaatgaacatgaagtgggggaagccatccaagagaagatccaagagaaggctgtgaagcgggaggacctgttcatcgtcagcaagttgtggcccactttctttgagagaccccttgtgaggaaagcctttgagaagaccctcaaggacctgaagctgagctatctggacgtctatcttattcactggccacagggattcaagtctggggatgaccttttccccaaagatgataaaggtaatgccatcggtggaaaagcaacgttcttggatgcctgggaggccatggaggagctggtggatgaggggctggtgaaagcccttggggtctccaatttcagccacttccagatcgagaagctcttgaacaaacctggactgaaatataaaccagtgactaaccaggttgagtgtcacccatacctcacacaggagaaactgatccagtactgccactccaagggcatcaccgttacggcctacagccccctgggctctccggatagaccttgggccaagccagaagacccttccctgctggaggatcccaagattaaggagattgctgcaaagcacaaaaaaaccgcagcccaggttctgatccgtttccatatccagaggaatgtgattgtcatccccaagtctgtgacaccagcacgcattgttgagaacattcaggtctttgactttaaattgagtgatgaggagatggcaaccatactcagcttcaacagaaactggagggcctgtaacgtgttgcaatcctctcatttggaagactatcccttcaatgcagaatattgaggttgaatctcctggtgagattatacaggagattctctttcttcgctgaagtgtgactacctccactcatgtcccattttagccaagcttatttaagatcacagtgaacttagtcctgttatagacgagaatcgaggtgctgttttagacatttatttctgtatgttcaactaggatcagaatatcacagaaaagcatggcttgaataaggaaatgacaattttttccacttatctgatcagaacaaatgtttattaagcatcagaaactctgccaacactgaggatgtaaagatcaataaaaaaaataataatcataa

SEQ ID NO: 106412 - DNA, 1621 bp, Homo sapiens
  Payload ID: 897
  Gene Symbol: AKR1B15
  Gene Name: aldo-keto reductase family 1, member B15
  Uniprot ID: C9JRZ8
  ENST ID: ENST00000457545
  CDS Start-End: 261-1295
cctgaagacgttccagggctccacaggccactgtcttctggaggggaacggatcgactgccggtgcgcccagccaaattcaactcctgagtcctcagtctctagtcccgggaaggtttcaccgagctgccctactccttgtaccccttctagctggccttagcatagctacgtcagcagctattggcacgactgccctgattcaaggagaaactggactaatatcactatctcaacaggatcgaggccatcaagctacagatggtcttacaaatggaaccccaagtgaactcaactaacaacttccaccaaggacccctggaccaacccgttggccctttgactggcctaaagagttcccttctgaaggacactacaagtgcagggccccttcttcgcccctatccagcatctcttctcggcaaagtgaaagaagcggtgaaggtggccattgatgcagaatatcgccacattgactgtgcctatttctatgagaatcaacatgaggtgggagaagccatccaagagaagatccaagagaaggctgtgatgcgggaggacctgttcatcgtcagcaaggtgtggcccactttctttgagagaccccttgtgaggaaagcctttgagaagaccctcaaggacctgaagctgagctatctggacgtctatcttattcactggccacagggattcaagactggggatgactttttccccaaagatgataaaggtaatatgatcagtggaaaaggaacgttcttggatgcctgggaggccatggaggagctggtggacgaggggctggtgaaagcccttggggtctcaaatttcaaccacttccagatcgagaggctcttgaacaaacctggactgaaatataaaccagtgactaaccaggttgagtgtcacccatacctcacgcaggagaaactgatccagtactgccactccaagggcatcaccgttacggcctacagccccctgggctctccggatagaccttgggccaaacctgaggacccttccctgctggaggatcccaagattaaggagattgctgcaaagcacaaaaaaaccacagcccaggttctgatccgtttccatatccagaggaatgtgacagtgatccccaagtctatgacaccagcacacattgttgagaacattcaggtctttgactttaaattgagtgatgaggagatggcaaccatactcagcttcaacagaaactggagggcctttgacttcaaggaattctctcatttggaggactttcccttcgatgcagaatattgaggttgaatctcctggtgagattacacaggggattctctttcttcgctgaagtgtgactgtctccactcaagaactattttagccaagcttatctgagatcacagtgaactttgtcctgttgtagaccagaatggaggtgctgttttagacatgtatttctgtatgttcaactaggataagaatatcacagaaaagcatggcctgaataagcaaatgacaattttttccacttatctgatctgatcaaatgtctgttaagcaccagaaactctgccaacactgaggatgtaaagataaataataaaaaataatgactttaaccaaca

SEQ ID NO: 106413 - DNA, 1035 bp, Homo sapiens
  Payload ID: 897
  Gene Symbol: AKR1B15
  Gene Name: aldo-keto reductase family 1, member B15
  Uniprot ID: C9JRZ8
  ENST ID: ENST00000423958
  CDS Start-End: 1-1035
atggtcttacaaatggaaccccaagtgaactcaactaacaacttccaccaaggacccctggaccaacccgttggccctttgactggcctaaagagttcccttctgaaggacactacaagtgcagggccccttcttcgcccctatccagcatctcttctcggcaaagtgaaagaagcggtgaaggtggccattgatgcagaatatcgccacattgactgtgcctatttctatgagaatcaacatgaggtgggagaagccatccaagagaagatccaagagaaggctgtgatgcgggaggacctgttcatcgtcagcaaggtgtggcccactttctttgagagaccccttgtgaggaaagcctttgagaagaccctcaaggacctgaagctgagctatctggacgtctatcttattcactggccacagggattcaagactggggatgactttttccccaaagatgataaaggtaatatgatcagtggaaaaggaacgttcttggatgcctgggaggccatggaggagctggtggacgaggggctggtgaaagcccttggggtctcaaatttcaaccacttccagatcgagaggctcttgaacaaacctggactgaaatataaaccagtgactaaccaggttgagtgtcacccatacctcacgcaggagaaactgatccagtactgccactccaagggcatcaccgttacggcctacagccccctgggctctccggatagaccttgggccaaacctgaggacccttccctgctggaggatcccaagattaaggagattgctgcaaagcacaaaaaaaccacagcccaggttctgatccgtttccatatccagaggaatgtgacagtgatccccaagtctatgacaccagcacacattgttgagaacattcaggtctttgactttaaattgagtgatgaggagatggcaaccatactcagcttcaacagaaactggagggcctttgacttcaaggaattctctcatttggaggactttcccttcgatgcagaatattga

SEQ ID NO: 106414 - DNA, 858 bp, Homo sapiens
  Payload ID: 898
  Gene Symbol: AKR1C1
  Gene Name: aldo-keto reductase family 1, member C1
  ENST ID: ENST00000380859
  CDS Start-End: 16-633
tgaagattgattgcaatgggagtggtttctctgtttctttgtatagtcgaacagatatttacttcttccaagaagatacaattcagaggaatttttatggcaaaagttcctaaaagtaaagctttagaggccaccaaattggcaattgaagctggcttccgccatattgattctgctcatttatacaataatgaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccagcctagagataattccatcttttccttgagtcctgactggtgattccaggcctccttgatcaaattgactgtccccaaatgttacacacatttcagcattaaagttactacacttttcccagtaaattacatttttttgttttattttatgttttaaaacttagagtcaatcagtgaagatctacagtggaaatacatatgtataaaattagtgaatttggtataatgatacggtgctgtgataatttaataaaagcattgagaaatt

SEQ ID NO: 106415 - DNA, 6705 bp, Homo sapiens
  Payload ID: 898
  Gene Symbol: AKR1C1
  Gene Name: aldo-keto reductase family 1, member C1
  Uniprot ID: Q04828
  ENST ID: ENST00000380872
  CDS Start-End: 193-1164
ttttcttaggtaagaaacggttgaactggatgcaatttttatcacagcttgtgtaagactgcctctgtccctcctctcacatgccattggttaaccagcagacagtgtgctcaggggcgttgccagctcattgctcttatagcctgtgagggaggaagaaagaaacatttgccagccaggctagtgacagaaatggattcgaaatatcagtgtgtgaagctgaatgatggtcacttcatgcctgtcctgggatttggcacctatgcgcctgcagaggttcctaaaagtaaagctttagaggccaccaaattggcaattgaagctggcttccgccatattgattctgctcatttatacaataatgaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggtgatttcagcaagctacagcaaagcccattggccagaaaggaaagacaataattttgttttttcattttgaaaaaattaaatgctctctcctaaagattcttcacctactttggtctccataacttctatgttttctttccttctgacacactagtgcccctaaattgtgatttgcctatacgtttagggccggggttggaagatgttaacaaccatttaagattcatttctgcagtgggagtgggtggagtttcaccctctgggaaaggggcaggtgacaggtatttatcagtcagtgcctctctagctcttgtaggaagaagcacacgcaggatggagtctagaggatgagcgatattgactagcaattcatgggctccctccagcagtgcgagggtcagagtttctggagccttgggaggaggcatccctgtgagggggggttagggagatgggagggcaccaggaaaagtgattagaagtcaggtatgggaaggctaaataggacagagtcgagtacatctctgcttggaaaaacatatcaacacccttttttttgaacattatatcttgctcataaaagaaaactttccacattgttttaacaaaccccacagctgagagtcaggcctgaatctttgatgtgtgcccattcacaacgttgaccctattggtttgtggtggggcagggcatcaaagacatcattgactaatcacattcccctgaatagctcatatttagaaaatattcttagattctaaaaatgtactattaatttgtgatattcagtcttttaaatattttatacattaaacaggcatagttacaaatataaaacaaaaatatcccaaagccattatgcatggcactcaagattaaaatgggaaataatacatctaataaatcaaatgttccaagacttcaaaggtcttttggaaacaggctatgtaaaacagcacactggtttcaaactttggtaaattttaagaacaactcttacaaaggcatttaattcttatacataattttcaggggacctaagttaatcagctaatcatgaagacatgattttcattttagaaaacacttttgaaaacttgggataatctcatgccttaatgatcaaagcattatgagaaggacagtggtttttaacctgggcatatgttctaacacatttactctccactattcgtactctggtagccatgttaaccccatcagagattccttctcaagccatgtctcagagctgagaggcatcccagcaagttttgcagctcacagttttttccgtaaattacttattctataaaattggagtaggccataaactttggagggccctagaccaattttttggattatttttcgtcttctatcattccgctgatcttagatattctctgcattaaatattaaatatcacttctaggctgaaaaatccccctaaaaatatttctagctcagatttttcctccaaattctgcaatagaagatcacaatgtgaactctgcatctccatgttaaagtctaatggacattcacacttagcatgtctcaaagaaatctcatgtaaaccatggccatcctgttctaccttaactttctgagtctatggaatgataatttcacatctcataaacttgactgatgtaagtgtcaagaaaagattgacattttgttaaaagttagtagtgaagtgtgtaacgcttaagcaaactttcatatttcaaatctctttagcaagtgtaactcttttttcaagatgtgaaataatcattaggtcagtcatttgtaaatagtacatctgctatggactttttccagttcttcaccatccatttttataaaactcttattgttaaaaaaaaagttactcagaatttcataaagccaaacacctgatttcaggaacacttgagatgtaagaaaattttatagggacctccaatcactaattttcctattttttctctcaaagaaatgctgaagggaggaattcaggttgaatgaaaggaaatagtaacttacagccatatagagttataaagacttcttgtaaatgtgaacatatggtaaaatataaaaacatgtatttttgaaattttggattctactcattattttacttcaatttaagatataaatgtatagaaataagtataattctaagctaatacgtatgcaatgtaggaagctgtaattactgaccaaaactatgtgaagtggagaaaacctggggaagtggatggttttagatgaaactgaagttaaattcatattgatttaaagtaaattgttataactttataaagtttttcatcatcaccacagcaatcacaaagagaataattatgaatatacgcaagaggaaatgagaagggaatccaaatgtcattaaaaaaaaatcacgccacctcacaaaatggtaacagtggatataaaggatagaaagctataaacctggtaggaaaacattgaaaatggcacaagtgactccttccctgtcaccaatgacagtcatgtgttgcataatgcctgggctatcttctgagaatggctttgttaggcaactgtgtcatggtggggacatgatagcattagagagaattctctcaaacactgtcatggccttatcaactatgcttctgtaatattctgaatccttcgctgcctttccaacagtgtttacaacggtttcctaagaaatgaaatccatttcaccaaaccacttttcttgctcatccataagaaacacttctcctttgttaaaattacatcatgagattgcaagcattcagtaacttgcaagctccaatttgaattctagttgtcttgctatttccaccacatctgcaattactttctccactgaaatcttgcattcctccaagtcatccaggagggttgaattcacttctttcaaactcctgttcaagtaaatgttttgccctcctgtcacgaatcatgaatgtttttaatggcatctagaatagtaaatctttttcagaagattttcaattttcttttcccaggttcttcagacaagtcaccatggtagctgtagacttatgaaatgtatttcctgaaccataaaacaagaacatcaaaattactctatgatccatgggaaacagaatgcatgttgtgttagcaggcatggaaagaacagtaatctctttcaacctctgtaagagagttcttggttgattaggtaccttgtcgataggcagttctaatttcaaagaactttttcttttgctgagcagtaagtcttaacagtgggcttaaaatattcagtaaaccattatttaaggagatgtggcttaaatatctaggctttcttgctttatttatagaacacttacagagtagatatagattaaatcttaaggaccctaggattgttagaatagtaaatgaacatcatatgttgtaatatagttagccagggaggggaaagatctctacaagaaataattttaaaaactactcaaagaaatcagagatatcacaaaatgacaaaacaagtacaggggcagcaaaaggtaacagatgtcaactatgagatctcatcaagaactaagaaaatggagaaaagtaccagatggcagatgggaggcagtgtgagcatgcctctcccacttggagattagtgtgtagagatttacattgtgaatttcttttcaagaaccaatgcagagacttaacagatatatgaaaaaatttcacatacactctgaagaagtctcaggcacaatcctactccatgaaataagaaaaaaccatcacatccccagattctgaggggagagagttcactccagagcatacatccccactggggatctggaaattcaggccacaagagaaggctttgatcctgtgcggacaagtgccttgagcagaatccacaggggagagctggaagtgcatggcagatatgagcacagaagctgggtgtccagccttgtgggcagaccgggagggatgtggcctgaaagccatggttattatctcagcgtgtaagctgatgatctgaggctggtcagagttctgtgcgcagactgcctggatgtaaacctggcactgttagcagagcactgcatgaatgaaaggaatgaaaatagccttgccaactgcataggtgctgggtgaggctcactgtggggggcgcacggcaagctattcaacattacgtacaggcatttgaggtcggggcatggaaaaatactgaggcagtgtgtgtatgttatttgtgctgagaatgaaactccttgaccttgaaaacaggacagggagtggtgtgtgtgctgtgataaggaatgctgaaaacggtctcctgagaatgcggtttgagtgcttttacaaggccacaggtgtctcacgacctgacctcataaagccatctagtggatgtttgtggcttaacaagccccttcaataagtacttggcggagggatgctggggggaccttcttagaagagctgcgccccacccccctccctggacagcccagctacaattgtctgagaactcactgcaagctgtaagcggcccactacttcccactcccttttttgaactcttctgtgcagcagaggcaattaaactctcctctggaacattaccccagcagcctgagaaccaccccttggcgctcacaggggctgcagcctgccttatccaaggacagttagagtgcagacccacctaaccctggacccactggtggtacccatccacccatcctggtagcttaacacaaagatacacttttaggagcttcatagcccctcttcccccattgcctgagaaaccactttccctgggcaacttagggcaagctcaaatcccactgctaccaccacagctggtgctcttttgcaagtgccacctcctagctggagaccaaccagcacagtccacacagcacctcaaggaagaataaatagaactgttcccaggaaggagaaaatgcctgcatgagctcagctgttaccactgcgtaccacaccctgaccagtcagaggtcttgagtcggtccgcatgacaagttcaccgctcgcataaccagcattcaagaaagccagcacactaagcctatctacagccagggagtctcagagtctacgtcactcccctgccacctcaatcagagctggtgctggtatccactgctgggagacttgtgctgaggtgaagcctgggctggatggctggaggatgaagaactgcacggaggagatggaggcacccagacagatgccccatggacatcctgaagcagagctgcctcactgccctgcacacacatgagagcgcagccaggaacagaaggactgggcaacattcaggcggagcccaggccaattttctaaacatggaatatgagttaaataaatggcttcgtattaaa

SEQ ID NO: 106416 - DNA, 994 bp, Homo sapiens
  Payload ID: 898
  Gene Symbol: AKR1C1
  Gene Name: aldo-keto reductase family 1, member C1
  ENST ID: ENST00000434459
  CDS Start-End: 1-975
atggattcgaaatatcagtgtgtgaagctgaatgatggtcacttcatgcctgtcctgggatttggcacctatgcgcctgcagaggttcctaaaagtaaagctttagaggccaccaaattggcaattgaagctggcttccgccatattgattctgctcatttatacaataatgaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggtgatggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatgtattttgctagccaccctaattatccatattcagatgaatattaacatggagggctttgcctga

SEQ ID NO: 106417 - DNA, 744 bp, Homo sapiens
  Payload ID: 898
  Gene Symbol: AKR1C1
  Gene Name: aldo-keto reductase family 1, member C1
  ENST ID: ENST00000442997
  CDS Start-End: 1-744
attcgaaatatcagtgtgtgaagctgaatgatggtcacttcatgcctgtcctgggatttggcacctatgcgcctgcagaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgc

SEQ ID NO: 106418 - DNA, 3756 bp, Homo sapiens
  Payload ID: 899
  Gene Symbol: AKR1C2
  Gene Name: aldo-keto reductase family 1, member C2
  Uniprot ID: P52895
  ENST ID: ENST00000380753
  CDS Start-End: 189-1160
ttttcttaggtaagaaacggttgaactggatgcaatttttatcacagcttgtgtaagactgcctctgtccctcctctcacatgccattggttaaccagcagacagtgtgctcaggggcgttgccagctcattgctcttatagcctgtgagggaggaagaaacatttgctaaccaggccagtgacagaaatggattcgaaataccagtgtgtgaagctgaatgatggtcacttcatgcctgtcctgggatttggcacctatgcgcctgcagaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggcgacttcagtaagctacagctaagcccatcggccggaaaagaaagacaataattttgtttttcattttgaaaaaattaaatgctctctcctaaagattcttcacctactttggtctccataacttctatgttttctctccttctgacacactagtgcccccaaattgtgatttgcctatacgtttagggccggggttggaagatgttaacaaccatttaagattcatttctgcagtgggagtgggtggagtttcaccctctgggaaaggggcaggtgacaggtatttatcagtcagtgcctctctagctcttgtaggaagaagcacacgcaggatggagtctagaggatgagcgatattgactagcaattcatgggctccctccagcagtgcgagggtcagagtttctggagccttgggaggaggcatccctgtgagggggggttagggagatgggagggcaccaggaaaagtgattagaagtcaggtatgggaaggctaaataggacagagtcgagtacatctctgcttggaaaaacatatcaacacccttttttttgatcattatatcttgttcataaaagaaaactttccacattgttttaacaaaccccacagctgagagtcaggcctgaatctttgatgtgtgcccattcacaacgttgaccctattggtttgtggtggggcaggacatcgaagatatcattgactcatcacattcccctgaatagctcatatttagaaaatattcttagattgtaaaaatgtactgttcatttgttatatgcaatcttttaaatgttttatactttaaacaaggcatagttacaagtataaaacataaatatcccaaagccattatgcatggcactcaagattaaaatgggaaataatacatctaataaatcaaatgttccaagacttcaaatgtcttttggaaacaggctatgtaaaacagcacactggtttcaaactttggtaaattttaagaagaactcttacaaaggcatttaattcttatacataattttcaggggaactaatcaaatcagctaatcatgaagacatgattttcgttttagaaaacacttttgaaaacttgggataatctcatgtcttaatgatcaaagcattatgagaaggacagtggttttttacctgggcacactttctaacacatttactctccactattcgtactctggtagccatgttaaccccatcagagattccttctcaagccatgtctcagagctgataggcatcccagcaagttttgcagctcacaatttttctgtaaattacttattctataaaattggaagaggccataaactttggagggccctagaccaattttttggattatttctggtctactctcattccgttgatgatcttagatattctctgcattaaatatcacctctaggctgagaaatccaccaaaaaatatttctagctcagcgttttcctccaaatcttcaatggaagatcataatgtgaactctgcatctccatgttaaagtttaatggacattcacacttagcatgtctcaaagaaatctcatgtaaaccatggccatcctgttctaccttaactttctgagtctatggaatgataatttcacatctcataaacttgactgatgtaagtgtcaagaaaagattgacattttgttaaaacttcgtagccaagtgtgtaacgcttaagcagactttcatatttcaaatctctatagcacgtgtaactcttttttcaagatgtgaaataatcattaggtcagtcatttgtaaatagtacggctgctgtgggctttttccagttcttcaccatccatttttataaaactcttattgttaaaaaaaaaaagttactcagaatttcataaagccaaacacctgatttcaggaacacttgagatgtaagaaaattttatagggacctccaatcactaattttcctattttttctctcaaagaaatgctgaagggaggaattcaggttgaatgaaaggaaatagtaacttacagccatatagagttataaagacttcttgtaaatgtgaacatatggtaaaatataaaaacatgtatttttgaaattttggattctactcattattttacttcaatttaagatataaatgtatagaaataagtataattctaagctaatacgtatgcaatgtaggaagctgtaattactgaccaaaactatgtgaagtggagaaaacctggggaagtggatggttttagatgaaactgaagttaaattcatattgatttaaagtaaattgtcataactttataaagtttttcatcatcaccacagcaatcacaaagagaataattatgaatatacgcaagaggaaatgagaagggaatccaaatgtcattaaaaaaaaatcacgccacctcacaaaatggtaacagtggatataaaggatagaaagctataaacctggtaggaaaacatt

SEQ ID NO: 106419 - DNA, 991 bp, Homo sapiens
  Payload ID: 899
  Gene Symbol: AKR1C2
  Gene Name: aldo-keto reductase family 1, member C2
  ENST ID: ENST00000407674
  CDS Start-End: 1-972
atggatcccaaatatcagtgtgtggagctaaatgatggtcatttcatgcctgtattaggatttggcacctgtgtacctccagaggttcctaggaatagagttgtggaggttacaaaattagcaatagaagctggtttcttccatattgattctgctcatttatacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatattcttgctggccaccctgattatccattttcaggtgaatattaacatggaggactttgtatga

SEQ ID NO: 106420 - DNA, 1481 bp, Homo sapiens
  Payload ID: 899
  Gene Symbol: AKR1C2
  Gene Name: aldo-keto reductase family 1, member C2
  ENST ID: ENST00000421196
  CDS Start-End: 26-919
tttgctaaccaggccagtgacagaaatggattcgaaataccagtgtgtgaagctgaatgatggtcacttcatgcctgtcctgggatttggcacctatgcgcctgcagaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggcgacttcagtaagctacagctaagcccatcggccggaaaagaaagacaataattttgtttttcattttgaaaaaattaaatgctctctcctaaagattcttcacctactttggtctccataacttctatgttttctctccttctgacacactagtgcccccaaattgtgatttgcctatacgtttagggccggggttggaagatgttaacaaccatttaagattcatttctgcagtgggagtgggtggagtttcaccctctgggaaaggggcaggtgacaggtatttatcagtcagtgcctctctagctcttgtaggaagaagcacacgcaggatggagtctagaggatgagcgatattgactagcaattcatgggctccctccagcagtgcgagggtcagagtttctggagccttgggaggaggcatccctgtgagggggggtta

SEQ ID NO: 106421 - DNA, 1098 bp, Homo sapiens
  Payload ID: 899
  Gene Symbol: AKR1C2
  Gene Name: aldo-keto reductase family 1, member C2
  Uniprot ID: P52895
  ENST ID: ENST00000455190
  CDS Start-End: 180-599
gtaagaaacggttgaactggatgcaatttttatcacagcttgtgtaagactgcctctgtccctcctctcacatgccattggttaaccagcagacagtgtgctcaggggcgttgccagctcattgctcttatagcctgtgagggaggaagaaacatttgctaaccaggccagtgacagaaatggattcgaaataccagtgtgtgaagctgaatgatggtcacttcatgcctgtcctgggatttggcacctatgcgcctgcagaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaaggaggacatagggattttaacatggaagaagagccctaaacataactcctaattcctttctatggaacagaaagcaattttgaatccatacttccgtgattgcatgtctacaagaaaagagagtgcagaatcctcaaagcctctgcctcaaaaacttgaggaaatgacaatcatctccttgaaggcacaaggtcttatttatgattcctgatttcacctcttgggatgttcacagacacagagtttcatgaagctgtggtgtccagaaaacctgctgcacatagggtgcacaatgagtttccatcttcttgcctcttttcaaggggcaagaactcagtccgggaatgtcttaaactacaaaccttcatgggaaaccttgttgcttctgcttcctctcttttcacactggaggttttatttttgcttagccatgaattcttgtgtcattcataacttttgtcttaaggtactgaaaactagtcaggctagttaatgcaaaagggtatattagatatgataatgggaaatcaaagccagggctacattaagaa

SEQ ID NO: 106422 - DNA, 745 bp, Homo sapiens
  Payload ID: 899
  Gene Symbol: AKR1C2
  Gene Name: aldo-keto reductase family 1, member C2
  ENST ID: ENST00000604507
  CDS Start-End: 144-745
tctcctgccagccaagtgaagacatgcttacttccccttcaccttccttcatgatgacagtgtgctcaggggcgttgccagctcattgctcttatagcctgtgagggaggaagaaacatttgctaaccaggccagtgacagaaatggattcgaaataccagtgtgtgaagctgaatgatggtcacttcatgcctgtcctgggatttggcacctatgcgcctgcagaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaa

SEQ ID NO: 106423 - DNA, 1807 bp, Homo sapiens
  Payload ID: 900
  Gene Symbol: AKR1C3
  Gene Name: aldo-keto reductase family 1, member C3
  Uniprot ID: P42330
  ENST ID: ENST00000380554
  CDS Start-End: 653-1624
ccctcatcaggattacagctttatcaggactgcatcttcttcagaaatgaatatttctcttacaacgcaaagaaagaaaaatcaaaataaattttctgattgaaaatgtaaaaaggcaaatatttttacagttttaactttaattttttattgaggaccaactatttgaaaaattctcattagtcattcctttaaattatgtgtatgtgagagaaagacgtaagatggttaattatttcaaatgatgcagtataaagaaggggcattatcacggcagaaacgaaaaaagatatttgtagctggaggtttttatagtctaacatatggttgctatttgttctacaaatccttttgaataatttaatatagagatttagaatagaaaataatactttagatagaaattaatgagtttattataaccatatattataataatttacttaggaattctctttgataagaaacaaatgaactgaatgcaattttctccacagaccatataagactgcctatgtacctcctcctacatgccattggttaaccatcagtcagtttgcaggggtggggggaggggtttcctgcccattgtttttgtaatctctgaggagaagcagcagcaaacatttgctagtcagacaagtgacagggaatggattccaaacaccagtgtgtaaagctaaatgatggccacttcatgcctgtattgggatttggcacctatgcacctccagaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaagaaagctcaattggactatgttgacctctatcttattcattctccaatgtctctaaagccaggtgaggaactttcaccaacagatgaaaatggaaaagtaatatttgacatagtggatctctgtaccacctgggaggccatggagaagtgtaaggatgcaggattggccaagtccattggggtgtcaaacttcaaccgcaggcagctggagatgatcctcaacaagccaggactcaagtacaagcctgtctgcaaccaggtagaatgtcatccgtatttcaaccggagtaaattgctagatttctgcaagtcgaaagatattgttctggttgcctatagtgctctgggatctcaacgagacaaacgatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtttttgagttccagttgactgcagaggacatgaaagccatagatggcctagacagaaatctccactattttaacagtgatagttttgctagccaccctaattatccatattcagatgaatattaacatggagggctttgcctgatgtctaccagaagccctgtgtgtggatggtgacgcagaggacgtctctatgccggtgactggacatatcacctctacttaaatccgtcctgtttagcgacttcagtcaactacagctgagtccataggccagaaagacaataaatttttatcattttgaaataa

SEQ ID NO: 106424 - DNA, 636 bp, Homo sapiens
  Payload ID: 900
  Gene Symbol: AKR1C3
  Gene Name: aldo-keto reductase family 1, member C3
  ENST ID: ENST00000602997
  CDS Start-End: 171-636
tgctagccagctgagtgacagtgatggattcaaaacatcagtgtttgaagctaaatgatggtcacttcatgcctgtcctgggatttggcacctatgcacctccagagaatcatctcttttgaaaaatcgattcatcaaatgaatcttcagccaacaactgttcaagaaggatgcaaatatcacaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaagaaagctcaattggactatgttgacctctatcttattcattctccaatgtctctaaagccaggtgaggaactttcaccaacagatgaaaatggaaaagtaatatttgacatagtggatctctgtaccacctgggaggccatggagaagtgtaaggatgcaggattggccaagtccattggggtgtcaaacttcaaccgcaggcagctggagatgatcctcaaca

SEQ ID NO: 106425 - DNA, 1405 bp, Homo sapiens
  Payload ID: 900
  Gene Symbol: AKR1C3
  Gene Name: aldo-keto reductase family 1, member C3
  ENST ID: ENST00000605149
  CDS Start-End: 326-1228
tttttgctgaacattccccttagtaaaatggcaggatggtttgcttgccattgaaactaaccaaacatttaatccttttccctttagagaaaaaagaaaaaaaaaggtgcagctcactgccagtgcccatttagttttacattaacatgttccttgaggttgaagcaaatctgaccgattttcaatgtaaaaataacatataaaaactgttctcggagttatttctaaacagaactaagatcagaattctttgaatcatcagaatcatctcttttgaaaaatcgattcatcaaatgaatcttcagccaacaactgttcaagaaggatgcaaatatcacaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaagaaagctcaattggactatgttgacctctatcttattcattctccaatgtctctaaagccaggtgaggaactttcaccaacagatgaaaatggaaaagtaatatttgacatagtggatctctgtaccacctgggaggccatggagaagtgtaaggatgcaggattggccaagtccattggggtgtcaaacttcaaccgcaggcagctggagatgatcctcaacaagccaggactcaagtacaagcctgtctgcaaccaggtagaatgtcatccgtatttcaaccggagtaaattgctagatttctgcaagtcgaaagatattgttctggttgcctatagtgctctgggatctcaacgagacaaacgatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtttttgagttccagttgactgcagaggacatgaaagccatagatggcctagacagaaatctccactattttaacagtgatagttttgctagccaccctaattatccatattcagatgaatattaacatggagggctttgcctgatgtctaccagaagccctgtgtgtggatggtgacgcagaggacgtctctatgccggtgactggacatatcacctctacttaaatccgtcctgtttagcgacttcagtcaactacagctgagtccataggccagaaagacaataaatttttatcattttg

SEQ ID NO: 106426 - DNA, 972 bp, Homo sapiens
  Payload ID: 901
  Gene Symbol:
  Gene Name: aldo-keto reductase family 1, member C3 [Source:EntrezGene
  Acc:8644]
  ENST ID: ENST00000439082
  CDS Start-End: 1-972
atggattcaaaacatcagtgtttgaagctaaatgatggtcacttcatgcctgtcctgggatttggcacctatgcacctccagaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaagaaagctcaattggactatgttgacctctatcttattcattctccaatgtctctaaagccaggtgaggaactttcaccaacagatgaaaatggaaaagtaatatttgacatagtggatctctgtaccacctgggaggccatggagaagtgtaaggatgcaggattggccaagtccattggggtgtcaaacttcaaccgcaggcagctggagatgatcctcaacaagccaggactcaagtacaagcctgtctgcaaccaggtagaatgtcatccgtatttcaaccggagtaaattgctagatttctgcaagtcgaaagatattgttctggttgcctatagtgctctgggatctcaacgagacaaacgatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtttttgagttccagttgactgcagaggacatgaaagccatagatggcctagacagaaatctccactattttaacagtgatagttttgctagccaccctaattatccatattcagatgaatattaa

SEQ ID NO: 106427 - DNA, 1192 bp, Homo sapiens
  Payload ID: 902
  Gene Symbol: AKR1C4
  Gene Name: aldo-keto reductase family 1, member C4
  Uniprot ID: P17516
  ENST ID: ENST00000263126
  CDS Start-End: 34-1005
acaggatctgcttagtgaaagaagtggcaagcaatggatcccaaatatcagcgtgtagagctaaatgatggtcacttcatgcccgtattgggatttggcacctatgcacctccagaggttccgaggaacagagctgtagaggtcaccaaattagcaatagaagctggcttccgccatattgattctgcttatttatacaataatgaggagcaggttggactggccatccgaagcaagattgcagatggcagtgtgaagagagaagacatattctacacttcaaagctttggtgcactttctttcaaccacagatggtccaaccagccttggaaagctcactgaaaaaacttcaactggactatgttgacctctatcttcttcatttcccaatggctctcaagccaggtgagacgccactaccaaaagatgaaaatggaaaagtaatattcgacacagtggatctctctgccacatgggaggtcatggagaagtgtaaggatgcaggattggccaagtccatcggggtgtcaaacttcaactgcaggcagctggagatgatcctcaacaagccaggactcaagtacaagcctgtctgcaaccaggtagaatgtcatccttacctcaaccagagcaaactgctggatttctgcaagtcaaaagacattgttctggttgcccacagtgctctgggaacccaacgacataaactatgggtggacccaaactccccagttcttttggaggacccagttctttgtgccttagcaaagaaacacaaacaaaccccagccctgattgccctgcgctaccagctgcagcgtggggttgtggtcctggccaagagctacaatgagcagcggatcagagagaacatccaggtttttgaattccagttgacatcagaggatatgaaagttctagatggtctaaacagaaattatcgatatgttgtcatggattttcttatggaccatcctgattatccattttcagatgaatattagcatagagggtgttgcacgacatctagcagaaggccctgtgtgtggatggtgatgcagaggatgtctctatgctggtgactggacacacagcctctggttaaatccctcccctcctgcttggcaacttcagctagctagatatatccatggtccagaaagcaaacataataaatttttatcttgaagt

SEQ ID NO: 106428 - DNA, 1414 bp, Homo sapiens
  Payload ID: 902
  Gene Symbol: AKR1C4
  Gene Name: aldo-keto reductase family 1, member C4
  Uniprot ID: P17516
  ENST ID: ENST00000380448
  CDS Start-End: 254-1225
aggaagaagtgaatagaagaaaagagggtgttgcaaatcaaaagcacatagagatatcatcttacaccagtcagaatggctattcttaaaatgtcagacaacaacagatattggattgccacatcatcaggaccacaccttcatcaggaatgaatattcctactacaattaaagaagaaacaaaattaatttgttggtgaaaaacatgttgctgaaggaaacaggatctgcttagtgaaagaagtggcaagcaatggatcccaaatatcagcgtgtagagctaaatgatggtcacttcatgcccgtattgggatttggcacctatgcacctccagaggttccgaggaacagagctgtagaggtcaccaaattagcaatagaagctggcttccgccatattgattctgcttatttatacaataatgaggagcaggttggactggccatccgaagcaagattgcagatggcagtgtgaagagagaagacatattctacacttcaaagctttggtgcactttctttcaaccacagatggtccaaccagccttggaaagctcactgaaaaaacttcaactggactatgttgacctctatcttcttcatttcccaatggctctcaagccaggtgagacgccactaccaaaagatgaaaatggaaaagtaatattcgacacagtggatctctctgccacatgggaggtcatggagaagtgtaaggatgcaggattggccaagtccatcggggtgtcaaacttcaactgcaggcagctggagatgatcctcaacaagccaggactcaagtacaagcctgtctgcaaccaggtagaatgtcatccttacctcaaccagagcaaactgctggatttctgcaagtcaaaagacattgttctggttgcccacagtgctctgggaacccaacgacataaactatgggtggacccaaactccccagttcttttggaggacccagttctttgtgccttagcaaagaaacacaaacaaaccccagccctgattgccctgcgctaccagctgcagcgtggggttgtggtcctggccaagagctacaatgagcagcggatcagagagaacatccaggtttttgaattccagttgacatcagaggatatgaaagttctagatggtctaaacagaaattatcgatatgttgtcatggattttcttatggaccatcctgattatccattttcagatgaatattagcatagagggtgttgcacgacatctagcagaaggccctgtgtgtggatggtgatgcagaggatgtctctatgctggtgactggacacacagcctctggttaaatccctcccctcctgcttggcaacttcagctagctagatatatccatggtccagaaagcaaacataataaatttttatcttgaagtaa

SEQ ID NO: 106429 - DNA, 2347 bp, Homo sapiens
  Payload ID: 903
  Gene Symbol: AKR1D1
  Gene Name: aldo-keto reductase family 1, member D1
  Uniprot ID: P51857
  ENST ID: ENST00000242375
  CDS Start-End: 43-1023
cctgtggtgttcagaatcactcctacagtcaggttctccacaatggatctcagtgctgcaagtcaccgcatacctctaagtgatggaaacagcattcccatcatcggacttggtacctactcagaacctaaatcgacccctaagggagcctgtgcaacatcggtgaaggttgctattgacacagggtaccgacatattgatggggcctacatctaccaaaatgaacacgaagttggggaggccatcagggagaagatagcagaaggaaaggtgcggagggaagatatcttctactgtggaaagctatgggctacaaatcatgtcccagagatggtccgcccaaccctggagaggacactcagggtcctccagctagattatgtggatctttacatcattgaagtacccatggcctttaagccaggagatgaaatataccctagagatgagaatggcaaatggttatatcacaagtcaaatctgtgtgccacttgggaggcgatggaagcttgcaaagacgctggcttggtgaaatccctgggagtgtccaattttaaccgcaggcagctggagctcatcctgaacaagccaggactcaaacacaagccagtcagcaaccaggttgagtgccatccgtatttcacccagccaaaactcttgaaattttgccaacaacatgacattgtcattactgcatatagccctttggggaccagtaggaatccaatctgggtgaatgtttcttctccacctttgttaaaggatgcacttctaaactcattggggaaaaggtacaataagacagcagctcaaattgttttgcgtttcaacatccagcgaggggtggttgtcattcctaaaagctttaatcttgaaaggatcaaagaaaattttcagatctttgacttttctctcactgaagaagaaatgaaggacattgaagccttgaataaaaatgtccgctttgtagaattgctcatgtggcgcgatcatcctgaatacccatttcatgatgaatactgactgcagggagttcctgaacagatttttcactcccacgagtgccaagacggtgcaatgggtagtcccctagatgtgaaaatgaagagagagggttttaccatcctgagaagaaataatgatggaaacatgtttaatgtttgtgcagtgtaaatgactttgactcagtcacattgaagtaaaaatattaaaatctgttgaaataactcttaggaaattatcaactaattttttcagatcagtatcttctagattccagacagaaaaaaattacacttcagaaaagacatcaaaggcaacatatgacaacaagtaatttatgaatctgggtagtagcgttggtaatctgagttctttaagggttaacaggacaacgaagtgcatgtggcagtgtgctggcagtggccttgaggctttggaccattggttacaaaacagacacagccaagataagatccacacacacattattaacaaggaagtgatttgctgcaccttgagttgagagggctacatgtagaaaagtcttaaaatagagctaaacaccacagtggtcaacaaagccatcataatgttggtgtttgtttccctccaatgtatgtatgtttagtttttatccaacctgaggaatgaaaacttaactggatctctcttgcatccttaaagggcctgagtctcaacatggctgctgatccatacttacacatcttactgtcaatcttgcctacattgattatagaaccactattacgtgaaaaggcttgaaacaaccaacatatacaaataaaaccctgccttgtaaaatagtaaaagagaagccatatattggcttttcttcttaacttgggagatatattgaaacaaggtgctttataagattattgtacttaagactttaatagtgttacttggatagcttatatgaattttgagaattttatatgaattttgagaaagcaagttcaaaagaactctggtaattttcctgtatgtacaatttaaagagtgaataagattattagaattcagcaatagagatatatctattttcaattcaactacagaaatatattttattggccgggtgcggtggctcatgcctataatcccagcactttgggaggccaaggtgggcagatcaggaggtcaggagatcgagaccatcttggctaacaaggtgaaaccccgtctctactaaaaatacaaaaaattagccaggcgcggtggcgggggcctgtaatcccagctactcaggaggctgaggcagaagaatggcatgaacccgggaggaggagcttgcagtgagccgagatagcgccactgcagt

SEQ ID NO: 106430 - DNA, 1236 bp, Homo sapiens
  Payload ID: 903
  Gene Symbol: AKR1D1
  Gene Name: aldo-keto reductase family 1, member D1
  Uniprot ID: P51857
  ENST ID: ENST00000432161
  CDS Start-End: 88-960
tttctttgatggaataggccctaggacacctttctaaaaagactccctgtggtgttcagaatcactcctacagtcaggttctccacaatggatctcagtgctgcaagtcaccgcatacctctaagtgatggaaacagcattcccatcatcggacttggtacctactcagaacctaaatcgacccctaagggagcctgtgcaacatcggtgaaggttgctattgacacagggtaccgacatattgatggggcctacatctaccaaaatgaacacgaagttggggaggccatcagggagaagatagcagaaggaaaggtgcggagggaagatatcttctactgtggaaagctatgggctacaaatcatgtcccagagatggtccgcccaaccctggagaggacactcagggtcctccagctagattatgtggatctttacatcattgaagtacccatggcctttaagccaggagatgaaatataccctagagatgagaatggcaaatggttatatcacaagtcaaatctgtgtgccacttgggaggcgatggaagcttgcaaagacgctggcttggtgaaatccctgggagtgtccaattttaaccgcaggcagctggagctcatcctgaacaagccaggactcaaacacaagccagtcagcaaccaggttgagtgccatccgtatttcacccagccaaaactcttgaaattttgccaacaacatgacattgtcattactgcatatagccctttggggaccagtaggaatccaatctgggtgaatgtttcttctccacctttgttaaaggatgcacttctaaactcattggggaaaaggtacaataagacagcagctcaaattgttttgcgtttcaacatccagcgaggggtggttgtcattcctaaaagctttaatcttgaaaggatcaaagaaaattttcaggtggcgcgatcatcctgaatacccatttcatgatgaatactgactgcagggagttcctgaacagatttttcactcccacgagtgccaagacggtgcaatgggtagtcccctagatgtgaaaatgaagagagagggttttaccatcctgagaagaaataatgatggaaacatgtttaatgtttgtgcagtgtaaatgactttgactcagtcacattgaagtaaaaatattaaaatctgttgaaataactcttaggaaattatcaactaattttttcagatcagtatcttctagat

SEQ ID NO: 106431 - DNA, 290 bp, Homo sapiens
  Payload ID: 903
  Gene Symbol: AKR1D1
  Gene Name: aldo-keto reductase family 1, member D1
  ENST ID: ENST00000438242
  CDS Start-End: 2-290
aatggatctcagtgctgcaagtcaccgcatacctctaagtgatggaaacagcattcccatcatcggacttggtacctactcagaacctaaatcgctatgggctacaaatcatgtcccagagatggtccgcccaaccctggagaggacactcagggtcctccagctagattatgtggatctttacatcattgaagtacccatggcctttaagccaggagatgaaatataccctagagatgagaatggcaaatggttatatcacaagtcaaatctgtgtgccacttgggagg

SEQ ID NO: 106432 - DNA, 2234 bp, Homo sapiens
  Payload ID: 903
  Gene Symbol: AKR1D1
  Gene Name: aldo-keto reductase family 1, member D1
  Uniprot ID: P51857
  ENST ID: ENST00000411726
  CDS Start-End: 53-910
aaaaagactccctgtggtgttcagaatcactcctacagtcaggttctccacaatggatctcagtgctgcaagtcaccgcatacctctaagtgatggaaacagcattcccatcatcggacttggtacctactcagaacctaaatcgacccctaagggagcctgtgcaacatcggtgaaggttgctattgacacagggtaccgacatattgatggggcctacatctaccaaaatgaacacgaagttggggaggccatcagggagaagatagcagaaggaaaggtgcggagggaagatatcttctactgtggaaagctatgggctacaaatcatgtcccagagatggtccgcccaaccctggagaggacactcagggtcctccagctagattatgtggatctttacatcattgaagtacccatggcctttaagccaggagatgaaatataccctagagatgagaatggcaaatggttatatcacaagtcaaatctgtgtgccacttgggaggttgagtgccatccgtatttcacccagccaaaactcttgaaattttgccaacaacatgacattgtcattactgcatatagccctttggggaccagtaggaatccaatctgggtgaatgtttcttctccacctttgttaaaggatgcacttctaaactcattggggaaaaggtacaataagacagcagctcaaattgttttgcgtttcaacatccagcgaggggtggttgtcattcctaaaagctttaatcttgaaaggatcaaagaaaattttcagatctttgacttttctctcactgaagaagaaatgaaggacattgaagccttgaataaaaatgtccgctttgtagaattgctcatgtggcgcgatcatcctgaatacccatttcatgatgaatactgactgcagggagttcctgaacagatttttcactcccacgagtgccaagacggtgcaatgggtagtcccctagatgtgaaaatgaagagagagggttttaccatcctgagaagaaataatgatggaaacatgtttaatgtttgtgcagtgtaaatgactttgactcagtcacattgaagtaaaaatattaaaatctgttgaaataactcttaggaaattatcaactaattttttcagatcagtatcttctagattccagacagaaaaaaattacacttcagaaaagacatcaaaggcaacatatgacaacaagtaatttatgaatctgggtagtagcgttggtaatctgagttctttaagggttaacaggacaacgaagtgcatgtggcagtgtgctggcagtggccttgaggctttggaccattggttacaaaacagacacagccaagataagatccacacacacattattaacaaggaagtgatttgctgcaccttgagttgagagggctacatgtagaaaagtcttaaaatagagctaaacaccacagtggtcaacaaagccatcataatgttggtgtttgtttccctccaatgtatgtatgtttagtttttatccaacctgaggaatgaaaacttaactggatctctcttgcatccttaaagggcctgagtctcaacatggctgctgatccatacttacacatcttactgtcaatcttgcctacattgattatagaaccactattacgtgaaaaggcttgaaacaaccaacatatacaaataaaaccctgccttgtaaaatagtaaaagagaagccatatattggcttttcttcttaacttgggagatatattgaaacaaggtgctttataagattattgtacttaagactttaatagtgttacttggatagcttatatgaattttgagaattttatatgaattttgagaaagcaagttcaaaagaactctggtaattttcctgtatgtacaatttaaagagtgaataagattattagaattcagcaatagagatatatctattttcaattcaactacagaaatatattttattggccgggtgcggtggctcatgcctataatcccagcactttgggaggccaaggtgggcagatcaggaggtcaggagatcgagaccatcttggctaacaaggtgaaaccccgtctctactaaaaatacaaaaaattagccaggcgcggtggcgggggcctgtaatcccagctactcaggaggctgaggcagaagaatggcatgaacccgggaggaggagcttgcagtgagccgagatagcgccactgcagt

SEQ ID NO: 106433 - DNA, 1566 bp, Homo sapiens
  Payload ID: 904
  Gene Symbol: AKR1E2
  Gene Name: aldo-keto reductase family 1, member E2
  Uniprot ID: Q96JD6
  ENST ID: ENST00000298375
  CDS Start-End: 72-1034
cagtagctcgcgcggtgcctgtcggtagtcgcgtgcggggcggcggggcggcggggcggccggcggcggccatgggagatatcccagccgtgggcctcagctcctggaaggcttctccagggaaagtgaccgaggcagtgaaagaggccattgacgcagggtaccggcacttcgactgtgcttacttttaccacaatgagagggaggttggagcagggatccgttgcaagatcaaggaaggcgctgtaagacgggaggatctgttcattgccactaagctgtggtgcacctgccataagaagtccttggtggaaacagcatgcagaaagagtctcaaggccttgaagctgaactatttggacctctacctcatacactggcccatgggtttcaagcctcctcatccagaatggatcatgagctgcagtgaactttccttctgcctctcacatcctcgagtgcaggacttgcctctggacgagagcaacatggttattcccagtgacacggacttcctggacacgtgggaggccatggaggacctggtgatcaccgggctggtgaagaacatcggggtgtcaaacttcaaccatgaacagcttgagaggcttttgaataagcctgggttgaggttcaagccactaaccaaccagattgagtgccacccatatcttactcagaagaatctgatcagtttttgccaatccagagatgtgtccgtgactgcttaccgtcctcttggtggctcgtgtgagggggttgacctgatagacaaccctgtgatcaagaggattgcaaaggagcacggcaagtctcctgctcagattttgatccgatttcaaatccagaggaatgtgatagtgatccccggatctatcaccccaagtcacattaaagagaatatccaggtgtttgattttgaattaacacagcacgatatggataacatcctcagcctaaacaggaatctccgactggccatgttccccataactaaaaatcacaaagactatcctttccacatagaatactgaggacgcttccccttccttgtttctgctcagcccagatgcacagacactattggcaatgttgaccctcctctgtcatcacagcgccagggcagctgtgcctgggacaggagccacacagtcagagggggatgtaagagccaccttctctgacaaatctggagaattgagtgtgttctaagtgaaggcaatggggtttctccaagacagcctgtgtggcctctactctgaacaaatacactgatgagtcatcagtgaaatttgccttcacattttaagaaaactttatcttatggagttatttaagccatctacagagctgaggaaacagtgtaatgtgtctctgccccattgcgcagctccacccattgtgccccaggccagcccgcgtcacctacacttccttctgtgccctgccagtgacccccaggttattctaaagcagagtccttcccttcccccagtgagaaggaaaatgggataagtctgggacactgtttcagttcaataaagaggcttttttcttccttaaaaa

SEQ ID NO: 106434 - DNA, 1036 bp, Homo sapiens
  Payload ID: 904
  Gene Symbol: AKR1E2
  Gene Name: aldo-keto reductase family 1, member E2
  Uniprot ID: Q96JD6
  ENST ID: ENST00000334019
  CDS Start-End: 30-821
gcggggcggcggggcggccggcggcggccatgggagatatcccagccgtgggcctcagctcctggaaggcttctccagggaaagtgaccgaggcagtgaaagaggccattgacgcagggtaccggcacttcgactgtgcttacttttaccacaatgagagggaggttggagcagggatccgttgcaagatcaaggaaggcgctgtaagacgggaggatctgttcattgccactaagctgtggtgcacctgccataagaagtccttggtggaaacagcatgcagaaagagtctcaaggccttgaagctgaactatttggacctctacctcatacactggcccatgggtttcaagcctcctcatccagaatggatcatgagctgcagtgaactttccttctgcctctcacatcctcgagtgcaggacttgcctctggacgagagcaacatggttattcccagtgacacggacttcctggacacgtgggaggccatggaggacctggtgatcaccgggctggtgaagaacatcggggtgtcaaacttcaaccatgaacagcttgagaggcttttgaataagcctgggttgaggttcaagccactaaccaaccagattttgatccgatttcaaatccagaggaatgtgatagtgatccccggatctatcaccccaagtcacattaaagagaatatccaggtgtttgattttgaattaacacagcacgatatggataacatcctcagcctaaacaggaatctccgactggccatgttccccataactaaaaatcacaaagactatcctttccacatagaatactgaggacgcttccccttccttgtttctgctcagcccagatgcacagacactattggcaatgttgaccctcctctgtcatcacagcgccagggcagctgtgcctgggacaggagccacacagtcagagggggatgtaagagccaccttctctgacaaatctggagaattgagtgtgttctaagtgaaggcaatggggtttctccaagacagcctgtgtg

SEQ ID NO: 106435 - DNA, 913 bp, Homo sapiens
  Payload ID: 904
  Gene Symbol: AKR1E2
  Gene Name: aldo-keto reductase family 1, member E2
  Uniprot ID: Q96JD6
  ENST ID: ENST00000345253
  CDS Start-End: 30-698
gcggggcggcggggcggccggcggcggccatgggagatatcccagccgtgggcctcagctcctggaaggcttctccagggaaagtgaccgaggcagtgaaagaggccattgacgcagggtaccggcacttcgactgtgcttacttttaccacaatgagagggaggttggagcagggatccgttgcaagatcaaggaaggcgctgtaagacgggaggatctgttcattgccactaagctgtggtgcacctgccataagaagtccttggtggaaacagcatgcagaaagagtctcaaggccttgaagctgaactatttggacctctacctcatacactggcccatgggtttcaagcctcctcatccagaatggatcatgagctgcagtgaactttccttctgcctctcacatcctcgagtgcaggacttgcctctggacgagagcaacatggttattcccagtgacacggacttcctggacacgtgggagattttgatccgatttcaaatccagaggaatgtgatagtgatccccggatctatcaccccaagtcacattaaagagaatatccaggtgtttgattttgaattaacacagcacgatatggataacatcctcagcctaaacaggaatctccgactggccatgttccccataactaaaaatcacaaagactatcctttccacatagaatactgaggacgcttccccttccttgtttctgctcagcccagatgcacagacactattggcaatgttgaccctcctctgtcatcacagcgccagggcagctgtgcctgggacaggagccacacagtcagagggggatgtaagagccaccttctctgacaaatctggagaattgagtgtgttctaagtgaaggcaatggggtttctccaagacagcctgtgtg

SEQ ID NO: 106436 - DNA, 381 bp, Homo sapiens
  Payload ID: 904
  Gene Symbol: AKR1E2
  Gene Name: aldo-keto reductase family 1, member E2
  ENST ID: ENST00000487985
  CDS Start-End: 1-170
gagatgtgtccgtgactgcttaccgtcctcttggtggctcgtgtgagggggttgacctgatagacaaccctgtgatcaagaggattgcaaaggagcacgattttgatccgatttcaaatccagaggaatgtgatagtgatccccggatctatcaccccaagtcacattaaagagaatatccaggtgtttgattttgaattaacacagcacgatatggataacatcctcagcctaaacaggaatctccgactggccatgttccccatgtaaatatggctccttctttttaaaacagagggaagaatatacagattgaatgattggtgtctgaataggtatttatcatacacattttagattaattaaactttctcattataa

SEQ ID NO: 106437 - DNA, 844 bp, Homo sapiens
  Payload ID: 904
  Gene Symbol: AKR1E2
  Gene Name: aldo-keto reductase family 1, member E2
  Uniprot ID: Q96JD6
  ENST ID: ENST00000532248
  CDS Start-End: 30-782
gcggggcggcggggcggccggcggcggccatgggagatatcccagccgtgggcctcagctcctggaaggcttctccagggaaagtgaccgaggcagtgaaagaggccattgacgcagggtaccggcacttcgactgtgcttacttttaccacaatgagagggaggttggagcagggatccgttgcaagatcaaggaaggcgctgtaagacgggaggatctgttcattgccactaagctgtggtgcacctgccataagaagtccttggtggaaacagcatgcagaaagagtctcaaggccttgaagctgaactatttggacctctacctcatacactggcccatgggtttcaagcctcctcatccagaatggatcatgagctgcagtgaactttccttctgcctctcacatcctcgagtgcaggacttgcctctggacgagagcaacatggttattcccagtgacacggacttcctggacacgtgggaggccatggaggacctggtgatcaccgggctggtgaagaacatcggggtgtcaaacttcaaccatgaacagcttgagaggcttttgaataagcctgggttgaggttcaagccactaaccaaccagattttgatccgatttcaaatccagaggaatgtgatagtgatccccggatctatcaccccaagtcacattaaagagaatatccaggtgtttgattttgaattaacacagcacgatatggataacatcctcagcctaaacaggaatctccgactggccatgttccccatgtaaatatggctccttctttttaaaacagagggaagaatatacagattgaatgattggtgtctgaa

SEQ ID NO: 106438 - DNA, 506 bp, Homo sapiens
  Payload ID: 904
  Gene Symbol: AKR1E2
  Gene Name: aldo-keto reductase family 1, member E2
  ENST ID: ENST00000525572
  CDS Start-End: 1-112
gagtctcaaggccttgaagctgaactatttggacctctacctcatacactggcccatgggtttcaaggtaccgttcacctcctcatccagaatggatcatgagctgcagtgaactttccttctgcctctcacatcctcgagtgcaggacttgcctctggacgagagcaacatggttattcccagtgacacggacttcctggacacgtgggaggccatggaggacctggtgatcaccgggctggtgaagaacatcggggtgtcaaacttcaaccatgaacagcttgagaggcttttgaataagcctgggttgaggttcaagccactaaccaaccagattgagtgccacccatatcttactcagaagaatctgatcagtttttgccaatccagagatgtgtccgtgactgcttaccgtcctcttggtggctcgtgtgagggggttgacctgatagacaaccctgtgatcaagaggattgcaaaggagcacggcaagtctcctgctcag

SEQ ID NO: 106439 - DNA, 1626 bp, Homo sapiens
  Payload ID: 904
  Gene Symbol: AKR1E2
  Gene Name: aldo-keto reductase family 1, member E2
  ENST ID: ENST00000474119
  CDS Start-End: 375-986
atgcttccagccattgtcggagtgtcagccgtcacaaggcacttccagccagtcgcaacggcgggtcgccagcgccgcagtagctcgcgcggtgcctgtcggcttctccagggaaagtgaccgaggcagtgaaagaggccattgacgcagggtaccggcacttcgactgtgcttacttttaccacaatgagagggaggttggagcagggatccgttgcaagatcaaggaaggcgctgtaagacgggaggatctgttcattgccactaagctgtggtgcacctgccataagaagtccttggtggaaacagcatgcagaaagagtctcaaggccttgaagctgaactatttggacctctacctcatacactggcccatgggtttcaagcctcctcatccagaatggatcatgagctgcagtgaactttccttctgcctctcacatcctcgagtgcaggacttgcctctggacgagagcaacatggttattcccagtgacacggacttcctggacacgtgggaggccatggaggacctggtgatcaccgggctggtgaagaacatcggggtgtcaaacttcaaccatgaacagcttgagaggcttttgaataagcctgggttgaggttcaagccactaaccaaccagattgagtgccacccatatcttactcagaagaatctgatcagtttttgccaatccagagatgtgtccgtgactgcttaccgtcctcttggtggctcgtgtgagggggttgacctgatagacaaccctgtgatcaagaggattgcaaaggagcacggcaagtctcctgctcagattttgatccgatttcaaatccagaggaatgtgatagtgatccccggatctatcaccccaagtcacattaaagagaatatccaggtgtttgattttgaattaacacagcacgatatggataacatcctcagcctaaacaggaatctccgactggccatgttccccatgtaaatatggctccttctttttaaaacagagggaagaatatacagattgaatgattggtgtctgaatagaactaaaaatcacaaagactatcctttccacatagaatactgaggacgcttccccttccttgtttctgctcagcccagatgcacagacactattggcaatgttgaccctcctctgtcatcacagcgccagggcagctgtgcctgggacaggagccacacagtcagagggggatgtaagagccaccttctctgacaaatctggagaattgagtgtgttctaagtgaaggcaatggggtttctccaagacagcctgtgtggcctctactctgaacaaatacactgatgagtcatcagtgaaatttgccttcacattttaagaaaactttatcttatggagttatttaagccatctacagagctgaggaaacagtgtaatgtgtctctgccccattgcgcagctccacccattgtgccccaggccagcccgcgtcacctacacttccttctgtgccctgccagtgacccccaggttattctaaagcagagtccttcccttcccccagtgagaaggaaaatgggataagtctgggacactgtttcagttcaataaagaggcttttttcttccttaaaaa

SEQ ID NO: 106440 - DNA, 754 bp, Homo sapiens
  Payload ID: 904
  Gene Symbol: AKR1E2
  Gene Name: aldo-keto reductase family 1, member E2
  ENST ID: ENST00000533295
  CDS Start-End: 159-754
cccacagtgaactgtgctctatttactgtacttcccacagttcagtgtccaaactgagcactgttgccgtgaagatgtcagggtgaacgaggagccctgtgatctcctgaggttcaagagagacttcagaagatggtgagctcctgagggcaaggcccatgcaggtcattttcagcactgcaccctggcctaacttgccccgtgcacaggcttctccagggaaagtgaccgaggcagtgaaagaggccattgacgcagggtaccggcacttcgactgtgcttacttttaccacaatgagagggaggttggagcagggatccgttgcaagatcaaggaaggcgctgtaagacgggaggatctgttcattgccactaagctgtggtgcacctgccataagaagtccttggtggaaacagcatgcagaaagagtctcaaggccttgaagctgaactatttggacctctacctcatacactggcccatgggtttcaagcctcctcatccagaatggatcatgagctgcagtgaactttccttctgcctctcacatcctcgagtgcaggacttgcctctggacgagagcaacatggttattcccagtgacacggacttcctggacacgtgggaggccatggaggacctggtgatcaccgggctggtgaagaacatcggggtgtcaaacttcaaccatgaacagcttgagaggcttttgaataagcctgggttgaggttcaagccactaaccaaccaggt

SEQ ID NO: 106441 - DNA, 1655 bp, Homo sapiens
  Payload ID: 904
  Gene Symbol: AKR1E2
  Gene Name: aldo-keto reductase family 1, member E2
  Uniprot ID: Q96JD6
  ENST ID: ENST00000463345
  CDS Start-End: 92-1015
acggcgggtcgccagcgccgcagtagctcgcgcggtgcctgtcggtagtcgcgtgcggggcggcggggcggcggggcggccggcggcggccatgggagatatcccagccgtgggcctcagctcctggaaggcttctccagggaaagtgaccgaggcagtgaaagaggccattgacgcagggtaccggcacttcgactgtgcttacttttaccacaatgagagggaggttggagcagggatccgttgcaagatcaaggaaggcgctgtaagacgggaggatctgttcattgccactaagctgtggtgcacctgccataagaagtccttggtggaaacagcatgcagaaagagtctcaaggccttgaagctgaactatttggacctctacctcatacactggcccatgggtttcaagcctcctcatccagaatggatcatgagctgcagtgaactttccttctgcctctcacatcctcgagtgcaggacttgcctctggacgagagcaacatggttattcccagtgacacggacttcctggacacgtgggaggccatggaggacctggtgatcaccgggctggtgaagaacatcggggtgtcaaacttcaaccatgaacagcttgagaggcttttgaataagcctgggttgaggttcaagccactaaccaaccagattgagtgccacccatatcttactcagaagaatctgatcagtttttgccaatccagagatgtgtccgtgactgcttaccgtcctcttggtggctcgtgtgagggggttgacctgatagacaaccctgtgatcaagaggattgcaaaggagcacggcaagtctcctgctcagattttgatccgatttcaaatccagaggaatgtgatagtgatccccggatctatcaccccaagtcacattaaagagaatatccaggtgtttgattttgaattaacacagcacgatatggataacatcctcagcctaaacaggaatctccgactggccatgttccccatgtaaatatggctccttctttttaaaacagagggaagaatatacagattgaatgattggtgtctgaatagaactaaaaatcacaaagactatcctttccacatagaatactgaggacgcttccccttccttgtttctgctcagcccagatgcacagacactattggcaatgttgaccctcctctgtcatcacagcgccagggcagctgtgcctgggacaggagccacacagtcagagggggatgtaagagccaccttctctgacaaatctggagaattgagtgtgttctaagtgaaggcaatggggtttctccaagacagcctgtgtggcctctactctgaacaaatacactgatgagtcatcagtgaaatttgccttcacattttaagaaaactttatcttatggagttatttaagccatctacagagctgaggaaacagtgtaatgtgtctctgccccattgcgcagctccacccattgtgccccaggccagcccgcgtcacctacacttccttctgtgccctgccagtgacccccaggttattctaaagcagagtccttcccttcccccagtgagaaggaaaatgggataagtctgggacactgtttcagttcaataaagaggcttttttcttccttaaaaa

SEQ ID NO: 106442 - DNA, 1362 bp, Homo sapiens
  Payload ID: 905
  Gene Symbol: AKR7A2
  Gene Name: aldo-keto reductase family 7, member A2
  Uniprot ID: O43488
  ENST ID: ENST00000235835
  CDS Start-End: 23-1102
ccaacgcgcaggcgccgctgctatgctgagtgccgcgtctcgcgtagtctcccgcgccgccgtccactgcgcgcttcgctctccgccgcccgaggcccgcgcgctcgccatgtcccggccaccgccaccgcgggtcgcctcggtgctgggcaccatggagatggggcgccgcatggacgcgcccgccagcgccgcggccgtgcgcgcctttctggagcgcggccacaccgaactggacacggccttcatgtacagcgacggccagtccgagaccatcctgggcggcctggggctcgggctgggcggtggcgactgcagagtgaaaattgccaccaaggccaacccttgggatggaaaatcactaaagcctgacagtgtccggtcccagctggagacgtcattgaagaggctgcagtgtccccaagtggacctcttctacctacacgcacctgaccacggcaccccggtggaagagacgctgcatgcctgccagcggctgcaccaggagggcaagttcgtggagcttggcctctccaactatgctagctgggaagtggccgagatctgtaccctctgcaagagcaatggctggatcctgcccactgtgtaccagggcatgtacaacgccaccacccggcaggtggaaacggagctcttcccctgcctcaggcactttggactgaggttctatgcctacaaccctctggctgggggcctgctgactggcaagtacaagtatgaggacaaggacgggaaacagcctgtgggccgcttctttgggaatagctgggctgagacctacaggaatcgcttctggaaggagcaccacttcgaggccattgcgttggtggagaaggccctgcaggccgcatatggcgccagcgcccccagtgtgacctcggctgccctccggtggatgtaccaccactcacagctgcagggtgcccacggggacgcggtcatcctgggcatgtccagcctggagcagctggagcagaacttggcagcaacagaggaagggcccctggagccggctgtcgtggatgcctttaatcaagcctggcatttggttgctcacgaatgtcccaactacttccgctaggcccatcatggctcaggctgcccaaggcttttctgtcacctcttttgttctctcacactgaccagtcttggccttaagctgacttagaagggtttttctgaattgtctagatccatgcattatttttctagcttcctgccttgctccctattcactttacactgtgaaaggtggggggtgagtcccacttgagcgcttcctgttgaataaagcaggcacttgacctggctgtagcctaggtcttgagtgaaccccaaaaa

SEQ ID NO: 106443 - DNA, 1171 bp, Homo sapiens
  Payload ID: 905
  Gene Symbol: AKR7A2
  Gene Name: aldo-keto reductase family 7, member A2
  ENST ID: ENST00000330072
  CDS Start-End: 1-945
cgcgccgccgtccactgcgcgcttcgctctccgccgcccgaggcccgcgcgctcgccatgtcccggccaccgccaccgcgggtcgcctcggtgctgggcaccatggagatggggcgccgcatggacgcgcccgccagcgccgcggccgtgcgcgcctttctggagcgcggccacaccgaactggacacggccttcatgtacagcgacggccagtccgagaccatcctgggcggcctggggctcgggctgggcggtggcgactgcagagtgaaaattgccaccaaggccaacccttgggatggaaaatcactaaagcctgacagtgtccggtcccagctggagacgtcattgaagaggctgcagtgtccccaagtggacctcttctacctacacgcacctgaccacggcaccccggtggaagagacgctgcatgcctgccagcggctgcaccaggagggcatgtacaacgccaccacccggcaggtggaaacggagctcttcccctgcctcaggcactttggactgaggttctatgcctacaaccctctggctgggggcctgctgactggcaagtacaagtatgaggacaaggacgggaaacagcctgtgggccgcttctttgggaatagctgggctgagacctacaggaatcgcttctggaaggagcaccacttcgaggccattgcgttggtggagaaggccctgcaggccgcatatggcgccagcgcccccagtgtgacctcggctgccctccggtggatgtaccaccactcacagctgcagggtgcccacggggacgcggtcatcctgggcatgtccagcctggagcagctggagcagaacttggcagcaacagaggaagggcccctggagccggctgtcgtggatgcctttaatcaagcctggcatttggttgctcacgaatgtcccaactacttccgctaggcccatcatggctcaggctgcccaaggcttttctgtcacctcttttgttctctcacactgaccagtcttggccttaagctgacttagaagggtttttctgaattgtctagatccatgcattatttttctagcttcctgccttgctccctattcactttacactgtgaaaggtggggggtgagtcccacttgagcgcttcctgttgaataaagcaggcacttgacct

SEQ ID NO: 106444 - DNA, 488 bp, Homo sapiens
  Payload ID: 905
  Gene Symbol: AKR7A2
  Gene Name: aldo-keto reductase family 7, member A2
  ENST ID: ENST00000481966
  CDS Start-End: 1-168
ggcaccccggtggaagagacgctgcatgcctgccagcggctgcaccaggagggcaagttcgtggagcttggcctctccaactatgctagctgggaagtggccgagatctgtaccctctgcaagagcaatggctggatcctgcccactgtgtaccagggggcctgctgactggcaagtacaagtatgaggacaaggacgggaaacagcctgtgggccgcttctttgggaatagctgggctgagacctacaggaatcgcttctggaaggagcaccacttcgaggccattgcgttggtggagaaggccctgcaggccgcatatggcgccagcgcccccagtgtgacctcggctgccctccggtggatgtaccaccactcacagctgcagggtgcccacggggacgcggtcatcctgggcatgtccagcctggagcagctggagcagaacttggcagcaacagaggaagggcccctggagccggctgtcgtg

SEQ ID NO: 106445 - DNA, 725 bp, Homo sapiens
  Payload ID: 905
  Gene Symbol: AKR7A2
  Gene Name: aldo-keto reductase family 7, member A2
  ENST ID: ENST00000489286
  CDS Start-End: 1-617
cggccttcatgtacagcgacggccagtccgagaccatcctgggcggcctggggctcgggctgggcggtggcgactgcagagtgaaaattgccaccaaggccaacccttgggatggaaaatcactaaagcctgacagtgtccggtcccagctggagacgtcattgaagaggctgcagtgtccccaagtggacctcttctacctacacgcacctgaccacggcaccccggtggaagagacgctgcatgcctgccagcggctgcaccaggagggcaagttcgtggagcttggcctctccaactatgctagctgggaagtggccgagatctgtaccctctgcaagagcaatggctggatcctgcccactgtgtaccagcttctggaaggagcaccacttcgaggccattgcgttggtggagaaggccctgcaggccgcatatggcgccagcgcccccagtgtgacctcggctgccctccggtggatgtaccaccactcacagctgcagggtgcccacggggacgcggtcatcctgggcatgtccagcctggagcagctggagcagaacttggcagcaacagaggaagggcccctggagccggctgtcgtggatgcctttaatcaagcctggcatttggttgctcacgaatgtcccaactacttccgctaggcccatcatggctcaggctgcccaaggcttttctgtcacctcttttgttctctcacact

SEQ ID NO: 106446 - DNA, 1710 bp, Homo sapiens
  Payload ID: 906
  Gene Symbol: AKR7A3
  Gene Name: aldo-keto reductase family 7, member A3 (aflatoxin aldehyde reductase)
  Uniprot ID: O95154
  ENST ID: ENST00000361640
  CDS Start-End: 542-1537
ttcttttctttcaacactttaaccatgtcactccatggggacgctgtcttgagcctttggtaagcctcattctccaggaccacacggcaggcgcgacagccctaggtccaccccaccccgtaagcgctccctccgggaggagacagaaacccaggacagctccggggcaaggccgaggaaggagggacgacggggcagggaggcccgaagagtccccgccttttgggatagtcgccacccttggaccccctcacccttggggacgttgaggagtgttaaaatctccaagacgcgagtcaccggtacgaagccacagccatttcgctgcttgctcggtgcaagtgcagaaggtcctagtagccgagcgtggagtcgagctcgtgggcggcgtcgggcaccttcggccgcgccctcagctgcacccgccggtgggcggggcccgagcccgtctctaaagccacgaggccgcccgctccgagcctggtgcttccgaccgctgcgcgcggctcctgggctgtcacagtctcccgttgccgccgtcatgtcccggcagctgtcgcgggcccggccagccacggtgctgggcgccatggagatggggcgccgcatggacgcgcccaccagcgccgcagtcacgcgcgccttcctggagcgcggccacaccgagatagacacggccttcgtgtacagcgagggccagtccgagaccatccttggcggcctggggctccggctgggcggcagcgactgcagagtgaaaattgataccaaggccattccactgtttgggaactccctgaagcctgacagtctccggttccagctggagacgtcactgaagcggctgcagtgtccccgagtggacctcttctacctgcatatgccagaccacagcaccccggtggaagagacactgcgtgcctgccaccagctgcaccaggagggcaagttcgtggagcttggcctctccaactatgcagcctgggaagtggccgagatctgtaccctctgcaagagcaacggctggatcctgcccactgtgtaccagggcatgtacaatgccatcacccggcaggtggaaacggagctcttcccctgcctcaggcactttggactgaggttctatgccttcaaccctctggctgggggcctgctgaccggcaagtacaagtatgaggacaagaatgggaaacagcccgtgggccgcttctttgggaatacctgggcagagatgtacaggaatcgctactggaaggagcaccactttgagggcattgccctggtggagaaggccctgcaggccgcgtatggcgccagcgcccccagcatgacctcggccaccctccggtggatgtaccaccactcacagctgcagggtgcccacggggacgcggtcatcctgggcatgtccagcctggagcagctggagcagaacttggcagcggcagaggaagggcccctggagccggctgtcgtggacgcctttaatcaagcctggcatttggttactcacgaatgtcccaactacttccgctaggcccatcgtttctcaggctgcccaaggctcttctgtaacatcttttgttactcacattttctttaatttagaactgcctcagtaaattcttagggatggaagtatttggacaaaaacctaatagaagagtcaccaccaaatgaagaataaaactcccagggtgctgtgtgtta

SEQ ID NO: 106447 - DNA, 1984 bp, Homo sapiens
  Payload ID: 907
  Gene Symbol: AKR7L
  Gene Name: aldo-keto reductase family 7-like (gene/pseudogene)
  ENST ID: ENST00000457194
  CDS Start-End: 1-617
cggccttcctgtacagcgacggccagtccgagaccatccttggcggcctggggctccgaatgggcagcagcgactgcagagtgaaaattgctaccaaggccaatccatggattgggaactccctgaagcctgacagtgtccgatcccagctggagacgtcactgaagcggctgcagtgtccctgagtggacctcttctatctacatgcacctgaccacagcgccccggtggaagagacactgcgtgcctgccaccagctgcaccaggagggcaagttcgtggagcttggcctctccaactatgccgcctgggaagtggccgagatctgtaccctctgcaagagcaacggctggatcctgcccactgtgtaccagcttctggaaggagcaccacttcgagggcattgccctggtggagaaggccctgcaggccgcgtatggcgccagcgctcccagcatgacctcggccgccctccggtggatgtaccaccactcacagctgcagggtgcccacggggacgcggtcatcctgggcatgtccagcctggagcagctggagcagaacttggcagcggcagaggaagggcccctggagccggctgtcgtggacgcctttaatcaagcctggcatttgtttgcccacgaatgtcccaactacttcatctaagctcattgtggctcaggctgcccaaggcttttctgtcaactcttttgctctctcccgctttgtctaatttagaactgcctcactaaattcttagggatggaagtatttggaaaaaaacctaacagtagagtcaccacctaaggaagaataaaatctcccagggtgctgtgtgttagtctgtttgcgttgctataaaagaatacctgagactgggtcatgtataaagaaaagaggtttctttggctcacagttctgcagtctgtacaagagggtgtggtgccggcatctgctcttggtgagggcctcaggaagcttagaatcatggcagaaggggaaacggagccagcgtgtcacatggtgagagagggagcaagagacagacaggggaggaaattcacacactgatggtggggatgtaaaatggtacaaccagtttggaaaacagtttggcagtttctcaaaggattaaacataaaattaccataggattcagcagttccacttgtgggtatgtagccaagagaaatgaaaacatatctccccacaaaaaaacttgggtatgagatttcacattatcattgctcataatagccaataagtaaaaacaacccaaatgtccaagaatgaataaatggataaacaaaatatggtatatttatacaacagactattattcggccattaaaaaaaaaaaagagtggctgacacctgtaatctcagcactttgagaggccaaggcagtaggactgattgaagacaggagttccagaccagtctgggaaacaaagcgagaccctgtctccactaaacataaaaacaaaattactggggccccatggcacacacctgtagtcccagctgctcgggaagctgagatgggcggattgcttgagcccaggtattcaagtctggagtgagctatgactgtgccactgcactccagcctgggcgacagagcaaaccctgtttccaaacaaacaaacaaacaaacaaatacacagacagaagtagttaaacatctacaaggtaagtgcatcttgaagacgtgttaagttaaagaagccaattacaaaaggtttcacgttgtatgatttcgtttatatgaaatgtccagaataggcaaatctgtttgagagagagaaagtagatgagtacttgcctaggactgggaggaggattgcgaggaaatggagattcactgctaatgagtacagggtttcttttgggggcgcttatgaagatgctctgaaattgattgtgatggttgtacaactctgaatacatgaaacagcattaaacatcactttaagtaagtcaa

SEQ ID NO: 106448 - DNA, 1240 bp, Homo sapiens
  Payload ID: 907
  Gene Symbol: AKR7L
  Gene Name: aldo-keto reductase family 7-like (gene/pseudogene)
  Uniprot ID: Q8NHP1
  ENST ID: ENST00000420396
  CDS Start-End: 78-1070
gccgcccgctccgagcctggtgcttccgaccgctgcgcgcggctcctgggctgtcacagtctcccgttgccgccgtcatgtcccggcagctgtcgcgggcccggccagccacggtgctgggcgccatggagatggggcgccgcatggacgcgcccaccagcgccgcagtcacgcgcgccttcctggagcgcggccacaccgagatagacacggccttcctgtacagcgacggccagtccgagaccatccttggcggcctggggctccgaatgggcagcagcgactgcagagtgaaaattgctaccaaggccaatccatggattgggaactccctgaagcctgacagtgtccgatcccagctggagacgtcactgaagcggctgcagtgtcccgtggacctcttctatctacatgcacctgaccacagcgccccggtggaagagacactgcgtgcctgccaccagctgcaccaggagggcaagttcgtggagcttggcctctccaactatgccgcctgggaagtggccgagatctgtaccctctgcaagagcaacggctggatcctgcccactgtgtaccagggcatgtacagcgccaccacccggcaggtggaaacggagctcttcccctgcctcaggcactttggactgaggttctatgcctacaaccctctggctgggggcctgctgaccggcaagtacaagtatgaggacaaggacgggaaacagcccgtgggccgcttctttgggactcagtgggcagagatctacaggaatcacttctggaaggagcaccacttcgagggcattgccctggtggagaaggccctgcaggccgcgtatggcgccagcgctcccagcatgacctcggccgccctccggtggatgtaccaccactcacagctgcagggtgcccacggggacgcggtcatcctgggcatgtccagcctggagcagctggagcagaacttggcagcggcagaggaagggcccctggagccggctgtcgtggacgcctttaatcaagcctggcatttgtttgcccacgaatgtcccaactacttcatctaagctcattgtggctcaggctgcccaaggcttttctgtcaactcttttgctctctcccgctttgtctaatttagaactgcctcactaaattcttagggatggaagtatttggaaaaaaacctaacagtagagtcaccacctaaggaagaataaaatctcccagggtgctgtg

SEQ ID NO: 106449 - DNA, 1313 bp, Homo sapiens
  Payload ID: 907
  Gene Symbol: AKR7L
  Gene Name: aldo-keto reductase family 7-like (gene/pseudogene)
  ENST ID: ENST00000429712
  CDS Start-End: 121-1116
accaccggtgggcgcggcccgagccagtccctaaagccacgaggccgcccgctccgagcctggtgcttccgaccgctgcgcgcggctcctgggctgtcacagtctcccgttgccgccgtcatgtcccggcagctgtcgcgggcccggccagccacggtgctgggcgccatggagatggggcgccgcatggacgcgcccaccagcgccgcagtcacgcgcgccttcctggagcgcggccacaccgagatagacacggccttcctgtacagcgacggccagtccgagaccatccttggcggcctggggctccgaatgggcagcagcgactgcagagtgaaaattgctaccaaggccaatccatggattgggaactccctgaagcctgacagtgtccgatcccagctggagacgtcactgaagcggctgcagtgtccctgagtggacctcttctatctacatgcacctgaccacagcgccccggtggaagagacactgcgtgcctgccaccagctgcaccaggagggcaagttcgtggagcttggcctctccaactatgccgcctgggaagtggccgagatctgtaccctctgcaagagcaacggctggatcctgcccactgtgtaccagggcatgtacagcgccaccacccggcaggtggaaacggagctcttcccctgcctcaggcactttggactgaggttctatgcctacaaccctctggctgggggcctgctgaccggcaagtacaagtatgaggacaaggacgggaaacagcccgtgggccgcttctttgggactcagtgggcagagatctacaggaatcacttctggaaggagcaccacttcgagggcattgccctggtggagaaggccctgcaggccgcgtatggcgccagcgctcccagcatgacctcggccgccctccggtggatgtaccaccactcacagctgcagggtgcccacggggacgcggtcatcctgggcatgtccagcctggagcagctggagcagaacttggcagcggcagaggaagggcccctggagccggctgtcgtggacgcctttaatcaagcctggcatttgtttgcccacgaatgtcccaactacttcatctaagctcattgtggctcaggctgcccaaggcttttctgtcaactcttttgctctctcccgctttgtctaatttagaactgcctcactaaattcttagggatggaagtatttggaaaaaaacctaacagtagagtcaccacctaaggaagaataaaatctcccagggtgctgtgtgttagtctgtttgcgttgctataaaa

SEQ ID NO: 106450 - DNA, 2384 bp, Homo sapiens
  Payload ID: 908
  Gene Symbol: ALDOA
  Gene Name: aldolase A, fructose-bisphosphate
  Uniprot ID: P04075
  ENST ID: ENST00000338110
  CDS Start-End: 1088-2182
aaacaccgctctggtcaccatggcaacagcgggatgccgcgaacggcttctgggcggggccggtccctcggacgattggacctagcttggcgcggaatccgtgaattgcccgcggcccgagggtgcagctcccggactgactggctctgcccttccccatggacgcctcctctagcccgtggaatccaaccccggctcctgtcagcagccctcccctgctgctccccatccctgccatcgtcttcatcgctgtgggcatctatttgttgctgctgggtctagtcctgctgactaggaactgcctgctggcccagggctgctgcgcggacggtagctccccctgcaggaagcaaggttcctccgggcccccagactgctgctggacctgtgcagaagcctgcaactttcctctgcctagcccggcccacttcctggatgcttgctgcccccagcccaccagagctgactgggcacctcgctgcccccgctgctgcccactctgcgactgtgcctgtacgtgccagctccccgactgccagagcctcaactgtctctgcttcgagatcaagctccgatgaggacccagggcccctgccctctggggagcggccagcccccagggcccatgtgccctcctccctgaagagcctttccccacgccactggaaccacagatggcctgccgagcacccaggcctgggaactggaagtggcagcgcagggcctggctccctgcagggcaggactcttggccggctggacggcagctcctctggagggccagaaaagagaggggctagtgctcgggcaggtgccctggcttcccttcccctccacacgtcaacgattctatttgaagttgggcaggggggtggcgctgctcaccacacacaagtgttataggaggagtctggcccttgagtaccgggtacgcaggggtgcctcaaccacactccgtccacggactctccgttattttaggaggtccctggccaaagatttatttctcttgacaaccaagggcctccgtctggatttccaaggaagaatttcctctgaagcaccggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaaggggga

SEQ ID NO: 106451 - DNA, 1447 bp, Homo sapiens
  Payload ID: 908
  Gene Symbol: ALDOA
  Gene Name: aldolase A, fructose-bisphosphate
  ENST ID: ENST00000395240
  CDS Start-End: 173-1279
ccccttccgaggctaaatcggctgcgttcctctcggaacgcgccgcagaaggggtcctggtgacgagtcccgcgttctctccttgaatccactcgccagcccgccgccctctgccgccgcaccctgcacacccgcccctctcctgtgccaggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcaggtgggcctgcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccg

SEQ ID NO: 106452 - DNA, 2447 bp, Homo sapiens
  Payload ID: 908
  Gene Symbol: ALDOA
  Gene Name: aldolase A, fructose-bisphosphate
  Uniprot ID: P04075
  ENST ID: ENST00000395248
  CDS Start-End: 983-2239
atgccgcgaacggcttctgggcggggccggtccctcggacgattggacctagcttggcgcggaatccgtgaattgcccgcggcccgagggtgcagctcccggactgactggctctgcccttccccatggacgcctcctctagcccgtggaatccaaccccggctcctgtcagcagccctcccctgctgctccccatccctgccatcgtcttcatcgctgtgggcatctatttgttgctgctgggtctagtcctgctgactaggaactgcctgctggcccagggctgctgcgcggacggtagctccccctgcaggaagcaaggttcctccgggcccccagactgctgctggacctgtgcagaagcctgcaactttcctctgcctagcccggcccacttcctggatgcttgctgcccccagcccaccagagctggcttccattctggtgatggagagagagaaataaccaggccattacaacagagggtgagaaatgacgtgctatggagcagcggttgctcagccctgcatgcgatcagaagcaggactgggcacctcgctgcccccgctgctgcccactctgcgactgtgcctgtacgtgccagctccccgactgccagagcctcaactgtctctgcttcgagatcaagctccgatgaggacccagggcccctgccctctggggagcggccagcccccagggcccatgtgccctcctccctgaagagcctttccccacgccactggaaccacagatggcctgccgagcacccaggcctgggaactggaagtggcagcgcagggcctggctccctgcagggcaggactcttggccggctggacggcagctcctctggagggccagaaaagagaggggctagtgctcgggtccctggccaaagatttatttctcttgacaaccaagggcctccgtctggatttccaaggaagaatttcctctgaagcaccggcaaggtgaccccatggcaaggcgcaagccagaagggtccagcttcaacatgacccacctgtccatggctatggccttttcctttcccccagttgccagtgggcaactccaccctcagctgggcaacacccagcaccagacagagttaggaaaggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaagggggagtcggc

SEQ ID NO: 106453 - DNA, 1603 bp, Homo sapiens
  Payload ID: 908
  Gene Symbol: ALDOA
  Gene Name: aldolase A, fructose-bisphosphate
  Uniprot ID: P04075
  ENST ID: ENST00000412304
  CDS Start-End: 310-1404
gaagcaccggtgagtgggcaggggctccctccccatcaatagggccgacccaagtcttcctcccccttcccccatgccgggccccacgatagtgtgaatgtcaggggcttcaggtttccctaaatataggtccctgccagaggatccgtggcgggaaaagggcaggggtcattagagaagatcggggacacatgtggggcgggcaggagctgccttataaccagcccgggaacccctagctcactcgctgctgaccaggctctgccggctccttcggcctcgccgcaggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaaggg

SEQ ID NO: 106454 - DNA, 512 bp, Homo sapiens
  Payload ID: 908
  Gene Symbol: ALDOA
  Gene Name: aldolase A, fructose-bisphosphate
  ENST ID: ENST00000566846
  CDS Start-End: 92-512
cttgaatccactcgccagcccgccgccctctgccgccgcaccctgcacacccgcccctctcctgtgccaggaacttgctactaccagcaccatgccctaccaatatccagcactgaccccggagcagaagaaggagctgtctgacatcgctcaccgcatcgtggcacctgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgc

SEQ ID NO: 106455 - DNA, 906 bp, Homo sapiens
  Payload ID: 908
  Gene Symbol: ALDOA
  Gene Name: aldolase A, fructose-bisphosphate
  ENST ID: ENST00000562679
  CDS Start-End: 72-906
ctgtggcaaaggattagggccccttagccctggcggggatcctaagaggcagtgaggggcaaggtgaccccatggcaaggcgcaagccagaagggtccagcttcaacatgacccacctgtccatggctatggccttttcctttcccccagttgccagtgggcaactccaccctcagctgggcaacacccagcaccagacagagttaggaaaggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctgg

SEQ ID NO: 106456 - DNA, 1359 bp, Homo sapiens
  Payload ID: 908
  Gene Symbol: ALDOA
  Gene Name: aldolase A, fructose-bisphosphate
  Uniprot ID: P04075
  ENST ID: ENST00000569545
  CDS Start-End: 220-1314
agtaccgggtacgcaggggtgcctcaaccacactccgtccacggactctccgttattttaggaggtccctggccaaagatttatttctcttgacaaccaagggcctccgtctggatttccaaggaagaatttcctctgaagcaccgcccgccgccctctgccgccgcaccctgcacacccgcccctctcctgtgccaggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgcccc

SEQ ID NO: 106457 - DNA, 2448 bp, Homo sapiens
  Payload ID: 908
  Gene Symbol: ALDOA
  Gene Name: aldolase A, fructose-bisphosphate
  Uniprot ID: P04075
  ENST ID: ENST00000566897
  CDS Start-End: 1153-2247
cgcgaacggcttctgggcggggccggtccctcggacgattggacctagcttggcgcggaatccgtgaattgcccgcggcccgagggtgcaggtgatgggtgctgaccgactggggaagcccggagtgtggggactgaggaggggagtggcctggggcgcgctggagcctgcgaggaaggcgccgcctcggatcccccgccccccattccccttcccgaattccaccctccggcccagccatggcctcagtttccccaaacaggaaagggaaggagggtgggcaccccggtctaacggtgcctctcagcctctgagacccagaaccttccttctgcagctcccggactgactggctctgcccttccccatggacgcccagggctgctgcgcggacggtagctccccctgcaggaagcaaggttcctccgggcccccagactgctgctggacctgtgcagaagcctgcaactttcctctgcctagcccggcccacttcctggatgcttgctgcccccagcccaccagagctgactgggcacctcgctgcccccgctgctgcccactctgcgactgtgcctgtacgtgccagctccccgactgccagagcctcaactgtctctgcttcgagatcaagctccgatgaggacccagggcccctgccctctggggagcggccagcccccagggcccatgtgccctcctccctgaagagcctttccccacgccactggaaccacagatggcctgccgagcacccaggcctgggaactggaagtggcagcgcagggcctggctccctgcagggcaggactcttggccggctggacggcagctcctctggagggccagaaaagagaggggctagtgctcgggcaggtgccctggcttcccttcccctccacacgtcaacgattctatttgaagttgggcaggggggtggcgctgctcaccacacacaagtgttataggaggagtctggcccttgagtaccgggtacgcaggggtgcctcaaccacactccgtccacggactctccgttattttaggaggtccctggccaaagatttatttctcttgacaaccaagggcctccgtctggatttccaaggaagaatttcctctgaagcaccggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaaggggg

SEQ ID NO: 106458 - DNA, 1550 bp, Homo sapiens
  Payload ID: 908
  Gene Symbol: ALDOA
  Gene Name: aldolase A, fructose-bisphosphate
  Uniprot ID: P04075
  ENST ID: ENST00000563060
  CDS Start-End: 254-1348
tccttcttaaaaaaaaccagggctccagagaatcagaacagccaccatcaccgcagggagtcaagggaggagggagattagagaaggagccagggagggtggcagggaggccacgtgatccgagtcccctcacccctttccttcccacaggtccctggccaaagatttatttctcttgacaaccaagggcctccgtctggatttccaaggaagaatttcctctgaagcaccggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaaggggga

SEQ ID NO: 106459 - DNA, 1499 bp, Homo sapiens
  Payload ID: 908
  Gene Symbol: ALDOA
  Gene Name: aldolase A, fructose-bisphosphate
  ENST ID: ENST00000569798
  CDS Start-End: 178-1263
cgccgccccttccgaggctaaatcggctgcgttcctctcggaacgcgccgcagaaggggtcctggtgacgagtcccgcgttctctccttgaatccactcgccagcccgccgccctctgccgccgcaccctgcacacccgcccctctcctgtgccaggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggtaaggataggcaggaggtgggcagggtgcctgggtggatgggactcggagaagagcccttctcactccacccctctccctgcttaggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtct

SEQ ID NO: 106460 - DNA, 2104 bp, Homo sapiens
  Payload ID: 908
  Gene Symbol: ALDOA
  Gene Name: aldolase A, fructose-bisphosphate
  Uniprot ID: P04075
  ENST ID: ENST00000564546
  CDS Start-End: 802-1896
tcgcctccgcgcgccgctagttccgccgccttctcgcgctccctgcgtgtcctctcgatgccctttcctccgcctcccttacgcctgggccagtgacagggtgtcggctccgcgccgattcagcccgcgggcgaggcaggctaacgcacgactgcgcgatgtggcccctatggtgacacgcgctgcagccgcgaagaccggaagctggggcggccccgggccgcgcgcgctgggcctgggaggcgaaactcagcttccttcgtttccgacttttccatccgcgtcctccacttccccgttccgccctcccccattgccaacattctggctgagtcacggcgccccagagcgcgccaggctgggggaaaggagcagaagggagggccctagcgacccgcgggatgtggtccgagtcacgtccgaggggggtggggagggatcgtgttctcggcgcccgccccttcctagcgcggcctctgggctgcgcctctcgggggcggcccgtagcccagtccgtcgcctgccattggacgccgcccgctcctcgtaaaggaaaaagctcggcggagggcggagtggtgcctttaaaaggccgggcgccgccttccgcctgcccgcctcctgcgccgccccttccgaggctaaatcggctgcgttcctctcggaacgcgccgcagaaggggtcctggtgacgagtcccgcgttctctccttgaatccactcgccagcccgccgccctctgccgccgcaccctgcacacccgcccctctcctgtgccaggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaagggggagtcggc

SEQ ID NO: 106461 - DNA, 666 bp, Homo sapiens
  Payload ID: 908
  Gene Symbol: ALDOA
  Gene Name: aldolase A, fructose-bisphosphate
  ENST ID: ENST00000562168
  CDS Start-End: 181-666
agtctggcccttgagtaccgggtacgcaggggtgcctcaaccacactccgtccacggactctccgttattttaggaggtccctggccaaagatttatttctcttgacaaccaagggcctccgtctggatttccaaggaagaatttcctctgaagcaccggaacttgctactaccagcaccatgccctaccaatatccagcactgaccccggagcagaagaaggagctgtctgacatcgctcaccgcatcgtggcacctgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgt

SEQ ID NO: 106462 - DNA, 538 bp, Homo sapiens
  Payload ID: 908
  Gene Symbol: ALDOA
  Gene Name: aldolase A, fructose-bisphosphate
  ENST ID: ENST00000565355
  CDS Start-End: 1-392
ccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggccgcctcctcggggctccaggctggcttgcccgcgctctttcttccctcgtgacagtggtgtgtggtgtcgtctgtgaatgctaagtccatcaccctttccggcacactgccaaataaacagctatttaagggggagtc

SEQ ID NO: 106463 - DNA, 1663 bp, Homo sapiens
  Payload ID: 908
  Gene Symbol: ALDOA
  Gene Name: aldolase A, fructose-bisphosphate
  Uniprot ID: P04075
  ENST ID: ENST00000564595
  CDS Start-End: 208-1464
aaaaggccgggcgccgccttccgcctgcccgcctcctgcgccgccccttccgaggctaaatcggctgcgttcctctcggaacgcgccgcagaaggggtcctggtgacgagtcccgcgttctctccttgaatccactcgccagcccgccgccctctgccgccgcaccctgcacacccgcccctctcctgtgccaggcaaggtgaccccatggcaaggcgcaagccagaagggtccagcttcaacatgacccacctgtccatggctatggccttttcctttcccccagttgccagtgggcaactccaccctcagctgggcaacacccagcaccagacagagttaggaaaggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaaggg

SEQ ID NO: 106464 - DNA, 613 bp, Homo sapiens
  Payload ID: 908
  Gene Symbol: ALDOA
  Gene Name: aldolase A, fructose-bisphosphate
  ENST ID: ENST00000564688
  CDS Start-End: 1-613
cggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccatta

SEQ ID NO: 106465 - DNA, 586 bp, Homo sapiens
  Payload ID: 908
  Gene Symbol: ALDOA
  Gene Name: aldolase A, fructose-bisphosphate
  ENST ID: ENST00000563987
  CDS Start-End: 120-586
actcgctgctgaccaggctctgccggctccttcggcctcgccgcagcccgccgccctctgccgccgcaccctgcacacccgcccctctcctgtgccaggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattgggga

SEQ ID NO: 106466 - DNA, 935 bp, Homo sapiens
  Payload ID: 908
  Gene Symbol: ALDOA
  Gene Name: aldolase A, fructose-bisphosphate
  ENST ID: ENST00000568435
  CDS Start-End: 900-935
ggcttctgggcggggccggtccctcggacgattggacctagcttggcgcggaatccgtgaattgcccgcggcccgagggtgcagctcccggactgactggctctgcccttccccatggacgcccagggctgctgcgcggacggtagctccccctgcaggaagcaaggttcctccgggcccccagactgctgctggacctgtgcagaagcctgcaactttcctctgcctagcccggcccacttcctggatgcttgctgcccccagcccaccagagctgactgggcacctcgctgcccccgctgctgcccactctgcgactgtgcctgtacgtgccagctccccgactgccagagcctcaactgtctctgcttcgagatcaagctccgatgaggacccagggcccctgccctctggggagcggccagcccccagggcccatgtgccctcctccctgaagagcctttccccacgccactggaaccacagatggcctgccgagcacccaggcctgggaactggaagtggcagcgcagggcctggctccctgcagggcaggactcttggccggctggacggcagctcctctggagggccagaaaagagaggggctagtgctcgggcaggtgccctggcttcccttcccctccacacgtcaacgattctatttgaagttgggcaggggggtggcgctgctcaccacacacaagtgttataggaggagtctggcccttgagtaccgggtacgcaggggtgcctcaaccacactccgtccacggactctccgttattttaggaggtccctggccaaagatttatttctcttgacaaccaagggcctccgtctggatttccaaggaagaatttcctctgaagcaccggaacttgctactaccagcaccatgccctaccaatatccagcactgaccccggagcag

SEQ ID NO: 106467 - DNA, 2402 bp, Homo sapiens
  Payload ID: 908
  Gene Symbol: ALDOA
  Gene Name: aldolase A, fructose-bisphosphate
  ENST ID: ENST00000627059
  CDS Start-End: 1088-2194
aaacaccgctctggtcaccatggcaacagcgggatgccgcgaacggcttctgggcggggccggtccctcggacgattggacctagcttggcgcggaatccgtgaattgcccgcggcccgagggtgcagctcccggactgactggctctgcccttccccatggacgcctcctctagcccgtggaatccaaccccggctcctgtcagcagccctcccctgctgctccccatccctgccatcgtcttcatcgctgtgggcatctatttgttgctgctgggtctagtcctgctgactaggaactgcctgctggcccagggctgctgcgcggacggtagctccccctgcaggaagcaaggttcctccgggcccccagactgctgctggacctgtgcagaagcctgcaactttcctctgcctagcccggcccacttcctggatgcttgctgcccccagcccaccagagctgactgggcacctcgctgcccccgctgctgcccactctgcgactgtgcctgtacgtgccagctccccgactgccagagcctcaactgtctctgcttcgagatcaagctccgatgaggacccagggcccctgccctctggggagcggccagcccccagggcccatgtgccctcctccctgaagagcctttccccacgccactggaaccacagatggcctgccgagcacccaggcctgggaactggaagtggcagcgcagggcctggctccctgcagggcaggactcttggccggctggacggcagctcctctggagggccagaaaagagaggggctagtgctcgggcaggtgccctggcttcccttcccctccacacgtcaacgattctatttgaagttgggcaggggggtggcgctgctcaccacacacaagtgttataggaggagtctggcccttgagtaccgggtacgcaggggtgcctcaaccacactccgtccacggactctccgttattttaggaggtccctggccaaagatttatttctcttgacaaccaagggcctccgtctggatttccaaggaagaatttcctctgaagcaccggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcaggtgggcctgcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaagggggagtcggc

SEQ ID NO: 106468 - DNA, 2451 bp, Homo sapiens
  Payload ID: 909
  Gene Symbol: ALDOB
  Gene Name: aldolase B, fructose-bisphosphate
  Uniprot ID: P05062
  ENST ID: ENST00000374855
  CDS Start-End: 126-1220
aaaaacatgatgagaagtctataaaaattgtgtgctaccaaagatctgtcttatttggcagctgctgcctcacccacagcttttgatatctaggaggactcttctctcccaaactacctgtcaccatggcccaccgatttccagccctcacccaggagcagaagaaggagctctcagaaattgcccagagcattgttgccaatggaaaggggatcctggctgcagatgaatctgtaggtaccatggggaaccgcctgcagaggatcaaggtggaaaacactgaagagaaccgccggcagttccgagaaatcctcttctctgtggacagttccatcaaccagagcatcgggggtgtgatccttttccacgagaccctctaccagaaggacagccagggaaagctgttcagaaacatcctcaaggaaaaggggatcgtggtgggaatcaagttagaccaaggaggtgctcctcttgcaggaacaaacaaagaaaccaccattcaagggcttgatggcctctcagagcgctgtgctcagtacaagaaagatggtgttgactttgggaagtggcgtgctgtgctgaggattgccgaccagtgtccatccagcctcgctatccaggaaaacgccaacgccctggctcgctacgccagcatctgtcagcagaatggactggtacctattgttgaaccagaggtaattcctgatggagaccatgacctggaacactgccagtatgttactgagaaggtcctggctgctgtctacaaggccctgaatgaccatcatgtttacctggagggcaccctgctaaagcccaacatggtgactgctggacatgcctgcaccaagaagtatactccagaacaagtagctatggccaccgtaacagctctccaccgtactgttcctgcagctgttcctggcatctgctttttgtctggtggcatgagtgaagaggatgccactctcaacctcaatgctatcaacctttgccctctaccaaagccctggaaactaagtttctcttatggacgggccctgcaggccagtgcactggctgcctggggtggcaaggctgcaaacaaggaggcaacccaggaggcttttatgaagcgggccatggctaactgccaggcggccaaaggacagtatgttcacacgggttcttctggggctgcttccacccagtcgctcttcacagcctgctatacctactagggtccaatgcccgccagcctagctccagtgcttctagtaggagggctgaaagggagcaacttttcctccaatcctggaaattcgacacaattagatttgaactgctggaaatacaacacatgttaaatcttaagtacaagggggaaaaaataaatcagttattgaaacataaaaatgaataccaaggacctgatcaaatttcacacagcagtttccttgcaacactttcagctccccatgctccagaatacccacccaagaaaataataggctttaaaacaatatcggctcctcatccaaagaacaactgctgattgaaacacctcattagctgagtgtagagaagtgcatcttatgaaacagtcttagcagtggtaggttgggaaggagatagctgcaaccaaaaaagaaataaatattctataaaccttcagctgctatcgggtttcacttttctgctcttgctgtccaaagactcagtgtatttcattacttttgactctactagacatgactgggtttcaacagtaaaggtcttcaactcttgctagtcattggaatcaagccgcaaaattttaaaaactgagatgctcaggccacaccccagctcaattaaatcagaaaccctagacttgggatcctctaactattagatttcttaaagctccctcagtaattccaatgtacagtcaagtttgagaactaccaatctaaatttcaagtttgagggtatttgaaaattaaagccattcacaatacgaagccagctaaaaatgtagaatgattttgagcaacttgtggagtataataagagaattaatgtgacttcaatgcttggagcattcttgttcaagtggcccaggtttggtgaaacaggactaccttgtcatctgcacgtccaggcatatttcgtagttttgcagtaaataatattcacataatgatactgtattgactttcaattttcagaattaacctatagttacagcacttaagacaaccagagttataaaagagaatttaaatattataactttggacaatataaaagtgatgatttaactgacagaagctaggaaatataagggggaggagaagtggaagaaagcaaagagagtcaggaatactacttaaaactgatgggttaagaaatagtgctttaattctatttaagtaataaaagaaatggatgtaaatcataaaaatatatatctaaaattaaaatattgat

SEQ ID NO: 106469 - DNA, 1391 bp, Homo sapiens
  Payload ID: 909
  Gene Symbol: ALDOB
  Gene Name: aldolase B, fructose-bisphosphate
  ENST ID: ENST00000616752
  CDS Start-End: 77-1027
cttatttggcagctgctgcctcacccacagcttttgatatctaggaggactcttctctcccaaactacctgtcaccatggcccaccgatttccagccctcacccaggagcagaagaaggagctctcagaaattgcccagagcattgttgccaatggaaaggggatcctggctgcagatgaatctgtaggtaccatggggaaccgcctgcagaggatcaaggtggaaaacactgaagagaaccgccggcagttccgagaaatcctcttctctgtggacagttccatcaaccagagcatcgggggtgtgatccttttccacgagaccctctaccagaaggacagccagggaaagctgttcagaaacatcctcaaggaaaaggggatcgtggtgggaatcaagttagaccaaggaggtgctcctcttgcaggaacaaacaaagaaaccaccattcaagggcttgatggcctctcagagcgctgtgctcagtacaagaaagatggtgttgactttgggaagtggcgtgctgtgctgaggattgccgaccagtgtccatccagcctcgctatccaggaaaacgccaacgccctggctcgctacgccagcatctgtcagcagaatggactggtacctattgttgaaccagaggtaattcctgatggagaccatgacctggaacactgccagtatgttactgagaaggtcctggctgctgtctacaaggccctgaatgaccatcatgtttacctggagggcaccctgctaaagcccaacatggtgactgctggacatgcctgcaccaagaagtatactccagaacaagtagctatggccaccgtaacagctctccaccgtactgttcctgcagctgttcctggcatctgctttttgtctggtggcatgagtgaagaggatgccactctcaacctcaatgctatcaacctttgccctctaccaaagccctggaaactaagtttctcttgggtggcaaggctgcaaacaaggaggcaacccaggaggcttttatgaagcgggccatggctaactgccaggcggccaaaggacagtatgttcacacgggttcttctggggctgcttccacccagtcgctcttcacagcctgctatacctactagggtccaatgcccgccagcctagctccagtgcttctagtaggagggctgaaagggagcaacttttcctccaatcctggaaattcgacacaattagatttgaactgctggaaatacaacacatgttaaatcttaagtacaagggggaaaaaataaatcagttattgaaacataaaaatgaataccaaggacctgatcaaatttcacacagcagtttccttgcaacactttcagctccccatgctccagaatacccaccc

SEQ ID NO: 106470 - DNA, 1982 bp, Homo sapiens
  Payload ID: 910
  Gene Symbol: ALDOC
  Gene Name: aldolase C, fructose-bisphosphate
  Uniprot ID: P09972
  ENST ID: ENST00000226253
  CDS Start-End: 477-1571
attacttcctgccctgaacttgggcaccttgaagatgcttctgccccacctactcaacctgttgttactgttctggtgcctcctcttcaccagactaagcttaatccccagcatccagcaagtgcccggcacgtggtaaagggattgtggcagaaatgaacgcaaggtcatggccaggctccccgaggtgggagggcagtccctaacagccacggatgcctggcggggcgctcactccacctcgccgccccgcctctgagggcgtggtcttgccccggacaccagtcctggggagggggtgtggtcagggcggggcatgcaggccacgcccccggaggagtcacgtagctctgcgacatccgcagcctcatttaccagagggagccagggctgcagcctcatctgtttgcggatcagaacccgagctgtgcttgtggctgcggctgctaactggctgcgcacagggagctgtcaccatgcctcactcgtacccagccctttctgctgagcagaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccaggtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggttgacaagggtgtggtgcctctagctgggactgatggagaaaccaccactcaagggctggatgggctctcagaacgctgtgcccaatacaagaaggatggtgctgactttgccaagtggcgctgtgtgctgaaaatcagtgagcgtacaccctctgcacttgccattctggagaacgccaacgtgctggcccgttatgccagtatctgccagcagaatggcattgtgcctattgtggaacctgaaatattgcctgatggagaccacgacctcaaacgttgtcagtatgttacagagaaggtcttggctgctgtgtacaaggccctgagtgaccatcatgtatacctggaggggaccctgctcaagcccaacatggtgaccccgggccatgcctgtcccatcaagtataccccagaggagattgccatggcaactgtcactgccctgcgtcgcactgtgcccccagctgtcccaggagtgaccttcctgtctgggggtcagagcgaagaagaggcatcattcaacctcaatgccatcaaccgctgcccccttccccgaccctgggcgcttaccttctcctatgggcgtgccctgcaagcctctgcactcaatgcctggcgagggcaacgggacaatgctggggctgccactgaggagttcatcaagcgggctgaggtgaatgggcttgcagcccagggcaagtatgaaggcagtggagaagatggtggagcagcagcacagtcactctacattgccaaccatgcctactgagtatccactccataccacagcccttggcccagccatctgcacccacttttgcttgtagtcatggccagggccaaatagctatgcagagcagagatgccttcacctggcaccaacttgtcttcctttctctcttcccttcccctctctcattgctgcacctgggaccataggatgggaggatagggagcccctcatgactgagggcagaagaaattgctagaagtcagaacaggatggctgggtctccccctacctcttccagctcccacaattttcccatgatgaggtagcttctccctgggctctccttcttgcctgccctgtctcctgggatcagagggtagtacagaagccctgactcatgccttgagtacataccatacagcaaataaatggtagcaaaacattcta

SEQ ID NO: 106471 - DNA, 1519 bp, Homo sapiens
  Payload ID: 910
  Gene Symbol: ALDOC
  Gene Name: aldolase C, fructose-bisphosphate
  ENST ID: ENST00000395319
  CDS Start-End: 98-1108
gggagccagggctgcagcctcatctgtttgcggatcagaacccgagctgtgcttgtggctgcggctgctaactggctgcgcacagggagctgtcaccatgcctcactcgtacccagccctttctgctgagcagaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccaggtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggttgacaagggtgtggtgcctctagctgggactgatggagaaaccaccactcaagggctggatgggctctcagaacgctgtgcccaatacaagaaggatggtgctgactttgccaagtggcgctgtgtgctgaaaatcagtgagcgtacaccctctgcacttgccattctggagaacgccaacgtgctggcccgttatgccagtatctgccagcaggtcttggctgctgtgtacaaggccctgagtgaccatcatgtatacctggaggggaccctgctcaagcccaacatggtgaccccgggccatgcctgtcccatcaagtataccccagaggagattgccatggcaactgtcactgccctgcgtcgcactgtgcccccagctgtcccaggagtgaccttcctgtctgggggtcagagcgaagaagaggcatcattcaacctcaatgccatcaaccgctgcccccttccccgaccctgggcgcttaccttctcctatgggcgtgccctgcaagcctctgcactcaatgcctggcgagggcaacgggacaatgctggggctgccactgaggagttcatcaagcgggctgaggtgaatgggcttgcagcccagggcaagtatgaaggcagtggagaagatggtggagcagcagcacagtcactctacattgccaaccatgcctactgagtatccactccataccacagcccttggcccagccatctgcacccacttttgcttgtagtcatggccagggccaaatagctatgcagagcagagatgccttcacctggcaccaacttgtcttcctttctctcttcccttcccctctctcattgctgcacctgggaccataggatgggaggatagggagcccctcatgactgagggcagaagaaattgctagaagtcagaacaggatggctgggtctccccctacctcttccagctcccacaattttcccatgatgaggtagcttctccctgggctctccttcttgcctgccctgtctcctgggatcagagggtagtacagaagccctgactcatgccttgagtacataccatacagcaaataaatggtagcaaaacattcta

SEQ ID NO: 106472 - DNA, 1722 bp, Homo sapiens
  Payload ID: 910
  Gene Symbol: ALDOC
  Gene Name: aldolase C, fructose-bisphosphate
  Uniprot ID: P09972
  ENST ID: ENST00000395321
  CDS Start-End: 217-1311
atgcaggccacgcccccggaggagtcacgtagctctgcgacatccgcagcctcatttaccagagggagccagggctgcagcctcatctgtttgcggatcagaacccgagctgtgcttgtggctgcggctgctaactggctgcgcacagaagctgagagaagagggtggcaataagtacttttgcctcattctgaagccttggaaggagctgtcaccatgcctcactcgtacccagccctttctgctgagcagaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccaggtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggttgacaagggtgtggtgcctctagctgggactgatggagaaaccaccactcaagggctggatgggctctcagaacgctgtgcccaatacaagaaggatggtgctgactttgccaagtggcgctgtgtgctgaaaatcagtgagcgtacaccctctgcacttgccattctggagaacgccaacgtgctggcccgttatgccagtatctgccagcagaatggcattgtgcctattgtggaacctgaaatattgcctgatggagaccacgacctcaaacgttgtcagtatgttacagagaaggtcttggctgctgtgtacaaggccctgagtgaccatcatgtatacctggaggggaccctgctcaagcccaacatggtgaccccgggccatgcctgtcccatcaagtataccccagaggagattgccatggcaactgtcactgccctgcgtcgcactgtgcccccagctgtcccaggagtgaccttcctgtctgggggtcagagcgaagaagaggcatcattcaacctcaatgccatcaaccgctgcccccttccccgaccctgggcgcttaccttctcctatgggcgtgccctgcaagcctctgcactcaatgcctggcgagggcaacgggacaatgctggggctgccactgaggagttcatcaagcgggctgaggtgaatgggcttgcagcccagggcaagtatgaaggcagtggagaagatggtggagcagcagcacagtcactctacattgccaaccatgcctactgagtatccactccataccacagcccttggcccagccatctgcacccacttttgcttgtagtcatggccagggccaaatagctatgcagagcagagatgccttcacctggcaccaacttgtcttcctttctctcttcccttcccctctctcattgctgcacctgggaccataggatgggaggatagggagcccctcatgactgagggcagaagaaattgctagaagtcagaacaggatggctgggtctccccctacctcttccagctcccacaattttcccatgatgaggtagcttctccctgggctctccttcttgcctgccctgtctcctgggatcagagggtagtacagaagccctgactcatgccttgagtacataccatacagcaaataaatggtagcaaaacattcta

SEQ ID NO: 106473 - DNA, 579 bp, Homo sapiens
  Payload ID: 910
  Gene Symbol: ALDOC
  Gene Name: aldolase C, fructose-bisphosphate
  ENST ID: ENST00000435638
  CDS Start-End: 132-579
agtctcatctctctctcaggctctctactcctttcagccttggtcctctgccctcccgtctgggtgtctgagttgtggggaattgaagtgcttcctattgctatcctcctgccaaacagggagctgtcaccatgcctcactcgtacccagccctttctgctgagcagaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccaggtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggttgacaagggtgtggtgcctctagctgggactgatggagaaaccaccactcaagggctggatgggctctcagaacgctgtgcccaatacaagaaggatggtgctgactttgccaagtggcgct

SEQ ID NO: 106474 - DNA, 686 bp, Homo sapiens
  Payload ID: 910
  Gene Symbol: ALDOC
  Gene Name: aldolase C, fructose-bisphosphate
  ENST ID: ENST00000584086
  CDS Start-End: 161-686
atttaccagagggagccagggctgcagcctcatctgtttgcggatcagaacccgagctgtgcttgtggctgcggctgctaactggctgcgcacagctgagagaagagggtggcaataagtacttttgcctcattctgaagccttggaaggagctgtcaccatgcctcactcgtacccagccctttctgctgagcagaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccaggtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggttgacaagggtgtggtgcctctagctgggactgatggagaaaccaccactcaagggctggatgggctctcagaacgctgtgcccaatacaagaaggatggtgctgactttgccaagtggcgctgtgtgctgaaaatcagtgagcgtacaccctctgcacttgccattctggagaacgccaacgtgctggcccgttatgcca

SEQ ID NO: 106475 - DNA, 839 bp, Homo sapiens
  Payload ID: 910
  Gene Symbol: ALDOC
  Gene Name: aldolase C, fructose-bisphosphate
  ENST ID: ENST00000578590
  CDS Start-End: 473-839
agcctgcatcaccactagctcccctcagtctcatctctctctcaggctctctactcctttcagccttggtcctctgccctcccgtctgggtgtctgagttgtggggaattgaagtgcttcctattgctatcctcctgccaaacaggtgaagtgcttcctgggcacagagatgacccggaggtgtcactagccctagtctccacacactaacacagctgacccgctgggccctctttcctacatcactgcagccccactggggccaacctctggtactgggtgggaataggcaataggcataggcaggcaggtttggagtacagaaaaggagaagctgcaggagcctgtgactggtatttgtgccactcctactccctacctgttcttccaaccttttcctctagaagctgagagaagagggtggcaataagtacttttgcctcattctgaagccttggaaggagctgtcaccatgcctcactcgtacccagccctttctgctgagcagaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccaggtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggttgacaagggtgtggtgcctctagctgggactgatggagaaa

SEQ ID NO: 106476 - DNA, 922 bp, Homo sapiens
  Payload ID: 910
  Gene Symbol: ALDOC
  Gene Name: aldolase C, fructose-bisphosphate
  ENST ID: ENST00000460201
  CDS Start-End: 383-922
ggaaaggccaggacttttgcctacctcaacaagggaccaagttcagtgaaagaagggttggcatccttgattgggcagcagatttatcagaagagctgtggcttcagggctgctcacctccccacccccaccctgcatctttccccagggctgggaaggatgcctaccagggacaaaaggagatgtgggaactggagccctaagcttgctagctgtcagaaggactggtgccacttgatgcccaggactcatgccaaggactgctgccctgttcccagccccttgcttgatggggaggccatttggcccatctggccaggagaggcagcagagggtgaggtctggcttttttatcttgtctccactccagggagctgtcaccatgcctcactcgtacccagccctttctgctgagcagaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccaggtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggttgacaagggtgtggtgcctctagctgggactgatggagaaaccaccactcaagggctggatgggctctcagaacgctgtgcccaatacaagaaggatggtgctgactttgccaagtggcgctgtgtgctgaaaatcagtgagcgtacaccctctgcacttgccattctggagaacgccaacgtgctggcccgttatgccagtatctgccagcag

SEQ ID NO: 106477 - DNA, 580 bp, Homo sapiens
  Payload ID: 910
  Gene Symbol: ALDOC
  Gene Name: aldolase C, fructose-bisphosphate
  ENST ID: ENST00000581807
  CDS Start-End: 176-580
tttaccagagggagccagggctgcagcctcatctgtttgcggatcagaacccgagctgtgcttgtggctgcggctgctaactggctgcgcacagaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccaggtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggttgacaagggtgtggtgcctctagctgggactgatggagaaaccaccactcaagggctggatgggctctcagaacgctgtgcccaatacaagaaggatggtgctgactttgccaagtggcgctgtgtgctgaaaatcagtgagcgtacaccctctgcacttgccattctggagaacgccaacgtgctggcccgttat

SEQ ID NO: 106478 - DNA, 2132 bp, Homo sapiens
  Payload ID: 911
  Gene Symbol: ALG1
  Gene Name: ALG1, chitobiosyldiphosphodolichol beta-mannosyltransferase
  Uniprot ID: Q9BT22
  ENST ID: ENST00000262374
  CDS Start-End: 32-1426
gcggtcacgtgactgctgcgggccagccaagatggcggcctcatgcttggtcctgctggcgctgtgtctgctgctgccgctgctgctgctgggaggatggaagcgctggcgccgggggcgggcggcccggcatgtagtagcggtggtgctgggcgacgtgggccgcagcccccgtatgcagtaccacgcgctgtcgttggccatgcacggcttctcggtgaccctcctggggttctgcaactccaaaccccatgatgagctcttgcagaacaacagaattcagattgtggggttgacagaacttcagagtcttgcagttgggccccgagttttccagtacggagtcaaagttgtacttcaggctatgtacttgctgtggaagttgatgtggagggagccaggtgcctatatctttctccagaaccccccaggtctgcctagcattgctgtctgctggttcgtgggctgcctttgtggaagcaagctcgtcattgactggcacaactatggctactccatcatgggtctggtgcatggccccaaccatcccctcgttctgctggccaagtggtacgagaagttctttgggcgcctgtcccacctgaacctgtgtgttaccaatgctatgcgagaagacctggcggataactggcacatcagggctgtgaccgtctacgacaagcccgcatctttctttaaagagacacctctggacctgcagcaccggctcttcatgaagctgggcagcatgcactctccgttcagggcccgctcagaacctgaggacccagtcacggagcggtcggccttcacggagcgggatgctgggagcgggctggtgacgcgtctccgtgagcggccagccctgctggtcagcagcacgagctggacagaggacgaagacttctccatcctgctggcagctttagaaaagtttgaacaactgactcttgatggacacaaccttccttctctcgtctgtgtgataacaggcaaagggcctctgagggagtattatagccgcctcatccaccagaagcacttccagcacatccaggtctgcaccccctggctggaggccgaggactaccccctgcttctagggtcggcggacctgggtgtctgtctgcacacgtcctccagtggcctggacctgcccatgaaggtggtggacatgttcgggtgctgtttgcctgtgtgtgctgtgaacttcaagtgtttacatgagctggtgaaacatgaagaaaatggcctggtctttgaggactcagaggaactggcagctcagctgcagatgcttttctcaaactttcctgatcctgcgggcaagctaaaccagttccggaagaacctgcgggagtcgcagcagctccgatgggatgagagctgggtgcagactgtgctccctttggttatggacacataactcctgggccagaggctaaaaccccaggacccctgctgtccttcccgcagcttcttcttggagtctcagggcaaaccctttcgagcagcacctcccagtggccagaagctgaaatgacagcagtggtactgcctggtaaaagaattggttctgtgacccgggaagctttggttggccttgatttcttctctggaggcttggaaacgcttcctctcttcttctgttcttcacgccccatgcccctgctagcgtattactgttctgtgacttccctgtgacctctgcagaactcctcatcctgcgtttggtctccaggtgtcccctttctgccgtgttcctaacattttgattcctgtcttgaaaaaagcacctgctgcaccgtaagcccagggatgtggcagctgcagtgggcttggctttgtgaggaactgagtgtgtccacgttgggggaacatcatacttgatacacacgtttttatttgcacaaagaaaatgctatttttggagccagaattttcatgtctgatttatggtgattttcttaagaaccagaactgctggcagaaagggggcacccacacgcttagatagccgatgtcttattagagggcagtttgtggttcctgatttggaaattaacattctccaaacattccagtccaatgaaagttttatccgctttcccatataaaaattcttcccatga

SEQ ID NO: 106479 - DNA, 1419 bp, Homo sapiens
  Payload ID: 911
  Gene Symbol: ALG1
  Gene Name: ALG1, chitobiosyldiphosphodolichol beta-mannosyltransferase
  Uniprot ID: Q9BT22
  ENST ID: ENST00000544428
  CDS Start-End: 182-1243
cacgtgtcagaagtgtgttaagtgaatccattgcgtggtctcacgtaattctcctaactccaaaccccatgatgagctcttgcagaacaacagaattcagattgtggggttgacagaacttcagagtcttgcagttgggccccgagttttccagtacggagtcaaagttgtacttcaggctatgtacttgctgtggaagttgatgtggagggagccaggtgcctatatctttctccagaaccccccaggtctgcctagcattgctgtctgctggttcgtgggctgcctttgtggaagcaagctcgtcattgactggcacaactatggctactccatcatgggtctggtgcatggccccaaccatcccctcgttctgctggccaagtggtacgagaagttctttgggcgcctgtcccacctgaacctgtgtgttaccaatgctatgcgagaagacctggcggataactggcacatcagggctgtgaccgtctacgacaagcccgcatctttctttaaagagacacctctggacctgcagcaccggctcttcatgaagctgggcagcatgcactctccgttcagggcccgctcagaacctgaggacccagtcacggagcggtcggccttcacggagcgggatgctgggagcgggctggtgacgcgtctccgtgagcggccagccctgctggtcagcagcacgagctggacagaggacgaagacttctccatcctgctggcagctttagaaaagtttgaacaactgactcttgatggacacaaccttccttctctcgtctgtgtgataacaggcaaagggcctctgagggagtattatagccgcctcatccaccagaagcacttccagcacatccaggtctgcaccccctggctggaggccgaggactaccccctgcttctagggtcggcggacctgggtgtctgtctgcacacgtcctccagtggcctggacctgcccatgaaggtggtggacatgttcgggtgctgtttgcctgtgtgtgctgtgaacttcaagtgtttacatgagctggtgaaacatgaagaaaatggcctggtctttgaggactcagaggaactggcagctcagctgcagatgcttttctcaaactttcctgatcctgcgggcaagctaaaccagttccggaagaacctgcgggagtcgcagcagctccgatgggatgagagctgggtgcagactgtgctccctttggttatggacacataactcctgggccagaggctaaaaccccaggacccctgctgtccttcccgcagcttcttcttggagtctcagggcaaaccctttcgagcagcacctcccagtggccagaagctgaaatgacagcagtggtactgcctggtaaaagaattggttctgtgacccgggaagctttggttggc

SEQ ID NO: 106480 - DNA, 742 bp, Homo sapiens
  Payload ID: 911
  Gene Symbol: ALG1
  Gene Name: ALG1, chitobiosyldiphosphodolichol beta-mannosyltransferase
  ENST ID: ENST00000591783
  CDS Start-End: 240-742
ctttcctgggtgggtctctaggtatagccggcgttaatcttgccacgtgtcagaagtgtgttaagtgaatccattgcgtggtctcacgtaattctcctagtaagtggaacccagactccaaaccccatgatgagctcttgcagaacaacagaattcagattgtggggttgacagaacttcagagtcttgcagttgggccccgagttttccagtacggagtcaaagttgtacttcaggctatgtacttgctgtggaagttgatgtggagggagccaggtgcctatatctttctccagaaccccccaggtctgcctagcattgctgtctgctggttcgtgggctgcctttgtggaagcaagctcgtcattgactggcacaactatggctactccatcatgggtctggtgcatggccccaaccatcccctcgttctgctggccaagtggtacgagaagttctttgggcgcctgtcccacctgaacctgtgtgttaccaatgctatgcgagaagacctggcggataactggcacatcagggctgtgaccgtctacgacaagcccgcatctttctttaaagagacacctctggacctgcagcaccggctcttcatgaagctgggcagcatgcactctccgttcagggcccgctcagaacctgaggacccagtcacggagcggtcggccttcacggagcgggatgctgggagcgggctggtgacgcgtctccgtgagcggccagccct

SEQ ID NO: 106481 - DNA, 582 bp, Homo sapiens
  Payload ID: 911
  Gene Symbol: ALG1
  Gene Name: ALG1, chitobiosyldiphosphodolichol beta-mannosyltransferase
  ENST ID: ENST00000586840
  CDS Start-End: 29-582
gtcacgtgactgctgcgggccagccaagatggcggcctcatgcttggtcctgctggcgctgtgtctgctgctgccgctgctgctgctgggaggatggaagcgctggcgccgggggcgggcggcccggcatgtagtagcggtggtgctgggcgacgtgggccgcagcccccgtatgcagtaccacgcgctgtcgttggccatgcacggcttctcggtgaccctcctggggttctgcaactccaaaccccatgatgagctcttgcagaacaacagaattcagattgtggggttgacagaacttcagagtcttgcagttgggccccgagttttccagtacggagtcaaagttgtacttcaggctatgtacttgctgtggaagttgatgtggagggagccaggtgcctatatctttctccaggtctgcctagcattgctgtctgctggttcgtgggctgcctttgtggaagcaagctcgtcattgactggcacaactatggctactccatcatgggtctggtgcatggccccaaccatcccctcgttctgctggccaagtggtacgagaagttctttgggcgcctg

SEQ ID NO: 106482 - DNA, 1689 bp, Homo sapiens
  Payload ID: 911
  Gene Symbol: ALG1
  Gene Name: ALG1, chitobiosyldiphosphodolichol beta-mannosyltransferase
  ENST ID: ENST00000591822
  CDS Start-End: 2-256
gatggcggcctcatgcttggtcctgctggcgctgtgtctgctgctgccgctgctgctgctgggaggatggaagcgctggcgccgggggcgggcggcccggcatgtagtagcggtggtgctgggcgacgtgggccgcagcccccgtatgcagtaccacgcgctgtcgttggccatgcacggcttctcggtgaccctcctggggttctgcagtgagtggccaagggtctgggagggacgatgctctctcagccgttgatcctcggttctaaccgccccggggagtcgaggcggaagtgctcctttagtcgccgcctttgggcagctctccgagattagacgagcggttctgccccagcctttcctggactccaaaccccatgatgagctcttgcagaacaacagaattcagattgtggggttgacagaacttcagagtcttgcagttgggccccgagttttccagtacggagtcaaagttgtacttcaggctatgtacttgctgtggaagttgatgtggagggagccaggtgcctatatctttctccagaaccccccaggtctgcctagcattgctgtctgctggttcgtgggctgcctttgtggaagcaagctcgtcattgactggcacaactatggctactccatcatgggtctggtgcatggccccaaccatcccctcgttctgctggccaagtggtacgagaagttctttgggcgcctgtcccacctgaacctgtgtgttaccaatgctatgcgagaagacctggcggataactggcacatcagggctgtgaccgtctacgacaagcccgcatctttctttaaagagacacctctggacctgcagcaccggctcttcatgaagctgggcagcatgcactctccgttcagggcccgctcagaacctgaggacccagtcacggagcggtcggccttcacggagcgggatgctgggagcgggctggtgacgcgtctccgtgagcggccagccctgctggtcagcagcacgagctggacagaggacgaagacttctccatcctgctggcagctttagaaaagtttgaacaactgactcttgatggacacaaccttccttctctcgtctgtgtgataacaggcaaagggcctctgagggagtattatagccgcctcatccaccagaagcacttccagcacatccaggtctgcaccccctggctggaggccgaggactaccccctgcttctagggtcggcggacctgggtgtctgtctgcacacgtcctccagtggcctggacctgcccatgaaggtggtggacatgttcgggtgctgtttgcctgtgtgtgctgtgaacttcaagtgtttacatgagctggtgaaacatgaagaaaatggcctggtctttgaggactcagaggaactggcagctcagctgcagatgcttttctcaaactttcctgatcctgcgggcaagctaaaccagttccggaagaacctgcgggagtcgcagcagctccgatgggatgagagctgggtgcagactgtgctccctttggttatggacacataactcctgggccagaggctaaaaccccaggacccctgctgtccttcccgcagcttcttcttggagtctcagggcaaaccctttcgagcagcacctcccagtggccagaagctgaaatgacagcagtggtactgcctggt

SEQ ID NO: 106483 - DNA, 2671 bp, Homo sapiens
  Payload ID: 911
  Gene Symbol: ALG1
  Gene Name: ALG1, chitobiosyldiphosphodolichol beta-mannosyltransferase
  Uniprot ID: Q9BT22
  ENST ID: ENST00000588623
  CDS Start-End: 1101-2162
aagtcccagggtggccgctttcagctcggactgaattacctgcgctcttttcggctggcgggctggcgggcggtgctggtgatgttaactttttatctccagtcatttcaccctctccctggtttggtaactgaagccttctgaaatgaaccagtgtcaggctccagtgaggactccatccccaattcaggaagcacagaggtggagcataatccccccaatttgtttatgtgcggctgacttctctcaagatggtgtgcctgtttgggaaaacttttgtttgcaagacaatgtgaaagaaatccttaaagctcacagactgctgggtggatatgacattctggcccttggttcccccaagaaaacagcaacttgcagatagcaagtcaaacttgtcagcagaatccagggatgttcctcgaggcctgacaagttaagagcaatcatgggaaggcattcagaggaccgcagcagaggatcaggtcaagggaaacctacctcctaaaggaaagatcgagaagaaccatgcgccccaccacccacctgggctgctcagctgggcacagaagcagccaaggatattttcattcggatgctcacatatgactgagttgccacatgaggatgatccgtggcgattttccaccttgaggcaaagcaggacaatgcgtgtaaagaggtttgcagccccgggaccgggttttcagctggtttttctaccccaaagtccaatgcgtgcaggctgtcatcagcaccacagacagcaccagaacccatcataatgtcccagaaggttttattgctaaattagtgtcagagctccagggaacacattcagatatagtcacactgagtcagagctcgagggaagagctgtaagctgggaaccagagaaccgatgacaaggcagcggcctcttctggcagcttccggaggagcccccacttaatgggacgtcatcacttgaggcagcagactccaaaccccatgatgagctcttgcagaacaacagaattcagattgtggggttgacagaacttcagagtcttgcagttgggccccgagttttccagtacggagtcaaagttgtacttcaggctatgtacttgctgtggaagttgatgtggagggagccaggtgcctatatctttctccagaaccccccaggtctgcctagcattgctgtctgctggttcgtgggctgcctttgtggaagcaagctcgtcattgactggcacaactatggctactccatcatgggtctggtgcatggccccaaccatcccctcgttctgctggccaagtggtacgagaagttctttgggcgcctgtcccacctgaacctgtgtgttaccaatgctatgcgagaagacctggcggataactggcacatcagggctgtgaccgtctacgacaagcccgcatctttctttaaagagacacctctggacctgcagcaccggctcttcatgaagctgggcagcatgcactctccgttcagggcccgctcagaacctgaggacccagtcacggagcggtcggccttcacggagcgggatgctgggagcgggctggtgacgcgtctccgtgagcggccagccctgctggtcagcagcacgagctggacagaggacgaagacttctccatcctgctggcagctttagaaaagtttgaacaactgactcttgatggacacaaccttccttctctcgtctgtgtgataacaggcaaagggcctctgagggagtattatagccgcctcatccaccagaagcacttccagcacatccaggtctgcaccccctggctggaggccgaggactaccccctgcttctagggtcggcggacctgggtgtctgtctgcacacgtcctccagtggcctggacctgcccatgaaggtggtggacatgttcgggtgctgtttgcctgtgtgtgctgtgaacttcaagtgtttacatgagctggtgaaacatgaagaaaatggcctggtctttgaggactcagaggaactggcagctcagctgcagatgcttttctcaaactttcctgatcctgcgggcaagctaaaccagttccggaagaacctgcgggagtcgcagcagctccgatgggatgagagctgggtgcagactgtgctccctttggttatggacacataactcctgggccagaggctaaaaccccaggacccctgctgtccttcccgcagcttcttcttggagtctcagggcaaaccctttcgagcagcacctcccagtggccagaagctgaaatgacagcagtggtactgcctggtaaaagaattggttctgtgacccgggaagctttggttggccttgatttcttctctggaggcttggaaacgcttcctctcttcttctgttcttcacgccccatgcccctgctagcgtattactgttctgtgacttccctgtgacctctgcagaactcctcatcctgcgtttggtctccaggtgtcccctttctgccgtgttcctaacattttgattcctgtcttgaaaaaagcacctgctgcaccgtaagcccagggatgtggcagctgcagtgggcttggctttgtgaggaactgagtgtgtccacgttgggggaacatcatacttgatacacacgtttttatttgcacaaagaaaatgctatttttggagcc

SEQ ID NO: 106484 - DNA, 805 bp, Homo sapiens
  Payload ID: 912
  Gene Symbol: ALG1L
  Gene Name: ALG1, chitobiosyldiphosphodolichol beta-mannosyltransferase-like
  Uniprot ID: Q6GMV1
  ENST ID: ENST00000340333
  CDS Start-End: 165-728
cagactgctgtgctagcaatcagtgagactccgtgggcgtaggaccctctgagccaggtgcgggatataatcttgtggtgcgccgttttttaagccggtccgaaaagcgcaatattcgggtgggagtgacccgatttcccagctcagaacctgaggacgcagccatggagcggtcggccttcatggagctggatgctgggagcaggctggtgatgcatctccgcgagtggccagccctgctggtcagcagcacgggctggacagagtttgaacaacttactcttgatggacacaaccttccttctcttgtctgtgtgataacagggtcggtggacctgggtgtctgtctgcacatgtcctccagtggcctggacctgcccatgaaggtggtggacatgttcgggtgctgtttgcctgtgtgtgccgtgaacttcaagtgtttacatgagctggtgaaacatgaagaaaatggcctggtctttgaggactcagaggaactggcagctctgcagatgcttttctcaaactttcctgatcctgcaggcaagctaaaccagttttggaagaacctgcgggagtcgcagcagctccgatgggatgagagctgggtgcagactgtgctccctttggttatggacatacaactcctgggccagaggctaaaaccccgggacccctgctgtccttcccgcagcttcttctcggagtctcagggcaaacccttttgagcagcgcctcccagtggccagaagctgaaatgacggcagtggtgccgcctggtgaatgaattggttctgtgacccgg

SEQ ID NO: 106485 - DNA, 701 bp, Homo sapiens
  Payload ID: 912
  Gene Symbol: ALG1L
  Gene Name: ALG1, chitobiosyldiphosphodolichol beta-mannosyltransferase-like
  ENST ID: ENST00000611639
  CDS Start-End: 1-624
atgaagctgggtggcactcactctctgttcagggcctgctcagaacctgaggacgcagccatggagcggtcggccttcatggagctggatgctgggagcaggctggtgatgcatctccgcgagtggccagccctgctggtcagcagcacgggctggacagagtttgaacaacttactcttgatggacacaaccttccttctcttgtctgtgtgataacagggtcggtggacctgggtgtctgtctgcacatgtcctccagtggcctggacctgcccatgaaggtggtggacatgttcgggtgctgtttgcctgtgtgtgccgtgaacttcaagtgtttacatgagctggtgaaacatgaagaaaatggcctggtctttgaggactcagaggaactggcagctctgcagatgcttttctcaaactttcctgatcctgcaggcaagctaaaccagttttggaagaacctgcgggagtcgcagcagctccgatgggatgagagctgggtgcagactgtgctccctttggttatggacatacaactcctgggccagaggctaaaaccccgggacccctgctgtccttcccgcagcttcttctcggagtctcagggcaaacccttttgagcagcgcctcccagtggccagaagctgaaatgacggcagtggtgccgcctggtgaatgaattggttctgtgacccgg

SEQ ID NO: 106486 - DNA, 969 bp, Homo sapiens
  Payload ID: 913
  Gene Symbol: ALG1L2
  Gene Name: ALG1, chitobiosyldiphosphodolichol beta-mannosyltransferase-like 2
  Uniprot ID: C9J202
  ENST ID: ENST00000425059
  CDS Start-End: 187-834
gtgggaggtgacaccaggaggtaaccaggtggaaatcaccctcaagtagcagagacaggtgtgcaaaggctcagagggagcttctccaggatcagcagagctcgattgtagggtgtgaggctgtcacagaggctggagaaataagcagttccttgctaagaagtctgaattttaacctgaagggacatgggagctactgcaggctgggctgtgaccgtctacgacaagccggcatctttctttaaagaggcacctctggacctgcagcaccggctcttcatgaagctgggcagcacgcactctccgttcagggcccgctcagaacctgaggacccagacacagagcggtcggccttcacggagcgggattctgggagcgggctggtgacgcgtctccacgagcggccagccctgctggtcagcagcacaagctggacagagtttgaacaactgactcttgacggacagaaccttccttctctcgtctgtgtgataacaggcaaagggcctctgagggagtattacagccgcctcatccaccagaagcatttccagcacatccaggtctgcatcccctggctggagggccgaggactacccccgcttctagggtcggtggacctggatgtctgtctggacacgtcctccagtggcctggacctgcccatgaaggtggtggacatgttcaggtgctgtttgcctgcgtgtgccgtgaacttcaagtgtttacatgagctggtgaaacatgaagaaaaccgcctggtctttgaggactcagaggaactggcagctcagctgcagtattttgcagatgcttttctcaaactttcctgatcctgaaggcaagctaaaccagttccggaagaacctgcgggagtcgcagcagctctgatgggatgagagctgggtgcagactgtgctccctttggttatggacacataactcctgggccagaggctaaaacccca

SEQ ID NO: 106487 - DNA, 3128 bp, Homo sapiens
  Payload ID: 914
  Gene Symbol: ALG10
  Gene Name: ALG10, alpha-1,2-glucosyltransferase
  Uniprot ID: Q5BKT4
  ENST ID: ENST00000266483
  CDS Start-End: 320-1741
ctaagcagcaagccacgcacctcccgcgctggcgaaatccgagacccgccccttccggaagttttgacactttgtgcgccccgggcaatgcgattgagagggtaatcatccggtccgttatctaaacccgtcactccgggaaacagcgacccgatctttccggatccgcgctctcccagcatcctttgccttccggtatgtggccccgtctggctagtcccgcctagcgcgcccatttcgagcccaagtttccagctcgggtttccaggctcagaattttccaggagtaggttcttgggcagtggctgtgggagctggaatggcgcagctggaaggttactatttctcggccgccttgagctgtacctttttagtatcctgcctcctcttctccgccttcagccgggcgttgcgagagccctacatggacgagatcttccacctgcctcaggcgcagcgctactgtgagggccatttctccctttcccagtgggatcccatgattactacattacctggcttgtacctggtgtcaattggagtgatcaaacctgccatttggatctttggatggtctgaacatgttgtctgctccattgggatgctcagatttgttaatcttctcttcagtgttggcaacttctatttactatatttgcttttctgcaaggtacaacccagaaacaaggctgcctcaagtatccagagagtcttgtcaacattaacactagcagtatttccaacactttatttttttaacttcctttattatacagaagcaggatctatgttttttactctttttgcgtatttgatgtgtctttatggaaatcataaaacttcagccttccttggattttgtggcttcatgtttcggcaaacaaatatcatctgggctgtcttctgtgcaggaaatgtcattgcacaaaagttaacggaggcttggaaaactgagctacaaaagaaggaagacagacttccacctattaaaggaccatttgcagaattcagaaaaattcttcagtttcttttggcttattccatgtcctttaaaaacttgagtatgcttttgcttctgacttggccctacatccttctgggatttctgttttgtgcttttgtagtagttaatggtggaattgttattggcgatcggagtagtcatgaagcctgtcttcattttcctcaactattctactttttttcatttactctctttttttcctttcctcatctcctgtctcctagcaaaattaagacttttctttccttagtttggaaacgtagaattctgttttttgtggttaccttagtctctgtgtttttagtttggaaattcacttatgctcataaatacttgctagcagacaatagacattatactttctatgtgtggaaaagagtttttcaaagatatgaaactgtaaaatatttgttagttccagcctatatatttgctggttggagtatagctgactcattgaaatcaaagtcaattttttggaatttaatgtttttcatatgcttgttcactgttatagttcctcagaaactgctggaatttcgttacttcattttaccttatgtcatttataggcttaacatacctctgcctcccacatccagactcatttgtgaactgagctgctatgcagttgttaatttcataacttttttcatctttctgaacaagacttttcagtggccaaatagtcaggacattcaaaggtttatgtggtaatatcagtgatatttcgaactgtgaaaatggacttaataattagaccatttctacaaagaacaactgaataggtggaaaacatggaatttcttttaggtgcagtggtggtcttcaaattacattagttttttttatatatattttaaacatatgtaagaaattaagtggcaaagaactgagaaagcttaagacctgcttcaaaagcctgaaaaatggaaaaataaaattgttttcagatatctcatatcactctcataatgttggccccttaaaaagcttgggaatgttttgtatgtacaagtttattaaaactgggtatgcttcatattactggaatgaatttattctcttcagagagaaatattaggttagtgcaaaagtaattgtggtttttgccattgaaagtaatggcaaaaccacaattacttttttaccaacctaataacaatgtattagcaaatatttacaaatggtcaggtgatattcttgattgaaaagttgcttaacatttcagtaatataattttaattctaagtcaaaatacaaatgcatagatagtaaatgataaagtagagactcatatatgcctgtctagacatcaaattgttggttattgtttacaatctagaaatgatgaagctctttcactaattcctaatatgaaatgtatgatggccaaagacaaattgtattgattataatcctttaaaagggggatttcctttctgaaatacatattgtattagcttcccagggcttccataacaaatgacgacaaacttgggtgcttacaacaattttcctcacagtctggaggccagaagtctaaaatcaaagtgtcagcagagttggttccttctggaggctctaaggaagaatccataaacagacattctatgtctgtttcctaatatcttgtggctgtgtgcaattcttggagttctttggcttctggacaaatcttgtccaagtattgcagacagcaatcttcactccagtctctgcctctgtgttcacacggcctttccctctgtcttctcttcattaccttttaaggacagtgtctttgaatgtagggcccaccctgatctagggtgattgtgtctggagacccttaattatgtttacaaagacccatgttccaagtaagtttgtattcacatgatctgagtagacattgtctcttcgtgggatacttttcagtccatgacagttactaaaggacattttaggatagtcttcatatgattgttaggagactacctttttagattttttttattatatatcaaattatagttgtatatacttatgagaaacaaagtggcattatgatttttgaatataatgtgggattaaataaagctaatctatccatcacctcaaa

SEQ ID NO: 106488 - DNA, 1637 bp, Homo sapiens
  Payload ID: 914
  Gene Symbol: ALG10
  Gene Name: ALG10, alpha-1,2-glucosyltransferase
  ENST ID: ENST00000541875
  CDS Start-End: 128-361
ccggtatgtggccccgtctggctagtcccgcctagcgcgcccatttcgagcccaagtttccagctcgggtttccaggctcagaattttccaggagtaggttcttgggcagtggctgtgggagctggaatggcgcagctggaaggttactatttctcggccgccttgagctgtacctttttagtatcctgcctcctcttctccgccttcagccgggcgttgcgagagccctacatggacgagatcttccacctgcctcaggcgcagcgctacttgggatcccatgattactacattacctggcttgtacctggtgtcaattggagtgatcaaacctgccatttggatctttggatggtctgaacatgttgtctgctccattgggatgctcagatttgttaatcttctcttcagtgttggcaacttctatttactatatttgcttttctgcaaggtacaacccagaaacaaggctgcctcaagtatccagagagtcttgtcaacattaacactagcagtatttccaacactttatttttttaacttcctttattatacagaagcaggatctatgttttttactctttttgcgtatttgatgtgtctttatggaaatcataaaacttcagccttccttggattttgtggcttcatgtttcggcaaacaaatatcatctgggctgtcttctgtgcaggaaatgtcattgcacaaaagttaacggaggcttggaaaactgagctacaaaagaaggaagacagacttccacctattaaaggaccatttgcagaattcagaaaaattcttcagtttcttttggcttattccatgtcctttaaaaacttgagtatgcttttgcttctgacttggccctacatccttctgggatttctgttttgtgcttttgtagtagttaatggtggaattgttattggcgatcggagtagtcatgaagcctgtcttcattttcctcaactattctactttttttcatttactctctttttttcctttcctcatctcctgtctcctagcaaaattaagacttttctttccttagtttggaaacgtagaattctgttttttgtggttaccttagtctctgtgtttttagtttggaaattcacttatgctcataaatacttgctagcagacaatagacattatactttctatgtgtggaaaagagtttttcaaagatatgaaactgtaaaatatttgttagttccagcctatatatttgctggttggagtatagctgactcattgaaatcaaagtcaattttttggaatttaatgtttttcatatgcttgttcactgttatagttcctcagaaactgctggaatttcgttacttcattttaccttatgtcatttataggcttaacatacctctgcctcccacatccagactcatttgtgaactgagctgctatgcagttgttaatttcataacttttttcatctttctgaacaagacttttcagtggccaaatagtcaggacattcaaaggtttatgtggtaatatcagtgatatttcgaactgtgaaaatggacttaataattagaccatttctacaaagaacaactgaataggtggaaaacatggaatttcttttaggtgcagtggtggtcttca

SEQ ID NO: 106489 - DNA, 571 bp, Homo sapiens
  Payload ID: 914
  Gene Symbol: ALG10
  Gene Name: ALG10, alpha-1,2-glucosyltransferase
  ENST ID: ENST00000538927
  CDS Start-End: 133-513
gccttccggtatgtggccccgtctggctagtcccgcctagcgcgcccatttcgagcccaagtttccagctcgggtttccaggctcagaattttccaggagtaggttcttgggcagtggctgtgggagctggaatggcgcagctggaaggttactatttctcggccgccttgagctgtacctttttagtatcctgcctcctcttctccgccttcagccgggcgttgcgagagccctacatggacgagatcttccacctgcctcaggcgcagcgctactgtgagggccatttctccctttcccagtgggatcccatgattactacattacctggcttgtacctggtgtcaattggagtgatcaaacctgccatttggatctttggatggtctgaacatgttgtctgctccattgggatgctcagatttgttaatcttctcttcagtgttggcaacttctatttactatatttgcttttctgcaaggtacaacccagaaacaaggaatacttctgagaggagaagcttccactctgatctagtctggcaaaattgaggaaaatattctaccctg

SEQ ID NO: 106490 - DNA, 10253 bp, Homo sapiens
  Payload ID: 915
  Gene Symbol: ALG10B
  Gene Name: ALG10B, alpha-1,2-glucosyltransferase
  Uniprot ID: Q5I7T1
  ENST ID: ENST00000308742
  CDS Start-End: 317-1738
aagcagcaagccacgcccctcccgcgctcgcgaaatccgagacccgccctttccggaagttttgacactgtgcgccccgagtaatgtgatggagagggtaatcatccggtccgttatctaaacccgtcactccaggaaacagcgacccgctgttttccggatccgcgctctcccagcatcctttgccttccggtatgtggccccgtctggctagtcctgtctagcgcgcccatttcgagcccaagtttccagctcgggtttccgggctcagaattttccaggagtgggttcttgggcagtggctgtgggagcaggaatggcgcagctagagggttactgtttctcggccgccttgagctgtacctttttagtgtcctgcctcctcttctccgccttcagccgggcgctgcgagagccctacatggacgagatcttccacctgcctcaggcgcagcgctactgtgagggccatttctccctttcccagtgggatcccatgattactacattacctggcttgtacctggtgtcagttggagtggtcaaacctgccatttggatctttgcatggtctgaacatgttgtctgctccattgggatgctcagatttgttaatcttctcttcagtgttggcaacttctatttactatatttgcttttccacaaggtacaacccagaaacaaggctgcctcaagtatccagagagtcttgtcaacattaacactagcagtatttccaacactttatttttttaacttcctttattatacagaagcaggatctatgttttttactctttttgcatatttgatgtgtctttatggaaatcataaaacttcagccttccttggattttgtggcttcatgtttcggcaaacaaatatcatctgggctgtcttctgtgcagggaatgtcattgcacaaaagttaactgaggcttggaaaactgagctacaaaagaaggaagacagacttccacctattaaaggaccatttgcagaattcagaaaaattcttcagtttcttttggcttattccatgtcctttaaaaacttgagtatgcttttctgtttgacttggccctacatccttctgggatttctgttttgtgcttttgtagtagttaatggtggaattgttattggcgatcggagtagtcatgaagcctgtcttcattttcctcaactattctactttttttcatttactctctttttttcttttcctcatctcctgtctcctagcaaaattaagacttttctttccttagtttggaaacatggaattctgtttttggtggttaccttagtctctgtgtttttagtttggaaattcacttatgctcataaatacttgctagcagacaatagacattatactttctatgtgtggaaaagagtttttcaaagatatgcaattctgaaatatttgttagttccagcctatatatttgctggttggagtatagctgactcattgaaatcaaagccaattttttggaatttaatgtttttcatatgcttgttcattgttatagttcctcagaaactgctggaatttcgttacttcattttaccttatgtcatttataggcttaacataactctgcctcccacatccagacttgtttgtgaactgagttgctatgcaattgttaatttcataactttttacatctttctgaacaagacttttcagtggccaaatagtcaggacattcaaaggtttatgtggtaatatcagtgatattttgaactgtaaaaatggacttaataattagaccatttctacaaagaacaactgaataggtggaaaacatggaatttcttttaggtgcagtggtggtcctcaaattacattagtttttttaatatatattttaaacatatgtaagaaattaagtggcaaagaactgggaaagcttaagacctgcttcaaaagcctgaataatgggaaaataaaattgttttcagatatctcatatcgctctcgtaatgttggcccctcacaaagcttgggaatgttttgtatgtataagtttattaaaactgggtatgcttcatattactagaactaatttattctcttcagagagaactattaggttagtgcaaaagtaattgtggtttttgccattgaaagtaatggcaaaaccacaattacttttgtaccaacctaataacaatgtgttagcaaatatttacaaatggtcaggtgatattcttgactgaaaagttccttaacatttcagtaaatataattttaattctaagtcaaaatagaaatgcatagatagtaaatgataaagtagagactcatatatgtctgtctaggcatcaaattgttggttattgtttacaatccagaaatgatgaagctctttcactaattcctaatatgaaatgtatgatggccaaagacaaattgtgttgattataatcctttaaaagggggatttcctttatgaaatacatattgtattagcttcccagggctgccataacaaatgaccacaaacttgggtgcttacaacaattttcctcacagtctggaggccagaagtctaaaatcaaagtgtcagcagagttggttccttctggaggctctaaggaagaatccattctatgtctgtttcctaatatcttgtggctgtctgcaattcttggagttctttggcttatgggcatatcttgtctaagtattgcagacagcaatcttcactccagtctctgcctctgcgttcacacggcctttccctctgtcttttcattaccttttaaggacagtgtctttgaatgtagggcccaccctgatctagggtgattgtgtctggagacccttaattatgtttacaaagacccatgttccaagtaagtttgtattcacatgttctgagtagacattgtctcttcatgggatacttttcagtccatgacagttactaaaggacattttaggataatcctcatatgattgttaggagactacctttaaaaattttttattatatatcaaattatagttgtatatacttatgaggtacgaagtggcattatgatttttgaatataatgtgggatgattaaataaagctaatctatccatcacctcaaatatttgacatattttgtgatgaaaacatttgaaatgtactctcaacagtattgaaatgtacatacagtgcttaattattagctgtattcaccatgttgtgtaatagatctaaaaaaagtcaaacatattccttctatctaattgaggctttgtatcttttgattgtcatctccctattcccacatccccggcctctagcaaccatcattcttctctctacttctgtgagtttaattgttttagattacacaaataagtgagatcatgtggtatttgtctttctgtgcttggcttatttcacttaccataatgtcctccacgatcatccatattgttgcaaatgacacaatttcttcctttttaaaggctgaatagtatttttttgtatatatatgccacattttctttatccattcatccatggatggacacttaggttgatcgaatcacttggttattgtgacttgtctgcaatgaacatagagtgcagacttctctttgacatacggatttcaaatcttctggataaatagccagaagtgggattgttggatcaggagataatatcttagctgataccttttaaataactctcagtatctttactgagaggttaaaaaataagtgacttcttaggtaatataaagctaaaggtgactagtgtttgattccattatctattaaaaaaagtcagaattgaaagaaagttgagaaatcctttggtctgactttgtagattagggaacaactgctggggtaggattattttgtgttactttttgaattttgtgtttattattttgagtgtattttttgggttgtcattccattacaggaaagtattatttgggcatgttaactttgacatgtaaacttagaattgtgaatagaactcatcttttaacataattttatgtttctaaactttaaaagtagctataagtgaacaaattactttcccctcaatgtcaaattttgcttctctgagttttaagtgatgagtctacatttacaaatataaaattgtgtgcaggtgaaaattacaagtataatttgagtaataaatgcaggccattttttggttgtactctagtactcagaaaatagatcggcattagttataacagtgattgtagaaaaacgtgttttacccagacttcttaaaaattagatgagagaggacactcaaagaaattatacttttgtcattaatttactatagtggagaactaaatctgggaagtcaaaattgaaaaaagaatgtgtaatttagggaaagtaactttttgtctgataatattaatgcaaggattttgtatttaggaatacttctgagaggagaagcttccactctgatctagtctggcaaaattgaggaaaatattctaccctgtaattaaagaagactgctctttggagggatcactgttctatatctttttttgtttgtttttgtctttgaggagaagtctcgctcttgtcccccaggctggaatgcaatggcgcgatcttggctcactgaaacctccacctcctgggttcaagcagttctcctgcctcagcctcccgagtagctgagattataggcgcccaccaccaagcctggctaattttttctatttttagtagagccggggtttcaccgtgttagccaggctggtctcgaactcctgacctcaggtaatccacctgcctcgcctcccaaagtgctgggattacaggcgtgagccactgtgcccagctcttctagttcatttttaagtgttgagtccctgctgtttaagagatgttttggtgaaaatctacattcagagagaaacaggttaatcttccacattttttataaaatacataaaatatagtacttggcattttaagaaaagaatgccatgtattaaaaggtgctattttcaactatttattattttaaaacaggaatgcttatcaatactttcgaatttaagataaatgtcttcgttaaattttctaggcagttcaaagatggccatttgctggtgaattttccaaaatagataacagataaaatgattatgtaagaacttggcacaacagatcattttgcctttagtcgttcaagaaatgatactaaactcaaagtcattcacttgaaacaactgagaagaccattcttaggtgtttagatccttgcttttagaaacattcttagttatatttgtgttttcaaaagttattgagtagatagatattttttcatgaatttttaaacattagacttagctgaattgattaaaattaggtgattatgaaaaaaatattgccctgctcgagggcatctggagccctacagttaccattactaaagtctgtgagtatgtctattttgaaaagtgtcataaaaatatctagtccataaatcattataggttcagtaatacatcattttgaactgattctatcttctgtgaaattctagagatatgttatctttaggtagcatgagtaagattcaggtatgctgtgaattttgttaacgtttatgttttccattaatggatagtcaggaatcttttgaactgcgtctatgtatttaaatgatttggaaagatagcatctctcagtttaaacttagcatctcattttggcaagataaattattttagctgtctggccttttctttgtcttcttagagttatttctgaaatgtgcatagccagtcataaaataacttgtgtaaatagcctaatgtaatttatttctaataaatacgtagcttaatgaaatgtatttctagtttgaacttaattgccacttggcttgatattattttccttagaattgttggaagagaggagagaggaagggatctaccatttttatttataccacctaaatagtggactgttattttggactcacttttaaataaaatatttattcacatgaagaaataaattttgtgtttattaggttagcaagcgtttattatctttgaagtaattggaatttcattaaaaagtgaagcaagtaagaattgtgatataaatttgaaaatttttaaatggaaattgaaatatgacttaggaactgtgggcttgtagaaaaaaacatttaacatgggagttaagatttttatatttggttgtggctctgggatcaataaggcaagtggtttagtctttagtcctcatttcaaatgagaatagtatttgtcctaactctagtcagtgtctgattggtatgtgtataaccttattttaaaaaggattcattcctgccatatactcataatatttataagtatgtcatatgataaatattgagtaaatatatactgaatgaagtttttagtatagagtgaagtgaatagaaaaaacatcctacataaccgtggctaattttaggaagtaaatcatgtttcataataagagtcatcctaaacatttttctgtgtaattttctgacccagtgttaacaatttttatttgccttagtgcaagcttgttcaacccacaggccacatgcagcccaggatggctttgaatgcggccccaacacaaattttgtaagctttcttaaaacatgatgagatattttgtgattttattttattttattttatttattattttattttattttattttattttttagctcatcagctatcattagtgttcgtgtattttatgtgtggcccaagatggttcttccagtgtggcccagggaagccaaaagattggagacccctgctagcatttaatgcttatacatgtatttacttgtaaacatgttgtttctttgataggatatgatttcaacataattactgtttatttaaaataagaaaaacaaataactttcaaccattaaaaggttataacactttaaaggaaagtttcttattaaagaaactttataccctattaagggtataatttcaaaataattgctttttatttaaaataagaaaatattcttatttctatttaaaataagaaaaatcagtaaccttcaacgaataacaggttaaagaatttaaaggtaaaagacatttcaactaattacaaatactttgttttttttagttgggctacattttaccactctaggaatagctgttaattattttttatatagggcatttttatgtatttaatgttgacaactgacgtttccaatatacaaaaacttgtgtaactgagaaaattataataaaaatagagattgaggacatatttttaacatatatccatgagtcaacactaatatttaatatttgagatttgaaaaattatttctagggtaagaaattctgtcacaatataatatctctatattgtgcttttttaagagataaatttttgatgaatttaatgttaattaaattttatctcagcctatcaccatcagaccaaaagacaatacagtatttttctaacaaggaaaagaaaatacatatatatatatttatatatacaaatatatacgtatttatatatacaaatttgtatatatgtaatgtatgtgtgtgtgtatacatataatttctccttttttttttttgtaagaattgagacagggtgtcactatgttgtgtgggctggtctcaaaacacctgcctcaagtgatcctcccaccttggcctcccaaagtgctaggatttacaatgagccactgtgccagcttccaacaagaaaaatattaaatgtattggtttttcacagtgaaacttaattcagtttagttgaaccatatatgtgtgtgtatggcatatataagatgaaaaaaggagaaaaagtaacaataataatgatggttgccatcattcattgaacacctataatgttttaggcattatactagctgatttacaaatattgtctcatttgatgctacatttatatttctatgaggcagatgttgatttctctttgactgctgaagaaactgaaggtcggtcaggtcaggtgatttgcccaaagtccacactgtcactaaatgaacatagattggtatgactcccaagcctgtgagtttttgaccgtcatattctgcctcactatgaaaagttttttttcaattttttttaaatcaaaagaagtagtatatggagagagaggtgaaaatccatgtttgctctctgcagtttccaaaccattcatgacgtgttatttttgtactggatatagtcattttttaaaatgctacaaactgttcaaaagagcatgaacaacatgataactccttataattttgttgtaagataaatgactaaaattatgtgggatatttaatttggataagtggaaattctatcacttgataagctctcttgaagaataattatttgaaagattggacttaattctgtattgcctgaagtgtaaatcagaggtcaacaattagattgcaaatcatgaaaagcataacttctaattgtttagtctttttagggaaacaagcccagaaaaaaagtaagattctcattcattggagataagatttctatttatcaaagatactacacaagagttagatagcaagtagttcaaatgtcttttaaaggtatctgacatctttaaagctctgtaatttttaaattctaaattttgttacagctaatttttaaaaattaattgctaagtcatggtcaagtatttctgatgacttacatgctgtctttggtatattttaagtttctaaaccaaaactactatttgactctattacaccctgttttagaaaaacatttgagttatacaacttactaaaatgtattttagcggtgatgttttggagcactggtaatatagtgtttaacttattttctattttttatccctctatattcgtgaaattacttctatttgaaaagttttccgccagtgataaaaaaaggctgagcactatctgtaaaaatttttaaggtgtccactaggtggagatattgtgctacatttccaagtgttgtagttaaacttttattagtctgaattaaactcttttatagtgttttattgttttaaaccacaaagatttataatcatttatatctatttatctaatgttattcaaatgttttctgcgttgtatgaagctaagataaatgtaaaaaaaacaaacaaaaaaaacctcactttgtgttttgtaatcattagacgatttaacctaatatatcttcccatatgatatgatctttgcatatggcatacttcattcatatgacatagttagaatcttttcccacaaacaatgagtgatgatatctcatttgaaaactcgtgtaacattgtatcagccactgttataaagtgatttacccatgttagtctcataacaactctatgagatcagtaccgtacacatggggaaacttagtatagagaggtgaagtattttttccaagattacaaaataactgtctgagctgggattcgtaaccaggcagcctgactccaaaatcaatattcttaactctattgttatgatggagaaaggcatgaagtctaccttcaaattcatggcattttagaaggaaaaattgtcgcaagtaatgtgattatacttcctagttttataggtcagaaaaatgaggtccacactaattttgcctcttccacagggagatagattctcatctaccattgtgtcttttgtttctgtttttgtcatgatacctcaaattgatatatgttgtaattatgaatttaaggaagtaaaaaaataactcagggctggagccttcagccatattaacatacattgacataaagacctttgttttaatatgaatgattccagttaacaaatggagaaatagttgtttgaaaattaatatttagcttctcaaaagagactcctgtttggaagcaaattgttggtttaacaggacatactttagatatttgaaaaattctctgtggaatcacaatctcttatttttaagaatgtaggaatatgtgttctatatgcttttaagttatgtattacatactattctctaaaatagaaatgtttatttggcttctaaaagtcatttgtgagttgatgttatttaaaactgcttttcagtcaacttattctttataaaaaagtttgttcaaatagcatgtttttattttgtttctaaataaattcatgtttgataatattttata

SEQ ID NO: 106491 - DNA, 571 bp, Homo sapiens
  Payload ID: 915
  Gene Symbol: ALG10B
  Gene Name: ALG10B, alpha-1,2-glucosyltransferase
  ENST ID: ENST00000551464
  CDS Start-End: 133-513
gccttccggtatgtggccccgtctggctagtcctgtctagcgcgcccatttcgagcccaagtttccagctcgggtttccgggctcagaattttccaggagtgggttcttgggcagtggctgtgggagcaggaatggcgcagctagagggttactgtttctcggccgccttgagctgtacctttttagtgtcctgcctcctcttctccgccttcagccgggcgctgcgagagccctacatggacgagatcttccacctgcctcaggcgcagcgctactgtgagggccatttctccctttcccagtgggatcccatgattactacattacctggcttgtacctggtgtcagttggagtggtcaaacctgccatttggatctttgcatggtctgaacatgttgtctgctccattgggatgctcagatttgttaatcttctcttcagtgttggcaacttctatttactatatttgcttttccacaaggtacaacccagaaacaaggaatacttctgagaggagaagcttccactctgatctagtctggcaaaattgaggaaaatattctaccctg

SEQ ID NO: 106492 - DNA, 1565 bp, Homo sapiens
  Payload ID: 915
  Gene Symbol: ALG10B
  Gene Name: ALG10B, alpha-1,2-glucosyltransferase
  ENST ID: ENST00000548240
  CDS Start-End: 56-289
ccgggctcagaattttccaggagtgggttcttgggcagtggctgtgggagcaggaatggcgcagctagagggttactgtttctcggccgccttgagctgtacctttttagtgtcctgcctcctcttctccgccttcagccgggcgctgcgagagccctacatggacgagatcttccacctgcctcaggcgcagcgctacttgggatcccatgattactacattacctggcttgtacctggtgtcagttggagtggtcaaacctgccatttggatctttgcatggtctgaacatgttgtctgctccattgggatgctcagatttgttaatcttctcttcagtgttggcaacttctatttactatatttgcttttccacaaggtacaacccagaaacaaggctgcctcaagtatccagagagtcttgtcaacattaacactagcagtatttccaacactttatttttttaacttcctttattatacagaagcaggatctatgttttttactctttttgcatatttgatgtgtctttatggaaatcataaaacttcagccttccttggattttgtggcttcatgtttcggcaaacaaatatcatctgggctgtcttctgtgcagggaatgtcattgcacaaaagttaactgaggcttggaaaactgagctacaaaagaaggaagacagacttccacctattaaaggaccatttgcagaattcagaaaaattcttcagtttcttttggcttattccatgtcctttaaaaacttgagtatgcttttctgtttgacttggccctacatccttctgggatttctgttttgtgcttttgtagtagttaatggtggaattgttattggcgatcggagtagtcatgaagcctgtcttcattttcctcaactattctactttttttcatttactctctttttttcttttcctcatctcctgtctcctagcaaaattaagacttttctttccttagtttggaaacatggaattctgtttttggtggttaccttagtctctgtgtttttagtttggaaattcacttatgctcataaatacttgctagcagacaatagacattatactttctatgtgtggaaaagagtttttcaaagatatgcaattctgaaatatttgttagttccagcctatatatttgctggttggagtatagctgactcattgaaatcaaagccaattttttggaatttaatgtttttcatatgcttgttcattgttatagttcctcagaaactgctggaatttcgttacttcattttaccttatgtcatttataggcttaacataactctgcctcccacatccagacttgtttgtgaactgagttgctatgcaattgttaatttcataactttttacatctttctgaacaagacttttcagtggccaaatagtcaggacattcaaaggtttatgtggtaatatcagtgatattttgaactgtaaaaatggacttaataattagaccatttctacaaagaacaactgaataggtggaaaacatggaatttcttttaggtgcagtggtggtcctca

SEQ ID NO: 106493 - DNA, 1404 bp, Homo sapiens
  Payload ID: 916
  Gene Symbol: ALG11
  Gene Name: ALG11, alpha-1,2-mannosyltransferase
  ENST ID: ENST00000523764
  CDS Start-End: 22-132
gagttcgggggtcggcggaagatggcggccggcgaaaggagctggtgcctgtgcaagttgttgaggagttgtggagtgtatggcagctggcacaattatccttgcacacaattcggggggcccaaagcttgacattgtggttcctcacgaaggagatataactggctttctggctgagagtgaagaagactatgctgaaactatcgctcacattctttccatgtctgcagaaaagagactccaaatcagaaaaagtgctcgtgcatctgtaagcagattctctgatcaggaatttgaagtgacattcctatcatctgtggaaaagttatttaagtaatgccatatctgtaaaattaaagatattttatataaactggttaaacaccttcatatgtaaatatttttctaaattcaatctcatttgtcaaatcattttactttagaaaacagacaaaatttccttttagaataaaaggaagtgttgaaaagaaaatggatgactagccttcggcttccattcttggtatacatgagagaggctggctgctgagatgaatgtgaaccaggttgcagagaatctggctttgagccaccaggaagaactagtggatttgccaaaaaactaccccttgagtgaaaatgaagatgagggggacagtgatggagagagaaagcatcaaaagcttctggaagcaatcatttcccttgatggaaagaataggcggaaattggctgagaggtctgaggctagtctgaaagtgtcagagttcagtgtcagttctgaaggatcaggagaaaagctgggccttgcagatctgcttgagcccgttaaaacttcatcttctttggccactgtaaaaaagcaactgaatagagtcaaatcaaagaaggtggtggagttacctcttaacaaagaaaaaattgaacagatccacagagaagtagcattcagtaaaacctcacaggtcctctccaaatgggaccctatcatcctgaagaaccagcaggcagagcagctggtttttcccctggggaaggagcagccagccattgctcccattgaacatgcgctcagtggctggaaggcaagaactcccctggagcaggaaatttttaacctcctccataagaacaagcagccagtgacagatcctttactgactcccatggaaaaggcctctctccaagccatgagcctggaagaggcaaagatgcaccgagcagagcttcagagggctcgggctctgcagtcctactatgaggccaaggctcgaaaagagaagaaaatcaaaagtaaaaagtatcacaaagtcgtgaagaaaggaaaggccaagaaagccttaaaagagtttgagcagctacagaaggttaatccaactgtggcactggaagaaatggaaaaaa

SEQ ID NO: 106494 - DNA, 2558 bp, Homo sapiens
  Payload ID: 916
  Gene Symbol: ALG11
  Gene Name: ALG11, alpha-1,2-mannosyltransferase
  Uniprot ID: Q2TAA5
  ENST ID: ENST00000521508
  CDS Start-End: 6-1484
ggaagatggcggccggcgaaaggagctggtgcctgtgcaagttgttgaggtttttttattcattattcttccctgggctcattgtatgtggaactttatgtgtgtgtttggtcattgtcctttggggaatcagactgctgctacagagaaagaaaaaattagtgtcaactagcaaaaatgggaaaaatcaaatggtgattgcattttttcatccatactgcaatgctggtggaggaggagaaagagttttatggtgtgctttaagagccctgcagaaaaagtatcctgaagcagtttatgttgtttataccggcgatgttaatgtcaacggtcaacagatactagaaggtgctttcagaagatttaacatcagattaattcacccagtgcagtttgtttttttaaggaaacgctatcttgtggaagattcactgtatcctcacttcacactgctgggccaaagtctaggatccatttttcttggctgggaagctctaatgcagtgtgttcctgatgtttacattgattcaatgggatacgcttttacgcttcctctgtttaagtatatagggggttgccaagttggaagctatgttcattatcctactatcagcaccgacatgctctctgtagtgaagaatcaaaatattggatttaataatgcagccttcattaccaggaatccttttctcagcaaagtaaagctcatctactactatttatttgcttttatttatggacttgttggttcttgcagtgatgtagtcatggtcaattcttcttggacactaaaccatattctctcactatggaaagttgggaattgcactaacattgtttatccaccttgtgatgtgcagacatttctggacattcccttacatgagaaaaagatgaccccaggacatttgctggtttctgttggccagtttaggccggaaaagaatcatccattgcagatcagagcctttgctaaattgctgaataagaagatggttgagtcacctccttcgcttaaacttgtcctcattggaggttgtcgtaacaaagatgatgaacttagggtaaaccaactgagaaggctgtctgaggatttaggagttcaagaatatgtggaatttaaaataaacattccatttgatgaattaaagaattatttgtctgaagcaacaattggtctgcataccatgtggaacgagcattttgggattggagttgtggagtgtatggcagctggcacaattatccttgcacacaattcggggggcccaaagcttgacattgtggttcctcacgaaggagatataactggctttctggctgagagtgaagaagactatgctgaaactatcgctcacattctttccatgtctgcagaaaagagactccaaatcagaaaaagtgctcgtgcatctgtaagcagattctctgatcaggaatttgaagtgacattcctatcatctgtggaaaagttatttaagtaatgccatatctgtaaaattaaagatattttatataaactggttaaacaccttcatatgtaaatatttttctaaattcaatctcatttgtcaaatcattttactttagaaaacagacaaaatttccttttagaataaaaggaagtgttgaaaagaaaatggatgactagccttcggcttccattcttggtatacatgagagaggctggctgctgagatgaatgtgaaccaggttgcagagaatctggctttgagccaccaggaagaactagtggatttgccaaaaaactaccccttgagtgaaaatgaagatgagggggacagtgatggagagagaaagcatcaaaagcttctggaagcaatcatttcccttgatggaaagaataggcggaaattggctgagaggtctgaggctagtctgaaagtgtcagagttcagtgtcagttctgaaggatcaggagaaaagctgggccttgcagatctgcttgagcccgttaaaacttcatcttctttggccactgtaaaaaagcaactgaatagagtcaaatcaaagaaggtggtggagttacctcttaacaaagaaaaaattgaacagatccacagagaagtagcattcagtaaaacctcacaggtcctctccaaatgggaccctatcatcctgaagaaccagcaggcagagcagctggtttttcccctggggaaggagcagccagccattgctcccattgaacatgcgctcagtggctggaaggcaagaactcccctggagcaggaaatttttaacctcctccataagaacaagcagccagtgacagatcctttactgactcccatggaaaaggcctctctccaagccatgagcctggaagaggcaaagatgcaccgagcagagcttcagagggctcgggctctgcagtcctactatgaggccaaggctcgaaaagagaagaaaatcaaaagtaaaaagtatcacaaagtcgtgaagaaaggaaaggccaagaaagccttaaaagagtttgagcagctacagaaggttaatccaactgtggcactggaagaaatggaaaaaattgaaaa

SEQ ID NO: 106495 - DNA, 1983 bp, Homo sapiens
  Payload ID: 916
  Gene Symbol: ALG11
  Gene Name: ALG11, alpha-1,2-mannosyltransferase
  ENST ID: ENST00000616513
  CDS Start-End: 9-101
ggcggaagatggcggccggcgaaaggagctggtgcctgtgcaagttgttgagtttcgagtatgtctttatcagcagcgtgaaaatgaacttggtaccataaattagtaccagtagagtggggtgctgctgaagagatacccaaaaatgtggaagcgactttggaactgggcaacaggcagaggctggaacagtttggagggctcagaagaagccaggaaaatgtgggaaagtttggaacatcctagagacttgttgaatggctttgaacaaaatgcggatagtgatatggacaacgaaatccaggctgaggtggtctcagatggagatgaagaacttgttgggaactggagaaaggtgactcctcttatgttttagcaaaggtactagaggcattttgcccctgccctagagatttgtggaactttgaacttgaaagagatgatttagggtatctggtgtaagaaatttctaagcagcaaagaattcaagaagtgacttgggtgctcttaaaagcattccattttaaaagcggaacagagcataaaagttcagaaaatttgcagcctgacaatgcagtagaaaagaaagacccatttttttaggagaaattcaagctggctgcagaaattttcaaaagtagcaaggagcctaatgttaatcctgaagaccatgggggaaaatgtctccaggcaatgtcggagaccttcatggcagcctctctcatggcaggcctggaggcccaggaggaaaaagtggttttgtgggccaggtgcaggggccctgtgctgtgtgcagcctagggacttggtaccctgtgtcccagctgctccagccgtggctgaaaggggccaatgcagagctagtgctgtggcttcagagggtgaaagccccaagccatggtagcttcacatggtgttgagcctgcgggtgcacagaagtcaagaatggaaatttgggaacctctacctagattgcagaagatgtatagaaacgcctggatgcccaggcaaaagtttgccaccggggcagggccctcatggagaacctctgccagggcagtgcagaagggaaatgtggggttggagcccccacacagagtccctactggggcactgcctagtggagctgcgagaagagggccaccgtcctccataccccagagtggtagatccactgacagcttgcaccgtgtgcctggaaaaacctcagacactcaacgccggcccatgaaagcagccaggagggaggctgtaccctgcaaatctacaggggcagagctgctcaagaccatgggaacccacctcttgcttaagcatgacctggatgtgagacctggagtcaaaggaggtcattttggagctttaaaaatttgactgccccactggattttggacttgcatgggccctgtaacccccttgttttggccaatttctcccatttggaacagctgtacttacccaatacctgtactcccattgtatctgggaagtaactagcttacttttgattttacaggctcataggcagaagggacttgccttgtctcggatgagactttggactgtggacatatgggttaatgctgaaatgagttaagactttgggggactgttgggaaggcataattggttttgaaatgtgatgacgtgagatttggaggggccagggcagaatgatatggtttggccatgtccccacccaaatctcagtttgaattgtgtctcccagaattcccatgtgttgtggaagggacccaggggaaggtaattgaatcatgggggccggtctttcccatgctattctcataataatgaataagtctcatgagatctgatgggtttatcaggggtttccgcttttgctgcttcctcgtttttctcttgcccactgccctgtaagaagtgccttacacctcctgccgtgattctgaggtctccccagccatatggaactgtaagtccaattaaatctctttttgttc

SEQ ID NO: 106496 - DNA, 5350 bp, Homo sapiens
  Payload ID: 917
  Gene Symbol: ALG12
  Gene Name: ALG12, alpha-1,6-mannosyltransferase
  Uniprot ID: Q9BV10
  ENST ID: ENST00000330817
  CDS Start-End: 275-1741
gcgcgcagcccgcggcggccatctttactcagggcacagagggtctctgcggccgtagcggccggggctgcggtagccactttagatttgggcaaggactttagattcgggctctgttctgtttccgccgtcctgcttcctgccgaggctggcccaggcagccgcgcttcgaaggacgccgccgggagctgcggagcatgcgtggagtggcagtgctaacggctggtgtctcgcactgttggcctgtgaaggtacgtgaagctgaaagcctggaatggctggaaaggggtcatcaggcaggcggcccctgctgctggggctgctggtggccgtagccactgtccacctggtcatctgtccctacaccaaagtggaggagagcttcaacctgcaggccacacatgacctgctctaccactggcaagacctggagcagtacgaccatcttgagttccccggagtcgtccccaggacgttcctcgggccagtggtgatcgcagtgttctccagccccgcggtttacgtgctttcgctgttagaaatgtccaagttttactctcagctaatagttagaggagtgcttggactcggcgtgatttttggactctggacgttacaaaaggaagtgagacggcacttcggggccatggtggccaccatgttctgctgggtgacggccatgcagttccacctgatgttctactgcacgcggacactgcccaatgtgctggccctgcctgtagtcctgctggccctcgcggcctggctgcggcacgagtgggcccgcttcatctggctgtcagccttcgccatcatcgtgttcagggtggagctgtgcctgttcctgggcctcctgctgctgctggccttgggcaaccgaaaggtttctgtagtcagagcccttcgccacgccgtcccggcagggatcctctgtttaggactgacggttgctgtggactcttatttttggcggcagctcacttggccggaaggaaaggtgctttggtacaacactgtcctgaacaaaagctccaactgggggacctccccgctgctgtggtacttctactcagccctgccccgcggcctgggctgcagcctgctcttcatccccctgggcttggtagacagaaggacgcacgcgccgacggtgctggcactgggcttcatggcactctactccctcctgccacacaaggagctacgcttcatcatctatgccttccccatgctcaacatcacggctgccagaggctgctcctacctgctgaataactataaaaagtcttggctgtacaaagcggggtctctgcttgtgatcggacacctcgtggtgaatgccgcctactcagccacggccctgtatgtgtcccatttcaactacccaggtggcgtcgcaatgcagaggctgcaccagctggtgcccccccagacagacgtccttctgcacattgacgtggcagccgcccagacaggtgtgtctcggtttctccaagtcaacagcgcctggaggtacgacaagagggaggatgtgcagccggggacaggcatgctggcatacacacacatcctcatggaggcggcccctgggctcctggccctctacagggacacacaccgggtcctggccagcgtcgtggggaccacaggtgtgagtctgaacctgacccaactgccccccttcaacgtccacctgcagacaaagctggtgcttctggagaggctcccccggccgtcctgagggggaccaggcagccctcagcagccacaggccttccaggagctgttatcactaccagtttctggcacaattccagcacaattatgacaattcagagaagcaagtcaaaggactgggcacctgcctctgacagacaccagaccaggtccagggcctcctccacagcctcagctggggctctcagcaccaaagaacgaggggcccaggtcttgttggcaccccgggagccactgcccagggtgatggtggccagctcagggcttcctgcgggtgactgtcgcccagaccaggtgccattcatgactaatcaggagcagcgggctcacccaggcacctgtctgccaggaggccacgtgtgtcctgcccacccagggggagctgtattttggcagcaccccacgcttgctgcccgagggcctcttggggcacctaagacagcaccccctctcaggggagaccatggtggccccggccgcacccccccaccctggtgccaccactgcaacttttgtattcacaggcatcccatctccatcacagataaaatcttaggagataaacacattcaaaaaggaatgagataaaaagaataaggcaataaatgttgattggaacctctcaagattacagaaaataatgagaatgaaattttaaaaatgtttcctatgtgatagcttatcacaggtgactattccaggtgttatggtaaagggacagcttggtgctgtcagcctcactgaccatgcatttataaagcaccaaagtgcgtgtgatgctgctgggcactggagatgggaccaggtgctgctgcacacgtatgcacacaccatgcatacatgcacacacaccacacacgcatgcacacagtgcacacgtgcacacaccatgcatacacaccacacaccgtgcacacgtgcacacaccatgcatacacaccacacacagtgcacacgtgcacattaccatgcatccacacacagtgcacacgtgcacacactatgcatacacagtgcacacgtgcacacaccatgcatacacaccacacaccgtgcacacgtgcacacaccatgcatacacaccacacacagtgcacacgtgcacattaccatgcatccacacacagtgcacacgtgcacacactatgcatacacagtgcacacgtgcacacaccatgcatacacaccacacagtgcacacgtgcacattaccatgcatacacagtgcacacgtgcacacaccatgcatacacaccacacacagtgcacacgtgcacattaccatgcatacacacagtgcacgcgtgcacattaccatgcatacacagtgcacatgtgcacacaccatgcatacacaccacacagtgcacacgtgcacacaccatgcatacacagtgcacacgtgcacacaccatgcatacacagtgcacatgtgcacacaccatgcatacacaccacacaccgtgcacacgtgcacacaccatgcatacacaccacacacagtgcacacgtgcacattaccatgcatccacacacagtgcacacgtgcacactatgcatacagtgcacacatgcacacaccatgcatacacagtgcacacgtgcacacaccatgcatacacaccacacagtgcacatgtgcacacaccatgcatacacaccacacacagtgcacacgtgcacacaccatgcatacacaccacacacagtgcacacgtgcacattaccatgcatacacagtgcacacgtgcacacaccatgcatgcacaccacacacagtgcacacgtgtacgttaccatgcatacacacagtgcacgcgtgcacattaccatgcatacacagtgcacacgtgcacacaccatgcatacacaccacacacagtgcacacgtgcacattaccgtgcatacacacagtgcatgcgtgcacattaccatgcatacacacagtgcacacgtgcacacaccatgaatacacaccacacacagtgcacacgtgcacacaccatgcatacacacagtgcacacgtgcacacaccatgcatacataccacacacagtgcacacgtgcacattaccatgcatacaccacgcatgcacaatgcacgtgcacaccatgcatacacaccacacatgcatccacacacaatgcacagatgcgcacaccatgcatacacaccatacatgcatgatcacacgtgcacacaccatacatacccaccacgcatgcacacacacaatgcacaggtgcacacaccatgcatacacaccacacaatgcaatcgtgcacacacaatgcacacgtgcacacaccatgcatacacaccacacaatgcaatcatgcacacaatgcacacgtgcacacaccatgcatacataccacacatgcacacacgtgtgcataaagacatgatttcttcctgtgctctttgagagcttgtggctgttgcccaggtgccctggggctgcctctccacctgatgcctcctggttttcccattgcgtctggcgaacatctgtgcagacacttcctgactcccacagaggccagatggtgagggctggagagcaggcttcctggccccagcatcccacagacatgggctccctcccccatccatccacctgtgtgtctcaggtattcactggttatccacgctcgtttgttctcttttatcgctggccacatgtggattgcctcccgacttcagtggtctgtgagtcactcctgtctttaattatcctggtgttcaaagtgtacgagatttgctggcgggaaccctgccatgctctgcctgtgtgccgtgcctctccttcgagcacctcctcatgaccaggcatggcagggcgtcctcttgggcctctggcctcggccattgctctgtgggtcttggctccctttggtggggaacagcgttagagaccgggatctagacacgaggtgtgctcgatgccacggggtgcctgagctttaggccctttctgtggacaggctagggaggacaggcatgctgcgtgcagttgcacacgtacatatgtaatatgtgtgtacagatctgaaacagcacagaaccgtgcctggattccgtcccaccttgcacggttctcccccaccccccatctccaccctgaggaccctggcccccagcaacagcagcatcctcacgcatctgctagggagtccagtgcacgcctgctcgagagctccagtgcagctttgccacaggattgcaaaaacaaacccaccatgaagaggtcgggattgtgtgcagttcactccctgcccacaactgcgggtgccgtcaagcactgtgctcatgagttccttgggtcggcttctccaccgtcagtgtagtggtgccttcgttggaaatacagctgggttcatccttcccgtttgctttcagtcttgtgcctcccaccataccccacacccccatcctgttaggtttgtagagtgtgaccatccttctagatgtcaaaactgcccctgaagacagatgcagggagccactccctcctgtacctcctcctcgctttttggtaatgagcataattgtctcctggtttatctcccatgtgtttaattttgtaaagataaacattacacatata

SEQ ID NO: 106497 - DNA, 753 bp, Homo sapiens
  Payload ID: 917
  Gene Symbol: ALG12
  Gene Name: ALG12, alpha-1,6-mannosyltransferase
  ENST ID: ENST00000492791
  CDS Start-End: 1-590
tcctgctggccctcgcggcctggctgcggcacgagtgggcccgcttcatctggctgtcagccttcgccatcatcgtgttcagggtggagctgtgcctgttcctgggcctcctgctgctgctggccttgggcaaccgaaaggtttctgtagtcagagcccttcgccacgccgtcccggcagggatcctctgtttaggactgacggttgctgtggactcttatttttggcggcagctcacttggccggaaggaaaggtgctttggtacaacactgtcctgaacaaaagctccaactgggggacctccccgctgctgtggtacttctactcagccctgccccgcggcctgggctgcagcctgctcttcatccccctgggcttggtagacagaaggacgcacgcgccgacggtgctggcactgggcttcatggcactctactccctcctgccacacaaggagctacgcttcatcatctatgccttccccatgctcaacatcacggctgccagaggctgctcctacctgtggcgtcgcaatgcagaggctgcaccagctggtgcccccccagacagacgtccttctgcacattgacgtggcagccgcccagacaggtgtgtctcggtttctccaagtcaacagcgcctggaggtacgacaagagggaggatgtgcagccggggacaggcatgctggcatacacacacatcctcatggaggcggcccctgggctcctggccctctacagggacacacac

SEQ ID NO: 106498 - DNA, 674 bp, Homo sapiens
  Payload ID: 917
  Gene Symbol: ALG12
  Gene Name: ALG12, alpha-1,6-mannosyltransferase
  ENST ID: ENST00000486602
  CDS Start-End: 1-616
ctcagccctgccccgcggcctgggctgcagcctgctcttcatccccctgggcttggtagacagaaggacgcacgcgccgacggtgctggcactgggcttcatggcactctactccctcctgccacacaaggagctacgcttcatcatctatgccttccccatgctcaacatcacggctgccagaggctgctcctacctgctgaataactataaaaagtcttggctgtacaaagcggggtctctgcttgtgatcggacacctcgtggtgaatgccgcctactcagccacggccctgtatgtgtcccatttcaactacccaggtggcgtcgcaatgcagaggctgcaccagctggtgcccccccagacagacgtccttctgcacattgacgtggcagccgcccagacaggtgtgtctcggtttctccaagtcaacagcgcctggagacaaagctggtgcttctggagaggctcccccggccgtcctgagggggaccaggcagccctcagcagccacaggccttccaggagctgttatcactaccagtttctggcacaattccagcacaattatgacaattcagagaagcaagtcaaaggactgggcacctgcctctgacagacaccagaccaggtccagggcctcctccacagcctcagctggggctctcagcacc

SEQ ID NO: 106499 - DNA, 3997 bp, Homo sapiens
  Payload ID: 918
  Gene Symbol: ALG13
  Gene Name: ALG13, UDP-N-acetylglucosaminyltransferase subunit
  Uniprot ID: Q9NP73
  ENST ID: ENST00000251943
  CDS Start-End: 487-3351
agttgcgtcatatccggcccttgcgatcagggcttgaggaacccgcgccatgaagtgcgtgtttgttaccgtagggaccaccagctttgacgacctcattgcgtgtgtgtcggcgcccgacagtctgcaagtgagtgagggaggcgagcaggcggcggcttggctcgccacccgccatctccggccatactgccagccgcgttagccttgcctgaccgtcgcgctcggaaagaaacccccgcaactctaccacagaaaatcgagagccttggttacaaccgacttatcctgcaaattggtagaggaacggtggtacctgaacccttcagtactgagtcgtttactctggatgtttacaggtacaaggattccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagagggtcatctcttctattgtacctgcagggtcctgacttgtcctgggcaagccaagtccattgcttctgctcctgggaagtgccaagattctgcagcgctgacttcaactgccttttcaggcctagactttgggctgctttccggatacctgcataagcaagcccttgttactgctacccatcctacctgcaccctgctttttccctcttgccacgctttttttcctctccctcttacccccaccctgtacaaaatgcataaaggatggaaaaactactgcagccagaagtctttgaatgaggcatcaatggatgaatatttaggcagcttagggctgtttcgaaagctgactgccaaggatgcctcttgcctctttcgggccatttcggagcagttgttttgcagccaggtccatcatttggaaatcaggaaggcttgtgtctcatatatgagggaaaatcaacaaacttttgagtcttatgtggagggatcttttgagaaatacctggaacggttgggagatcccaaggaaagtgctggccagctggaaataagagctctttctctaatttataatcgggatttcattctttatcgctttcctggaaaacctccaacttatgtcacagataatggctatgaagacaagattctactctgctactcaagtagtggtcactatgattctgtgtactcaaaacaatttcagtcaagtgcagctgtttgtcaggctgtattgtacgaaattctctataaagatgtgtttgttgtggatgaagaagagttgaagactgcgattaaattgtttcgaagtggttctaagaagaacagaaataatgctgtaactggaagcgaggatgcccatactgattacaagagttcaaatcagaataggatggaagagtggggtgcctgctacaatgctgaaaatataccagagggctacaataaaggaacagaagaaacaaagtctccagaaaatccatcaaagatgcccttcccctataaggtgctcaaagccctggatccagaaatctatcgtaatgtagaatttgatgtttggttggacagcagaaaagaacttcaaaaatctgattacatggagtatgctgggagacagtactatttgggagacaagtgtcaggtttgcttggaatcagaaggaagatattataatgctcatatccaggaagttggaaatgagaacaattcagtaacagtcttcattgaagaattggcggaaaagcatgttgttccactggctaacttaaaaccagttacccaagtgatgtctgttcctgcctggaatgctatgcccagtcggaaaggaagaggttaccagaaaatgcctgggggttatgtcccggaaatagttatatcagagatggacataaagcaacagaagaagatgttcaagaaaattcgagggaaagaagtttacatgactatggcttacggcaagggagaccccctcctcccacccaggctgcagcacagtatgcattatgggcacgatcctccaatgcactactcacagacagctggcaatgttatgtctaatgaacattttcatcctcagcatccatctccgagacaaggtcggggatatgggatgcccaggaattcatctcggtttataaacaggcacaacatgccgggccctaaagttgatttttacccaggcccaggtaaaaggtgctgccagagctatgataacttctcttatagatctcgttcatttagacgtagtcaccgccagatgagttgtgtgaataaggagtcccagtatggatttaccccagggaatggacagatgcccaggggcttggaagaaactattactttttatgaagttgaagaaggggatgagactgcttatccaactttacctaatcatggaggtccctctacaatggttcctgctacttcaggatactgtgttggaaggcggggacatagctcaggcaaacagactttgaatttagaggagggcaatggccagagtgaaaatgggcgatatcatgaagaatatctttatcgtgcagagccagactatgaaacttcaggtgtttatagcacaactgcatctacagcaaacttgtctcttcaggacagaaagtcatgttctatgtctcctcaggacacagttacctcatacaactacccccagaagatgatgggaaatattgcagcagttgcagcttcctgtgccaataatgttccagctccagtcttatctaacggtgcagcggctaatcaagctattagtaccacttcagtttcctcacagaatgctatacagcctctctttgtatctccacctacacacggcaggccagatacaaaagttttgcagtactatttcaatctaggattgcagtgctattaccacagctactggcactccatggtctatgtgccacagatgcagcagcagcttcatgtagagaattatccagtctatactgagccacctctggtagatcaaaccgttcctcaatgctacagtgaggtgaggagagaagatggcatacaggcggaagcatcagcaaatgatacttttccgaatgctgattcttcatctgtccctcatggagcagtctattatccagtaatgtcagatccctatgggcagccacctttgccaggttttgactcctgccttccggttgtgccagattattcctgtgttcccccctggcatccagttggtacagcatatggtggttcttctcaaattcatggtgctataaatcctgggccaattggctgtattgctccatctcccccagcttctcattatgtacctcagggtatgtaagatccagcagtatgaagtattcttgcactgccattttcttgctgtttttgtttttaaaaagtattttatgttagtggttaaatgatttaggtgattagtgtttactattgtatttgtctttaaaattattttatcttttgatttaaaatagtactttaaaattaaggggtattattttgggctgtgactaaggaaattgagatggatgtacaactagccccatattgagcatacttcattgtattcagctgttttcctgtcagccatttgtcagctttatattagctgatggtaccaattgataaaatgaatataaagtatttcattggttcaaaaatcacacatcatattaaaccatgcagaattggagtaacttccacttttttctagaaagtaaaaccaagagcctttgcttctggataactcacttaatattaaattaaagagctcttcacgtttcttgagaattatctgaagccagttgcattctgtgatatcagttttgaaggcacatggttctctgctttagatttatcccatatgctattgtttaatactggatgtatgtaagtgttttactgcactgtattgaattggtgtcttttgcacagttagcagtaaataaaaattagcatttaaaattgcc

SEQ ID NO: 106500 - DNA, 2770 bp, Homo sapiens
  Payload ID: 918
  Gene Symbol: ALG13
  Gene Name: ALG13, UDP-N-acetylglucosaminyltransferase subunit
  Uniprot ID: Q9NP73
  ENST ID: ENST00000371979
  CDS Start-End: 102-599
acggatttccgcctccctcacagaaggcagtcactgcaacgtgcgtggcctcagttgcgtcatatccggcccttgcgatcagggcttgaggaacccgcgccatgaagtgcgtgtttgttaccgtagggaccaccagctttgacgacctcattgcgtgtgtgtcggcgcccgacagtctgcaaaaaatcgagagccttggttacaaccgacttatcctgcaaattggtagaggaacggtggtacctgaacccttcagtactgagtcgtttactctggatgtttacaggtacaaggattccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagagggtcatctcttctattgtacctgcagcacgcttcctgggctgttacagtcaatggacttatcaacactgaaatgttatcctcctggccagccagaaaaattttctgcatttttggataaagttgttggattacaaaaataaacactaaactctcaacactttaaaagcaacccccaaattcaacctatgtaatgtgattaaatcaaattaaatacataatatatatttacaaaataatataattaataaacttcctacatctatagaatgtataggaaattttatgttgtgcacatttgcattgggtccaaatcctaattgcagtttagtgaaattactagatttttttctaatcttcagtatgtagtgagcattcacaggttttctcctagaatctcaagtggaattggaatcataaaaatgaatgagatttgaaaactttcacaaagattataaatgtagttagtttgatactccttagaataaaaaaatgaaacagtaacaacttttatgtaaaaaaattttacataagagttagcatctttagctttataatctaaggaaccaaatttaaaaaatgatggattatgctctgtgaaatgaaaagttcaatcattgcctaaaaaagatgatcaagttagttgatctcttgtacttggaaaagctacttttttcctaaagaacagagtggagtggatatattcactttttttttctaaaacatacaaagtgataaaataatcgtgcctaatgtcaaaactttactggtttgagaagaataatcaaaaaggacttataccaataggacttactattgttttttaaggatctcctctcacagtggtaatgaaacattaactgtaacagaaatttacaatttatgtgcttataaaattagttttatgaatgaacaataaactgatgcatataatggcttaaatatatggttttaaaattgacttaacttgagcaagatacattatgaagttctttctgattagagtgtgtggtctcaagacctttacagtagattatccttaagtgtccatagctctctggtacaatgtttagatatagtttatctatcaaaatagaacattcactataaagacctctcttccattccaatcatattatcccaacatgctaaatgttccaaacattttatttggaatgcattttatcatgtttttataggtttatttttctgattgtgttttatttaggctaatattaaaaaaatgcttactagtggtagaaggtggtgacaaagaaatactctgggtagcaggaggaagccaacttggattaaaattttgctgagaataatctaaaaagtgagtaatctggttgagaattcacagcaccataatcataattgtatatcaatgttatgttttaggaaaggtcctattcaaatccagggagagaatctttagtgttttctgggccctcataaatacgtttttctcatttgagaaaattgtgactttatgttggtcacttagtttttatagtttatgatgaagaattaaagagaaacaaatgaaaggcaaggtctactcaaatatcagacaactaaaaggctatacagcccctaaatcctttgctatctacttccccagaataatgcataacctaaattccattatttcatttagcagaggtttaagccgttgttgtcaattgtgtgcagtaacgcctctgacttcccttttgtggaattttgtatcgattttggatttttaagtcaaaggagactttaaaatcattttgatttggcacggattcttgagattatctagtccaattccatcatattcagattttaccatttgcttaaagtatagcttttggcagaactgcccctaggagcagctccttgattcccagtcccctgctctttctaccctgcataatatatgttgtaagctttttgtttctttatagttgtttgcctagtgttcattttagttactcgaattccttgcaaggtaggttttgtttgtttatttatggaagttatttagtaggaatttcacacttaactgggttttcctttggcgtatgacaaccttacctaggacttagaaatctgtgatttctgagtttttggaatttaggaaaatgctctgggtaggattgatagtagattgaataaattaagactttaagacagaattgtagacttttggagttgggagataatttaaagaatattttaaaccaccagttttacagatgaggaaacatgctaaattaatcaccacatttacatcttattagtccttattaaagaatggtaaccaaaa

SEQ ID NO: 106501 - DNA, 4133 bp, Homo sapiens
  Payload ID: 918
  Gene Symbol: ALG13
  Gene Name: ALG13, UDP-N-acetylglucosaminyltransferase subunit
  Uniprot ID: Q9NP73
  ENST ID: ENST00000394780
  CDS Start-End: 70-3483
actgcaacgtgcgtggcctcagttgcgtcatatccggcccttgcgatcagggcttgaggaacccgcgccatgaagtgcgtgtttgttaccgtagggaccaccagctttgacgacctcattgcgtgtgtgtcggcgcccgacagtctgcaaaaaatcgagagccttggttacaaccgacttatcctgcaaattggtagaggaacggtggtacctgaacccttcagtactgagtcgtttactctggatgtttacaggtacaaggattccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagagggtcatctcttctattgtacctgcagggtcctgacttgtcctgggcaagccaagtccattgcttctgctcctgggaagtgccaagattctgcagcgctgacttcaactgccttttcaggcctagactttgggctgctttccggatacctgcataagcaagcccttgttactgctacccatcctacctgcaccctgctttttccctcttgccacgctttttttcctctccctcttacccccaccctgtacaaaatgcataaaggatggaaaaactactgcagccagaagtctttgaatgaggcatcaatggatgaatatttaggcagcttagggctgtttcgaaagctgactgccaaggatgcctcttgcctctttcgggccatttcggagcagttgttttgcagccaggtccatcatttggaaatcaggaaggcttgtgtctcatatatgagggaaaatcaacaaacttttgagtcttatgtggagggatcttttgagaaatacctggaacggttgggagatcccaaggaaagtgctggccagctggaaataagagctctttctctaatttataatcgggatttcattctttatcgctttcctggaaaacctccaacttatgtcacagataatggctatgaagacaagattctactctgctactcaagtagtggtcactatgattctgtgtactcaaaacaatttcagtcaagtgcagctgtttgtcaggctgtattgtacgaaattctctataaagatgtgtttgttgtggatgaagaagagttgaagactgcgattaaattgtttcgaagtggttctaagaagaacagaaataatgctgtaactggaagcgaggatgcccatactgattacaagagttcaaatcagaataggatggaagagtggggtgcctgctacaatgctgaaaatataccagagggctacaataaaggaacagaagaaacaaagtctccagaaaatccatcaaagatgcccttcccctataaggtgctcaaagccctggatccagaaatctatcgtaatgtagaatttgatgtttggttggacagcagaaaagaacttcaaaaatctgattacatggagtatgctgggagacagtactatttgggagacaagtgtcaggtttgcttggaatcagaaggaagatattataatgctcatatccaggaagttggaaatgagaacaattcagtaacagtcttcattgaagaattggcggaaaagcatgttgttccactggctaacttaaaaccagttacccaagtgatgtctgttcctgcctggaatgctatgcccagtcggaaaggaagaggttaccagaaaatgcctgggggttatgtcccggaaatagttatatcagagatggacataaagcaacagaagaagatgttcaagaaaattcgagggaaagaagtttacatgactatggcttacggcaagggagaccccctcctcccacccaggctgcagcacagtatgcattatgggcacgatcctccaatgcactactcacagacagctggcaatgttatgtctaatgaacattttcatcctcagcatccatctccgagacaaggtcggggatatgggatgcccaggaattcatctcggtttataaacaggcacaacatgccgggccctaaagttgatttttacccaggcccaggtaaaaggtgctgccagagctatgataacttctcttatagatctcgttcatttagacgtagtcaccgccagatgagttgtgtgaataaggagtcccagtatggatttaccccagggaatggacagatgcccaggggcttggaagaaactattactttttatgaagttgaagaaggggatgagactgcttatccaactttacctaatcatggaggtccctctacaatggttcctgctacttcaggatactgtgttggaaggcggggacatagctcaggcaaacagactttgaatttagaggagggcaatggccagagtgaaaatgggcgatatcatgaagaatatctttatcgtgcagagccagactatgaaacttcaggtgtttatagcacaactgcatctacagcaaacttgtctcttcaggacagaaagtcatgttctatgtctcctcaggacacagttacctcatacaactacccccagaagatgatgggaaatattgcagcagttgcagcttcctgtgccaataatgttccagctccagtcttatctaacggtgcagcggctaatcaagctattagtaccacttcagtttcctcacagaatgctatacagcctctctttgtatctccacctacacacggcaggccagtgattgcctcaccatcctatccatgccattctgctattcctcatgctggtgcctctctaccaccaccaccaccaccaccaccaccaccaccaccaccaccacctcctcctcctcctcctcctcctcctcctcctcctcctgctcttgatgtgggagagacttcaaacttacaaccaccaccaccactaccacctccaccttattcctgtgatccaagcggcagtgatttgcctcaagatacaaaagttttgcagtactatttcaatctaggattgcagtgctattaccacagctactggcactccatggtctatgtgccacagatgcagcagcagcttcatgtagagaattatccagtctatactgagccacctctggtagatcaaaccgttcctcaatgctacagtgaggtgaggagagaagatggcatacaggcggaagcatcagcaaatgatacttttccgaatgctgattcttcatctgtccctcatggagcagtctattatccagtaatgtcagatccctatgggcagccacctttgccaggttttgactcctgccttccggttgtgccagattattcctgtgttcccccctggcatccagttggtacagcatatggtggttcttctcaaattcatggtgctataaatcctgggccaattggctgtattgctccatctcccccagcttctcattatgtacctcagggtatgtaagatccagcagtatgaagtattcttgcactgccattttcttgctgtttttgtttttaaaaagtattttatgttagtggttaaatgatttaggtgattagtgtttactattgtatttgtctttaaaattattttatcttttgatttaaaatagtactttaaaattaaggggtattattttgggctgtgactaaggaaattgagatggatgtacaactagccccatattgagcatacttcattgtattcagctgttttcctgtcagccatttgtcagctttatattagctgatggtaccaattgataaaatgaatataaagtatttcattggttcaaaaatcacacatcatattaaaccatgcagaattggagtaacttccacttttttctagaaagtaaaaccaagagcctttgcttctggataactcacttaatattaaattaaagagctcttcacgtttcttgagaattatctgaagccagttgcattctgtgatatcagttttgaaggcacatggttctctgctttagatttatcccatatgctattgtttaatactggatgtatgtaagtgttttactgcactgtattgaattggtgtcttttgcacagttagcagtaaataaaaattagcatttaaaattgccaaaa

SEQ ID NO: 106502 - DNA, 3812 bp, Homo sapiens
  Payload ID: 918
  Gene Symbol: ALG13
  Gene Name: ALG13, UDP-N-acetylglucosaminyltransferase subunit
  Uniprot ID: Q9NP73
  ENST ID: ENST00000436609
  CDS Start-End: 298-3162
agtttttcctcaggcccccctgtggaccgcacgtcggcgccggcgtctgagccagccgagctcgcctcagagcccggctccttcccctcagcacttggccggagcccgcgcggttcctctcctcagcgcgcgtcgtcccctcagggctcccggttctcgcagttgatcaagtacaaggattccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagagggtcatctcttctattgtacctgcagggtcctgacttgtcctgggcaagccaagtccattgcttctgctcctgggaagtgccaagattctgcagcgctgacttcaactgccttttcaggcctagactttgggctgctttccggatacctgcataagcaagcccttgttactgctacccatcctacctgcaccctgctttttccctcttgccacgctttttttcctctccctcttacccccaccctgtacaaaatgcataaaggatggaaaaactactgcagccagaagtctttgaatgaggcatcaatggatgaatatttaggcagcttagggctgtttcgaaagctgactgccaaggatgcctcttgcctctttcgggccatttcggagcagttgttttgcagccaggtccatcatttggaaatcaggaaggcttgtgtctcatatatgagggaaaatcaacaaacttttgagtcttatgtggagggatcttttgagaaatacctggaacggttgggagatcccaaggaaagtgctggccagctggaaataagagctctttctctaatttataatcgggatttcattctttatcgctttcctggaaaacctccaacttatgtcacagataatggctatgaagacaagattctactctgctactcaagtagtggtcactatgattctgtgtactcaaaacaatttcagtcaagtgcagctgtttgtcaggctgtattgtacgaaattctctataaagatgtgtttgttgtggatgaagaagagttgaagactgcgattaaattgtttcgaagtggttctaagaagaacagaaataatgctgtaactggaagcgaggatgcccatactgattacaagagttcaaatcagaataggatggaagagtggggtgcctgctacaatgctgaaaatataccagagggctacaataaaggaacagaagaaacaaagtctccagaaaatccatcaaagatgcccttcccctataaggtgctcaaagccctggatccagaaatctatcgtaatgtagaatttgatgtttggttggacagcagaaaagaacttcaaaaatctgattacatggagtatgctgggagacagtactatttgggagacaagtgtcaggtttgcttggaatcagaaggaagatattataatgctcatatccaggaagttggaaatgagaacaattcagtaacagtcttcattgaagaattggcggaaaagcatgttgttccactggctaacttaaaaccagttacccaagtgatgtctgttcctgcctggaatgctatgcccagtcggaaaggaagaggttaccagaaaatgcctgggggttatgtcccggaaatagttatatcagagatggacataaagcaacagaagaagatgttcaagaaaattcgagggaaagaagtttacatgactatggcttacggcaagggagaccccctcctcccacccaggctgcagcacagtatgcattatgggcacgatcctccaatgcactactcacagacagctggcaatgttatgtctaatgaacattttcatcctcagcatccatctccgagacaaggtcggggatatgggatgcccaggaattcatctcggtttataaacaggcacaacatgccgggccctaaagttgatttttacccaggcccaggtaaaaggtgctgccagagctatgataacttctcttatagatctcgttcatttagacgtagtcaccgccagatgagttgtgtgaataaggagtcccagtatggatttaccccagggaatggacagatgcccaggggcttggaagaaactattactttttatgaagttgaagaaggggatgagactgcttatccaactttacctaatcatggaggtccctctacaatggttcctgctacttcaggatactgtgttggaaggcggggacatagctcaggcaaacagactttgaatttagaggagggcaatggccagagtgaaaatgggcgatatcatgaagaatatctttatcgtgcagagccagactatgaaacttcaggtgtttatagcacaactgcatctacagcaaacttgtctcttcaggacagaaagtcatgttctatgtctcctcaggacacagttacctcatacaactacccccagaagatgatgggaaatattgcagcagttgcagcttcctgtgccaataatgttccagctccagtcttatctaacggtgcagcggctaatcaagctattagtaccacttcagtttcctcacagaatgctatacagcctctctttgtatctccacctacacacggcaggccagatacaaaagttttgcagtactatttcaatctaggattgcagtgctattaccacagctactggcactccatggtctatgtgccacagatgcagcagcagcttcatgtagagaattatccagtctatactgagccacctctggtagatcaaaccgttcctcaatgctacagtgaggtgaggagagaagatggcatacaggcggaagcatcagcaaatgatacttttccgaatgctgattcttcatctgtccctcatggagcagtctattatccagtaatgtcagatccctatgggcagccacctttgccaggttttgactcctgccttccggttgtgccagattattcctgtgttcccccctggcatccagttggtacagcatatggtggttcttctcaaattcatggtgctataaatcctgggccaattggctgtattgctccatctcccccagcttctcattatgtacctcagggtatgtaagatccagcagtatgaagtattcttgcactgccattttcttgctgtttttgtttttaaaaagtattttatgttagtggttaaatgatttaggtgattagtgtttactattgtatttgtctttaaaattattttatcttttgatttaaaatagtactttaaaattaaggggtattattttgggctgtgactaaggaaattgagatggatgtacaactagccccatattgagcatacttcattgtattcagctgttttcctgtcagccatttgtcagctttatattagctgatggtaccaattgataaaatgaatataaagtatttcattggttcaaaaatcacacatcatattaaaccatgcagaattggagtaacttccacttttttctagaaagtaaaaccaagagcctttgcttctggataactcacttaatattaaattaaagagctcttcacgtttcttgagaattatctgaagccagttgcattctgtgatatcagttttgaaggcacatggttctctgctttagatttatcccatatgctattgtttaatactggatgtatgtaagtgttttactgcactgtattgaattggtgtcttttgcacagttagcagtaaataaaaattagcatttaaaattgccaaaa

SEQ ID NO: 106503 - DNA, 916 bp, Homo sapiens
  Payload ID: 918
  Gene Symbol: ALG13
  Gene Name: ALG13, UDP-N-acetylglucosaminyltransferase subunit
  ENST ID: ENST00000486353
  CDS Start-End: 22-501
agggcttgaggaacccgcgccatgaagtgcgtgtttgttaccgtagggaccaccagctttgacgacctcattgcgtgtgtgtcggcgcccgacagtctgcaaaaaatcgagagccttggttacaaccgacttatcctgcaaattggtagaggaacggtggtacctgaacccttcagtactgagtcgtttactctggatgtttacaggtacaaggattccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagagggtcatctcttctattgtacctgcaggctaatattaaaaaaatgcttactagtggtagaaggtggtgacaaagaaatactctgggtagcaggaggaagccaacttggattaaaattttgctgagaataatctaaaaaggtcctgacttgtcctgggcaagccaagtccattgcttctgctcctgggaagtgccaagattctgcagcgctgacttcaactgccttttcaggcctagactttgggctgctttccggatacctgcataagcaagcccttgttactgctacccatcctacctgcaccctgctttttccctcttgccacgctttttttcctctccctcttacccccaccctgtacaaaatgcataaaggatggaaaaactactgcagccagaagtctttgaatgaggcatcaatggatgaatatttaggcagcttagggctgtttcgaaagctgactgccaaggatgcctcttgcctctttcgggccatttcggagcagttgttttgcagccaggtccatcatttggaaatca

SEQ ID NO: 106504 - DNA, 3236 bp, Homo sapiens
  Payload ID: 918
  Gene Symbol: ALG13
  Gene Name: ALG13, UDP-N-acetylglucosaminyltransferase subunit
  ENST ID: ENST00000495283
  CDS Start-End: 22-177
agggcttgaggaacccgcgccatgaagtgcgtgtttgttaccgtagggaccaccagctttgacgacctcattgcgtgtgtgtcggcgcccgacagtctgcaagtgagtgagggaggcgagcaggcggcggcttggctcgccacccgccatctccggccatactgccagccgcgttagccttgcctgaccgtcgcgctcggaaagaaacccccgcaactctaccacaggtacaaggattccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagagggtcatctcttctattgtacctgcagggtcctgacttgtcctgggcaagccaagtccattgcttctgctcctgggaagtgccaagattctgcagcgctgacttcaactgccttttcaggcctagactttgggctgctttccggatacctgcataagcaagcccttgttactgctacccatcctacctgcaccctgctttttccctcttgccacgctttttttcctctccctcttacccccaccctgtacaaaatgcataaaggatggaaaaactactgcagccagaagtctttgaatgaggcatcaatggatgaatatttaggcagcttagggctgtttcgaaagctgactgccaaggatgcctcttgcctctttcgggccatttcggagcagttgttttgcagccaggtccatcatttggaaatcaggaaggcttgtgtctcatatatgagggaaaatcaacaaacttttgagtcttatgtggagggatcttttgagaaatacctggaacggttgggagatcccaaggaaagtgctggccagctggaaataagagctctttctctaatttataatcgggatttcattctttatcgctttcctggaaaacctccaacttatgtcacagataatggctatgaagacaagattctactctgctactcaagtagtggtcactatgattctgtgtactcaaaacaatttcagtcaagtgcagctgtttgtcaggctgtattgtacgaaattctctataaagatgtgtttgttgtggatgaagaagagttgaagactgcgattaaattgtttcgaagtggttctaagaagaacagaaataatgctgtaactggaagcgaggatgcccatactgattacaagagttcaaatcagaataggatggaagagtggggtgcctgctacaatgctgaaaatataccagagggctacaataaaggaacagaagaaacaaagtctccagaaaatccatcaaagatgcccttcccctataaggtgctcaaagccctggatccagaaatctatcgtaatgtagaatttgatgtttggttggacagcagaaaagaacttcaaaaatctgattacatggagtatgctgggagacagtactatttgggagacaagtgtcaggtttgcttggaatcagaaggaagatattataatgctcatatccaggaagttggaaatgagaacaattcagtaacagtcttcattgaagaattggcggaaaagcatgttgttccactggctaacttaaaaccagttacccaagtgatgtctgttcctgcctggaatgctatgcccagtcggaaaggaagaggttaccagaaaatgcctgggggttatgtcccggaaatagttatatcagagatggacataaagcaacagaagaagatgttcaagaaaattcgagggaaagaagtttacatgactatggcttacggcaagggagaccccctcctcccacccaggctgcagcacagtatgcattatgggcacgatcctccaatgcactactcacagacagctggcaatgttatgtctaatgaacattttcatcctcagcatccatctccgagacaaggtcggggatatgggatgcccaggaattcatctcggtttataaacaggcacaacatgccgggccctaaagttgatttttacccaggcccaggtaaaaggtgctgccagagctatgataacttctcttatagatctcgttcatttagacgtagtcaccgccagatgagttgtgtgaataaggagtcccagtatggatttaccccagggaatggacagatgcccaggggcttggaagaaactattactttttatgaagttgaagaaggggatgagactgcttatccaactttacctaatcatggaggtccctctacaatggttcctgctacttcaggatactgtgttggaaggcggggacatagctcaggcaaacagactttgaatttagaggagggcaatggccagagtgaaaatgggcgatatcatgaagaatatctttatcgtgcagagccagactatgaaacttcaggtgtttatagcacaactgcatctacagcaaacttgtctcttcaggacagaaagtcatgttctatgtctcctcaggacacagttacctcatacaactacccccagaagatgatgggaaatattgcagcagttgcagcttcctgtgccaataatgttccagctccagtcttatctaacggtgcagcggctaatcaagctattagtaccacttcagtttcctcacagaatgctatacagcctctctttgtatctccacctacacacggcaggccagatacaaaagttttgcagtactatttcaatctaggattgcagtgctattaccacagctactggcactccatggtctatgtgccacagatgcagcagcagcttcatgtagagaattatccagtctatactgagccacctctggtagatcaaaccgttcctcaatgctacagtgaggtgaggagagaagatggcatacaggcggaagcatcagcaaatgatacttttccgaatgctgattcttcatctgtccctcatggagcagtctattatccagtaatgtcagatccctatgggcagccacctttgccaggttttgactcctgccttccggttgtgccagattattcctgtgttcccccctggcatccagttggtacagcatatggtggttcttctcaaattcatggtgctataaatcctgggccaattggctgtattgctccatctcccccagcttctcattatgtacctcagggtatgtaagatccagcagtatgaag

SEQ ID NO: 106505 - DNA, 620 bp, Homo sapiens
  Payload ID: 918
  Gene Symbol: ALG13
  Gene Name: ALG13, UDP-N-acetylglucosaminyltransferase subunit
  ENST ID: ENST00000482742
  CDS Start-End: 396-581
tcctcaggcccccctgtggaccgcacgtcggcgccggcgtctgagccagccgagctcgcctcagagcccggctccttcccctcagcacttggccggagcccgcgcggttcctctcctcagcgcgcgtcgtcccctcagggctcccggttctcgcagttgatcaaaaaatcgagagccttggttacaaccgacttatcctgcaaattggtagaggaacggtggtacctgaacccttcagtactgagtcgtttactctggatgtttacaggtacaaggattccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagagggtcatctcttctattgtacctgcagcacgcttcctgggctgttacagtcaatggacttatcaacactgaaatgttatcctcctggccagccagaaaaattttctgcatttttggataaagttgttggattacaaaaataaacactaaactctcaacactttaaaagcaacccccaaatt

SEQ ID NO: 106506 - DNA, 745 bp, Homo sapiens
  Payload ID: 918
  Gene Symbol: ALG13
  Gene Name: ALG13, UDP-N-acetylglucosaminyltransferase subunit
  ENST ID: ENST00000487141
  CDS Start-End: 45-560
ggagagagtggcctagcctccctcccagcctacatctttctcccatgctggatacttcctgccttcaaacatcagactccaagttcttcagttttgggactcggactggctctccttgctcctcagcttgcagacatcctattgtgggaccttgtgattgtaaaatcgagagccttggttacaaccgacttatcctgcaaattggtagaggaacggtggtacctgaacccttcagtactgagtcgtttactctggatgtttacaggtacaaggattccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagagggtcatctcttctattgtacctgcaggctaatattaaaaaaatgcttactagtggtagaaggtggtgacaaagaaatactctgggtagcaggaggaagccaacttggattaaaattttgctgagaataatctaaaaatatgtggagggatcttttgagaaatacctggaacggttgggagatcccaaggaaagtgctggccagctggaaataagagctctttctctaatttataatcgggatttcattctttatcgctttcctggaaaacctccaacttatgtcacagataatggctatgaagacaag

SEQ ID NO: 106507 - DNA, 3200 bp, Homo sapiens
  Payload ID: 918
  Gene Symbol: ALG13
  Gene Name: ALG13, UDP-N-acetylglucosaminyltransferase subunit
  ENST ID: ENST00000470971
  CDS Start-End: 13-144
ggaacccgcgccatgaagtgcgtgtttgttaccgtagggaccaccagctttgacgacctcattgcgtgtgtgtcggcgcccgacagtctgcaagtacaaggattccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagagggtcatctcttctattgtacctgcagtatgtggagggatcttttgagaaatacctggaacggttgggagatcccaaggaaagtgctggccagctggaaataagagctctttctctaatttataatcgggatttcattctttatcgctttcctggaaaacctccaacttatgtcacagataatggctatgaagacaagtctccagaaaatccatcaaagatgcccttcccctataaggtgctcaaagccctggatccagaaatctatcgtaatgtagaatttgatgtttggttggacagcagaaaagaacttcaaaaatctgattacatggagtatgctgggagacagtactatttgggagacaagtgtcaggtttgcttggaatcagaaggaagatattataatgctcatatccaggaagttggaaatgagaacaattcagtaacagtcttcattgaagaattggcggaaaagcatgttgttccactggctaacttaaaaccagttacccaagtgatgtctgttcctgcctggaatgctatgcccagtcggaaaggaagaggttaccagaaaatgcctgggggttatgtcccggaaatagttatatcagagatggacataaagcaacagaagaagatgttcaagaaaattcgagggaaagaagtttacatgactatggcttacggcaagggagaccccctcctcccacccaggctgcagcacagtatgcattatgggcacgatcctccaatgcactactcacagacagctggcaatgttatgtctaatgaacattttcatcctcagcatccatctccgagacaaggtcggggatatgggatgcccaggaattcatctcggtttataaacaggcacaacatgccgggccctaaagttgatttttacccaggcccaggtaaaaggtgctgccagagctatgataacttctcttatagatctcgttcatttagacgtagtcaccgccagatgagttgtgtgaataaggagtcccagtatggatttaccccagggaatggacagatgcccaggggcttggaagaaactattactttttatgaagttgaagaaggggatgagactgcttatccaactttacctaatcatggaggtccctctacaatggttcctgctacttcaggatactgtgttggaaggcggggacatagctcaggcaaacagactttgaatttagaggagggcaatggccagagtgaaaatgggcgatatcatgaagaatatctttatcgtgcagagccagactatgaaacttcaggtgtttatagcacaactgcatctacagcaaacttgtctcttcaggacagaaagtcatgttctatgtctcctcaggacacagttacctcatacaactacccccagaagatgatgggaaatattgcagcagttgcagcttcctgtgccaataatgttccagctccagtcttatctaacggtgcagcggctaatcaagctattagtaccacttcagtttcctcacagaatgctatacagcctctctttgtatctccacctacacacggcaggccagtgattgcctcaccatcctatccatgccattctgctattcctcatgctggtgcctctctaccaccaccaccaccaccaccaccaccaccaccaccaccaccacctcctcctcctcctcctcctcctcctcctcctcctcctgctcttgatgtgggagagacttcaaacttacaaccaccaccaccactaccacctccaccttattcctgtgatccaagcggcagtgatttgcctcaagatacaaaagttttgcagtactatttcaatctaggattgcagtgctattaccacagctactggcactccatggtctatgtgccacagatgcagcagcagcttcatgtagagaattatccagtctatactgagccacctctggtagatcaaaccgttcctcaatgctacagtgaggtgaggagagaagatggcatacaggcggaagcatcagcaaatgatacttttccgaatgctgattcttcatctgtccctcatggagcagtctattatccagtaatgtcagatccctatgggcagccacctttgccaggttttgactcctgccttccggttgtgccagattattcctgtgttcccccctggcatccagttggtacagcatatggtggttcttctcaaattcatggtgctataaatcctgggccaattggctgtattgctccatctcccccagcttctcattatgtacctcagggtatgtaagatccagcagtatgaagtattcttgcactgccattttcttgctgtttttgtttttaaaaagtattttatgttagtggttaaatgatttaggtgattagtgtttactattgtatttgtctttaaaattattttatcttttgatttaaaatagtactttaaaattaaggggtattattttgggctgtgactaaggaaattgagatggatgtacaactagccccatattgagcatacttcattgtattcagctgttttcctgtcagccatttgtcagctttatattagctgatggtaccaattgataaaatgaatataaagtatttcattggttcaaaaatcacacatcatattaaaccatgcagaattggagtaacttccacttttttctagaaagtaaaaccaagagcctttgcttctggataactcacttaatattaaattaaagagctcttcacgtttcttgagaattatctgaagccagttgcattctgtgatatcagttttgaaggcacatggttctctgctttagatttatcccatatgctattgtttaatactggatgtatgtaagtgttttactgcactgtattgaattggtgtcttttgcacagttagcagtaaataaaaattagcatttaaaattgccaaaa

SEQ ID NO: 106508 - DNA, 1098 bp, Homo sapiens
  Payload ID: 918
  Gene Symbol: ALG13
  Gene Name: ALG13, UDP-N-acetylglucosaminyltransferase subunit
  ENST ID: ENST00000492038
  CDS Start-End: 26-157
gatcagggcttgaggaacccgcgccatgaagtgcgtgtttgttaccgtagggaccaccagctttgacgacctcattgcgtgtgtgtcggcgcccgacagtctgcaagtacaaggattccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagagggtcatctcttctattgtacctgcagttcttccttgagacactagaagcttgccaaagggccagcacgcttcctgggctgttacagtcaatggacttatcaacactgaaatgttatcctcctggccagccagaaaaattttctgcatttttggataaagttgttggattacaaaaataaacactaaactctcaacactttaaaagcaacccccaaattcaacctatgtaatgtgattaaatcaaattaaatacataatatatatttacaaaataatataattaataaacttcctacatctatagaatgtataggaaattttatgttgtgcacatttgcattgggtccaaatcctaattgcagtttagtgaaattactagatttttttctaatcttcagtatgtagtgagcattcacaggttttctcctagaatctcaagtggaattggaatcataaaaatgaatgagatttgaaaactttcacaaagattataaatgtagttagtttgatactccttagaataaaaaaatgaaacagtaacaacttttatgtaaaaaaattttacataagagttagcatctttagctttataatctaaggaaccaaatttaaaaaatgatggattatgctctgtgaaatgaaaagttcaatcattgcctaaaaaagatgatcaagttagttgatctcttgtacttggaaaagctacttttttcctaaagaacagagtggagtggatatattcactttttttttctaaaacatacaaagtgataaaataatcgtgcctaatgtcaaaactttactggtttgagaagaataa

SEQ ID NO: 106509 - DNA, 679 bp, Homo sapiens
  Payload ID: 918
  Gene Symbol: ALG13
  Gene Name: ALG13, UDP-N-acetylglucosaminyltransferase subunit
  ENST ID: ENST00000482374
  CDS Start-End: 28-183
gcgatcagggcttgaggaacccgcgccatgaagtgcgtgtttgttaccgtagggaccaccagctttgacgacctcattgcgtgtgtgtcggcgcccgacagtctgcaagtgagtgagggaggcgagcaggcggcggcttggctcgccacccgccatctccggccatactgccagccgcgttagccttgcctgaccgtcgcgctcggaaagaaacccccgcaactctaccacaggtacaaggattccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagagggtcatctcttctattgtacctgcagcacgcttcctgggctgttacagtcaatggacttatcaacactgaaatgttatcctcctggccagccagaaaaattttctgcatttttggataaagttgttggattacaaaaataaacactaaactctcaacactttaaaagcaacccccaaattcaacctatgtaatgtgattaaatcaaattaaatacataatatatatttacaaaataatataattaataaacttcctacatctatagaatgtata

SEQ ID NO: 106510 - DNA, 4175 bp, Homo sapiens
  Payload ID: 918
  Gene Symbol: ALG13
  Gene Name: ALG13, UDP-N-acetylglucosaminyltransferase subunit
  Uniprot ID: Q9NP73
  ENST ID: ENST00000610588
  CDS Start-End: 350-3529
agttgcgtcatatccggcccttgcgatcagggcttgaggaacccgcgccatgaagtgcgtgtttgttaccgtagggaccaccagctttgacgacctcattgcgtgtgtgtcggcgcccgacagtctgcaagtgagtgagggaggcgagcaggcggcggcttggctcgccacccgccatctccggccatactgccagccgcgttagccttgcctgaccgtcgcgctcggaaagaaacccccgcaactctaccacagaaaatcgagagccttggttacaaccgacttatcctgcaaattggtagaggaacggtggtacctgaacccttcagtactgagtcgtttactctggatgtttacaggtgcaggaagctgtttggagactctggaaaaaggaaagccactcgtagtggttataaacgaaaagttgatgaacaatcatcagctggaactggcaaagcagctacacaaagagggtcatctcttctattgtacctgcagggtcctgacttgtcctgggcaagccaagtccattgcttctgctcctgggaagtgccaagattctgcagcgctgacttcaactgccttttcaggcctagactttgggctgctttccggatacctgcataagcaagcccttgttactgctacccatcctacctgcaccctgctttttccctcttgccacgctttttttcctctccctcttacccccaccctgtacaaaatgcataaaggatggaaaaactactgcagccagaagtctttgaatgaggcatcaatggatgaatatttaggcagcttagggctgtttcgaaagctgactgccaaggatgcctcttgcctctttcgggccatttcggagcagttgttttgcagccaggtccatcatttggaaatcaggaaggcttgtgtctcatatatgagggaaaatcaacaaacttttgagtcttatgtggagggatcttttgagaaatacctggaacggttgggagatcccaaggaaagtgctggccagctggaaataagagctctttctctaatttataatcgggatttcattctttatcgctttcctggaaaacctccaacttatgtcacagataatggctatgaagacaagattctactctgctactcaagtagtggtcactatgattctgtgtactcaaaacaatttcagtcaagtgcagctgtttgtcaggctgtattgtacgaaattctctataaagatgtgtttgttgtggatgaagaagagttgaagactgcgattaaattgtttcgaagtggttctaagaagaacagaaataatgctgtaactggaagcgaggatgcccatactgattacaagagttcaaatcagaataggatggaagagtggggtgcctgctacaatgctgaaaatataccagagggctacaataaaggaacagaagaaacaaagtctccagaaaatccatcaaagatgcccttcccctataaggtgctcaaagccctggatccagaaatctatcgtaatgtagaatttgatgtttggttggacagcagaaaagaacttcaaaaatctgattacatggagtatgctgggagacagtactatttgggagacaagtgtcaggtttgcttggaatcagaaggaagatattataatgctcatatccaggaagttggaaatgagaacaattcagtaacagtcttcattgaagaattggcggaaaagcatgttgttccactggctaacttaaaaccagttacccaagtgatgtctgttcctgcctggaatgctatgcccagtcggaaaggaagaggttaccagaaaatgcctgggggttatgtcccggaaatagttatatcagagatggacataaagcaacagaagaagatgttcaagaaaattcgagggaaagaagtttacatgactatggcttacggcaagggagaccccctcctcccacccaggctgcagcacagtatgcattatgggcacgatcctccaatgcactactcacagacagctggcaatgttatgtctaatgaacattttcatcctcagcatccatctccgagacaaggtcggggatatgggatgcccaggaattcatctcggtttataaacaggcacaacatgccgggccctaaagttgatttttacccaggcccaggtaaaaggtgctgccagagctatgataacttctcttatagatctcgttcatttagacgtagtcaccgccagatgagttgtgtgaataaggagtcccagtatggatttaccccagggaatggacagatgcccaggggcttggaagaaactattactttttatgaagttgaagaaggggatgagactgcttatccaactttacctaatcatggaggtccctctacaatggttcctgctacttcaggatactgtgttggaaggcggggacatagctcaggcaaacagactttgaatttagaggagggcaatggccagagtgaaaatgggcgatatcatgaagaatatctttatcgtgcagagccagactatgaaacttcaggtgtttatagcacaactgcatctacagcaaacttgtctcttcaggacagaaagtcatgttctatgtctcctcaggacacagttacctcatacaactacccccagaagatgatgggaaatattgcagcagttgcagcttcctgtgccaataatgttccagctccagtcttatctaacggtgcagcggctaatcaagctattagtaccacttcagtttcctcacagaatgctatacagcctctctttgtatctccacctacacacggcaggccagtgattgcctcaccatcctatccatgccattctgctattcctcatgctggtgcctctctaccaccaccaccaccaccaccaccaccaccaccaccaccaccacctcctcctcctcctcctcctcctcctcctcctcctcctgctcttgatgtgggagagacttcaaacttacaaccaccaccaccactaccacctccaccttattcctgtgatccaagcggcagtgatttgcctcaagatacaaaagttttgcagtactatttcaatctaggattgcagtgctattaccacagctactggcactccatggtctatgtgccacagatgcagcagcagcttcatgtagagaattatccagtctatactgagccacctctggtagatcaaaccgttcctcaatgctacagtgaggtgaggagagaagatggcatacaggcggaagcatcagcaaatgatacttttccgaatgctgattcttcatctgtccctcatggagcagtctattatccagtaatgtcagatccctatgggcagccacctttgccaggttttgactcctgccttccggttgtgccagattattcctgtgttcccccctggcatccagttggtacagcatatggtggttcttctcaaattcatggtgctataaatcctgggccaattggctgtattgctccatctcccccagcttctcattatgtacctcagggtatgtaagatccagcagtatgaagtattcttgcactgccattttcttgctgtttttgtttttaaaaagtattttatgttagtggttaaatgatttaggtgattagtgtttactattgtatttgtctttaaaattattttatcttttgatttaaaatagtactttaaaattaaggggtattattttgggctgtgactaaggaaattgagatggatgtacaactagccccatattgagcatacttcattgtattcagctgttttcctgtcagccatttgtcagctttatattagctgatggtaccaattgataaaatgaatataaagtatttcattggttcaaaaatcacacatcatattaaaccatgcagaattggagtaacttccacttttttctagaaagtaaaaccaagagcctttgcttctggataactcacttaatattaaattaaagagctcttcacgtttcttgagaattatctgaagccagttgcattctgtgatatcagttttgaaggcacatggttctctgctttagatttatcccatatgctattgtttaatactggatgtatgtaagtgttttactgcactgtattgaattggtgtcttttgcacagttagcagtaaataaaaattagcatttaaaattgcc

SEQ ID NO: 106511 - DNA, 916 bp, Homo sapiens
  Payload ID: 918
  Gene Symbol: ALG13
  Gene Name: ALG13, UDP-N-acetylglucosaminyltransferase subunit
  ENST ID: ENST00000468657
  CDS Start-End: 41-196
atatccggcccttgcgatcagggcttgaggaacccgcgccatgaagtgcgtgtttgttaccgtagggaccaccagctttgacgacctcattgcgtgtgtgtcggcgcccgacagtctgcaagtgagtgagggaggcgagcaggcggcggcttggctcgccacccgccatctccggccatactgccagccgcgttagccttgcctgaccgtcgcgctcggaaagaaacccccgcaactctaccacagaaaatcgagagccttggttacaaccgacttatcctgcaaattggtagaggaacggtggtacctgaacccttcagtactgagtcgtttactctggatgtttacaggtacaaggattccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagagggtcatctcttctattgtacctgcagcacgcttcctgggctgttacagtcaatggacttatcaacactgaaatgttatcctcctggccagccagaaaaattttctgcatttttggataaagttgttggattacaaaaataaacactaaactctcaacactttaaaagcaacccccaaattcaacctatgtaatgtgattaaatcaaattaaatacataatatatatttacaaaataatataattaataaacttcctacatctatagaatgtataggaaattttatgttgtgcacatttgcattgggtccaaatcctaattgcagtttagtgaaattactagatttttttctaatcttcagtatgtagtgagcattcacaggttttctcctagaa

SEQ ID NO: 106512 - DNA, 693 bp, Homo sapiens
  Payload ID: 918
  Gene Symbol: ALG13
  Gene Name: ALG13, UDP-N-acetylglucosaminyltransferase subunit
  ENST ID: ENST00000473389
  CDS Start-End: 31-432
cttgcgatcagggcttgaggaacccgcgccatgaagtgcgtgtttgttaccgtagggaccaccagctttgacgacctcattgcgtgtgtgtcggcgcccgacagtctgcaaaaaatcgagagccttggttacaaccgacttatcctgcaaattggtagaggaacggtggtacctgaacccttcagtactgagtcgtttactctggatgtttacaggtacaaggattccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagagggtcatctcttctattgtacctgcagttcttccttgagacactagaagcttgccaaagggccagcacgcttcctgggctgttacagtcaatggacttatcaacactgaaatgttatcctcctggccagccagaaaaattttctgcatttttggataaagttgttggattacaaaaataaacactaaactctcaacactttaaaagcaacccccaaattcaacctatgtaatgtgattaaatcaaattaaatacataatatatatttacaaaataatataattaataaacttcctacatctatagaa

SEQ ID NO: 106513 - DNA, 3893 bp, Homo sapiens
  Payload ID: 918
  Gene Symbol: ALG13
  Gene Name: ALG13, UDP-N-acetylglucosaminyltransferase subunit
  Uniprot ID: Q9NP73
  ENST ID: ENST00000621367
  CDS Start-End: 383-3247
agttgcgtcatatccggcccttgcgatcagggcttgaggaacccgcgccatgaagtgcgtgtttgttaccgtagggaccaccagctttgacgacctcattgcgtgtgtgtcggcgcccgacagtctgcaagtgagtgagggaggcgagcaggcggcggcttggctcgccacccgccatctccggccatactgccagccgcgttagccttgcctgaccgtcgcgctcggaaagaaacccccgcaactctaccacaggtacaaggattccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagagggtcatctcttctattgtacctgcagggtcctgacttgtcctgggcaagccaagtccattgcttctgctcctgggaagtgccaagattctgcagcgctgacttcaactgccttttcaggcctagactttgggctgctttccggatacctgcataagcaagcccttgttactgctacccatcctacctgcaccctgctttttccctcttgccacgctttttttcctctccctcttacccccaccctgtacaaaatgcataaaggatggaaaaactactgcagccagaagtctttgaatgaggcatcaatggatgaatatttaggcagcttagggctgtttcgaaagctgactgccaaggatgcctcttgcctctttcgggccatttcggagcagttgttttgcagccaggtccatcatttggaaatcaggaaggcttgtgtctcatatatgagggaaaatcaacaaacttttgagtcttatgtggagggatcttttgagaaatacctggaacggttgggagatcccaaggaaagtgctggccagctggaaataagagctctttctctaatttataatcgggatttcattctttatcgctttcctggaaaacctccaacttatgtcacagataatggctatgaagacaagattctactctgctactcaagtagtggtcactatgattctgtgtactcaaaacaatttcagtcaagtgcagctgtttgtcaggctgtattgtacgaaattctctataaagatgtgtttgttgtggatgaagaagagttgaagactgcgattaaattgtttcgaagtggttctaagaagaacagaaataatgctgtaactggaagcgaggatgcccatactgattacaagagttcaaatcagaataggatggaagagtggggtgcctgctacaatgctgaaaatataccagagggctacaataaaggaacagaagaaacaaagtctccagaaaatccatcaaagatgcccttcccctataaggtgctcaaagccctggatccagaaatctatcgtaatgtagaatttgatgtttggttggacagcagaaaagaacttcaaaaatctgattacatggagtatgctgggagacagtactatttgggagacaagtgtcaggtttgcttggaatcagaaggaagatattataatgctcatatccaggaagttggaaatgagaacaattcagtaacagtcttcattgaagaattggcggaaaagcatgttgttccactggctaacttaaaaccagttacccaagtgatgtctgttcctgcctggaatgctatgcccagtcggaaaggaagaggttaccagaaaatgcctgggggttatgtcccggaaatagttatatcagagatggacataaagcaacagaagaagatgttcaagaaaattcgagggaaagaagtttacatgactatggcttacggcaagggagaccccctcctcccacccaggctgcagcacagtatgcattatgggcacgatcctccaatgcactactcacagacagctggcaatgttatgtctaatgaacattttcatcctcagcatccatctccgagacaaggtcggggatatgggatgcccaggaattcatctcggtttataaacaggcacaacatgccgggccctaaagttgatttttacccaggcccaggtaaaaggtgctgccagagctatgataacttctcttatagatctcgttcatttagacgtagtcaccgccagatgagttgtgtgaataaggagtcccagtatggatttaccccagggaatggacagatgcccaggggcttggaagaaactattactttttatgaagttgaagaaggggatgagactgcttatccaactttacctaatcatggaggtccctctacaatggttcctgctacttcaggatactgtgttggaaggcggggacatagctcaggcaaacagactttgaatttagaggagggcaatggccagagtgaaaatgggcgatatcatgaagaatatctttatcgtgcagagccagactatgaaacttcaggtgtttatagcacaactgcatctacagcaaacttgtctcttcaggacagaaagtcatgttctatgtctcctcaggacacagttacctcatacaactacccccagaagatgatgggaaatattgcagcagttgcagcttcctgtgccaataatgttccagctccagtcttatctaacggtgcagcggctaatcaagctattagtaccacttcagtttcctcacagaatgctatacagcctctctttgtatctccacctacacacggcaggccagatacaaaagttttgcagtactatttcaatctaggattgcagtgctattaccacagctactggcactccatggtctatgtgccacagatgcagcagcagcttcatgtagagaattatccagtctatactgagccacctctggtagatcaaaccgttcctcaatgctacagtgaggtgaggagagaagatggcatacaggcggaagcatcagcaaatgatacttttccgaatgctgattcttcatctgtccctcatggagcagtctattatccagtaatgtcagatccctatgggcagccacctttgccaggttttgactcctgccttccggttgtgccagattattcctgtgttcccccctggcatccagttggtacagcatatggtggttcttctcaaattcatggtgctataaatcctgggccaattggctgtattgctccatctcccccagcttctcattatgtacctcagggtatgtaagatccagcagtatgaagtattcttgcactgccattttcttgctgtttttgtttttaaaaagtattttatgttagtggttaaatgatttaggtgattagtgtttactattgtatttgtctttaaaattattttatcttttgatttaaaatagtactttaaaattaaggggtattattttgggctgtgactaaggaaattgagatggatgtacaactagccccatattgagcatacttcattgtattcagctgttttcctgtcagccatttgtcagctttatattagctgatggtaccaattgataaaatgaatataaagtatttcattggttcaaaaatcacacatcatattaaaccatgcagaattggagtaacttccacttttttctagaaagtaaaaccaagagcctttgcttctggataactcacttaatattaaattaaagagctcttcacgtttcttgagaattatctgaagccagttgcattctgtgatatcagttttgaaggcacatggttctctgctttagatttatcccatatgctattgtttaatactggatgtatgtaagtgttttactgcactgtattgaattggtgtcttttgcacagttagcagtaaataaaaattagcatttaaaattgcc

SEQ ID NO: 106514 - DNA, 785 bp, Homo sapiens
  Payload ID: 918
  Gene Symbol: ALG13
  Gene Name: ALG13, UDP-N-acetylglucosaminyltransferase subunit
  ENST ID: ENST00000489033
  CDS Start-End: 4-159
gccatgaagtgcgtgtttgttaccgtagggaccaccagctttgacgacctcattgcgtgtgtgtcggcgcccgacagtctgcaagtgagtgagggaggcgagcaggcggcggcttggctcgccacccgccatctccggccatactgccagccgcgttagccttgcctgaccgtcgcgctcggaaagaaacccccgcaactctaccacagaaaatcgagagccttggttacaaccgacttatcctgcaaattggtagaggaacggtggtacctgaacccttcagtactgagtcgtttactctggatgtttacaggtgcaggaagctgtttggagactctggaaaaaggaaagccactcgtagtggttataaacgaaaagttgatgaacaatcatcagctggaactggcaaagcagctacacaaagagggtcatctcttctattgtacctgcagcacgcttcctgggctgttacagtcaatggacttatcaacactgaaatgttatcctcctggccagccagaaaaattttctgcatttttggataaagttgttggattacaaaaataaacactaaactctcaacactttaaaagcaacccccaaattcaacctatgtaatgtgattaaatcaaattaaatacataatatatatttacaaaataatataattaataaacttcctacatctatagaatgtataggaaattttatgttgtgcacatttgcattgggtccaaatcctaattgcagtttagtgaaattactagatttttttctaatcttca

SEQ ID NO: 106515 - DNA, 711 bp, Homo sapiens
  Payload ID: 918
  Gene Symbol: ALG13
  Gene Name: ALG13, UDP-N-acetylglucosaminyltransferase subunit
  ENST ID: ENST00000471924
  CDS Start-End: 1-108
attgcgtgtgtgtcggcgcccgacagtctgcaagtgagtgagggaggcgagcaggcggcggcttggctcgccacccgccatctccggccatactgccagccgcgttagccttgcctgaccgtcgcgctcggaaagaaacccccgcaactctaccacagaaaatcgagagccttggttacaaccgacttatcctgcaaattggtagaggaacggtggtacctgaacccttcagtactgagtcgtttactctggatgtttacaggtacaaggattccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagagggtcatctcttctattgtacctgcaggctaatattaaaaaaatgcttactagtggtagaaggtggtgacaaagaaatactctgggtagcaggaggaagccaacttggattaaaattttgctgagaataatctaaaaaggtcctgacttgtcctgggcaagccaagtccattgcttctgctcctgggaagtgccaagattctgcagcgctgacttcaactgccttttcaggcctagactttgggctgctttccggatacctgcataagcaagcccttg

SEQ ID NO: 106516 - DNA, 582 bp, Homo sapiens
  Payload ID: 918
  Gene Symbol: ALG13
  Gene Name: ALG13, UDP-N-acetylglucosaminyltransferase subunit
  ENST ID: ENST00000622986
  CDS Start-End: 25-423
atcagggcttgaggaacccgcgccatgaagtgcgtgtttgttaccgtagggaccaccagctttgacgacctcattgcgtgtgtgtcggcgcccgacagtctgcaaaaaatcgagagccttggttacaaccgacttatcctgcaaattggtagaggaacggtggtacctgaacccttcagtactgagtcgtttactctggatgtttacaggtacaaggattccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagagggtcatctcttctattgtacctgcaggtatgctagagactgattattattatctcttgccttaattcgtcccttgcacttcctcttatccacctacctaacccatctgtctcttctgcctcttaccttctcccagttaccaaaccttttgattttctcagctgtaaaatcctcccatttgtttgtctcccattttgcaatc

SEQ ID NO: 106517 - DNA, 440 bp, Homo sapiens
  Payload ID: 918
  Gene Symbol: ALG13
  Gene Name: ALG13, UDP-N-acetylglucosaminyltransferase subunit
  ENST ID: ENST00000623310
  CDS Start-End: 1-233
agccacctttgccaggttttgactcctgccttccggttgtgccagattattcctgtgttcccccctggcatccagttggtacagcatatggtggttcttctcaaattcatggtgctataaatcctgggccaattggctgtattgctccatctcccccagcttctcattatgtacctcaggaaagtaaaaccaagagcctttgcttctggataactcacttaatattaaattaaagagctcttcacgtttcttgagaattatctgaagccagttgcattctgtgatatcagttttgaaggcacatggttctctgctttagatttatcccatatgctattgtttaatactggatgtatgtaagtgttttactgcactgtattgaattggtgtcttttgcacagttagcagtaaataaaaattagcatttaaaattgccaaaa

SEQ ID NO: 106518 - DNA, 876 bp, Homo sapiens
  Payload ID: 918
  Gene Symbol: ALG13
  Gene Name: ALG13, UDP-N-acetylglucosaminyltransferase subunit
  ENST ID: ENST00000624881
  CDS Start-End: 41-493
atatccggcccttgcgatcagggcttgaggaacccgcgccatgaagtgcgtgtttgttaccgtagggaccaccagctttgacgacctcattgcgtgtgtgtcggcgcccgacagtctgcaaaaaatcgagagccttggttacaaccgacttatcctgcaaattggtagaggaacggtggtacctgaacccttcagtactgagtcgtttactctggatgtttacaggtgcaggaagctgtttggagactctggaaaaaggaaagccactcgtagtggttataaacgaaaagttgatgaacaatcatcagctggaactggcaaagcagctacacaaagagggtcatctcttctattgtacctgcagggtcctgacttgtcctgggcaagccaagtccattgcttctgctcctgggaagtgccaagattctgcagcgctgacttcaactgccttttcaggcctagactttgggctgctttccggatacctgcataagcaagcccttgttactgctacccatcctacctgcaccctgctttttccctcttgccacgctttttttcctctccctcttacccccaccctgtacaaaatgcataaaggatggaaaaactactgcagccagaagtctttgaatgaggcatcaatggatgaatatttaggcagcttagggctgtttcgaaagctgactgccaaggatgcctcttgcctctttcgggccatttcggagcagttgttttgcagccaggtccatcatttggaaatcaggaaggcttgtgtctcatatatgagggaaaatcaacaaacttttgagtcttatgtggagggatcttttgagaaatacctggaacggttgggagatcccaaggaaagtgctg

SEQ ID NO: 106519 - DNA, 3761 bp, Homo sapiens
  Payload ID: 918
  Gene Symbol: ALG13
  Gene Name: ALG13, UDP-N-acetylglucosaminyltransferase subunit
  ENST ID: ENST00000624161
  CDS Start-End: 44-175
gtcatatccggcccttgcgatcagggcttgaggaacccgcgccatgaagtgcgtgtttgttaccgtagggaccaccagctttgacgacctcattgcgtgtgtgtcggcgcccgacagtctgcaagtacaaggattccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagagggtcatctcttctattgtacctgcagggtcctgacttgtcctgggcaagccaagtccattgcttctgctcctgggaagtgccaagattctgcagcgctgacttcaactgccttttcaggcctagactttgggctgctttccggatacctgcataagcaagcccttgttactgctacccatcctacctgcaccctgctttttccctcttgccacgctttttttcctctccctcttacccccaccctgtacaaaatgcataaaggatggaaaaactactgcagccagaagtctttgaatgaggcatcaatggatgaatatttaggcagcttagggctgtttcgaaagctgactgccaaggatgcctcttgcctctttcgggccatttcggagcagttgttttgcagccaggtccatcatttggaaatcaggaaggcttgtgtctcatatatgagggaaaatcaacaaacttttgagtcttatgtggagggatcttttgagaaatacctggaacggttgggagatcccaaggaaagtgctggccagctggaaataagagctctttctctaatttataatcgggatttcattctttatcgctttcctggaaaacctccaacttatgtcacagataatggctatgaagacaagattctactctgctactcaagtagtggtcactatgattctgtgtactcaaaacaatttcagtcaagtgcagctgtttgtcaggctgtattgtacgaaattctctataaagatgtgtttgttgtggatgaagaagagttgaagactgcgattaaattgtttcgaagtggttctaagaagaacagaaataatgctgtaactggaagcgaggatgcccatactgattacaagagttcaaatcagaataggatggaagagtggggtgcctgctacaatgctgaaaatataccagagggctacaataaaggaacagaagaaacaaagtctccagaaaatccatcaaagatgcccttcccctataaggtgctcaaagccctggatccagaaatctatcgtaatgtagaatttgatgtttggttggacagcagaaaagaacttcaaaaatctgattacatggagtatgctgggagacagtactatttgggagacaagtgtcaggtttgcttggaatcagaaggaagatattataatgctcatatccaggaagttggaaatgagaacaattcagtaacagtcttcattgaagaattggcggaaaagcatgttgttccactggctaacttaaaaccagttacccaagtgatgtctgttcctgcctggaatgctatgcccagtcggaaaggaagaggttaccagaaaatgcctgggggttatgtcccggaaatagttatatcagagatggacataaagcaacagaagaagatgttcaagaaaattcgagggaaagaagtttacatgactatggcttacggcaagggagaccccctcctcccacccaggctgcagcacagtatgcattatgggcacgatcctccaatgcactactcacagacagctggcaatgttatgtctaatgaacattttcatcctcagcatccatctccgagacaaggtcggggatatgggatgcccaggaattcatctcggtttataaacaggcacaacatgccgggccctaaagttgatttttacccaggcccaggtaaaaggtgctgccagagctatgataacttctcttatagatctcgttcatttagacgtagtcaccgccagatgagttgtgtgaataaggagtcccagtatggatttaccccagggaatggacagatgcccaggggcttggaagaaactattactttttatgaagttgaagaaggggatgagactgcttatccaactttacctaatcatggaggtccctctacaatggttcctgctacttcaggatactgtgttggaaggcggggacatagctcaggcaaacagactttgaatttagaggagggcaatggccagagtgaaaatgggcgatatcatgaagaatatctttatcgtgcagagccagactatgaaacttcaggtgtttatagcacaactgcatctacagcaaacttgtctcttcaggacagaaagtcatgttctatgtctcctcaggacacagttacctcatacaactacccccagaagatgatgggaaatattgcagcagttgcagcttcctgtgccaataatgttccagctccagtcttatctaacggtgcagcggctaatcaagctattagtaccacttcagtttcctcacagaatgctatacagcctctctttgtatctccacctacacacggcaggccagatacaaaagttttgcagtactatttcaatctaggattgcagtgctattaccacagctactggcactccatggtctatgtgccacagatgcagcagcagcttcatgtagagaattatccagtctatactgagccacctctggtagatcaaaccgttcctcaatgctacagtgaggtgaggagagaagatggcatacaggcggaagcatcagcaaatgatacttttccgaatgctgattcttcatctgtccctcatggagcagtctattatccagtaatgtcagatccctatgggcagccacctttgccaggttttgactcctgccttccggttgtgccagattattcctgtgttcccccctggcatccagttggtacagcatatggtggttcttctcaaattcatggtgctataaatcctgggccaattggctgtattgctccatctcccccagcttctcattatgtacctcagggtatgtaagatccagcagtatgaagtattcttgcactgccattttcttgctgtttttgtttttaaaaagtattttatgttagtggttaaatgatttaggtgattagtgtttactattgtatttgtctttaaaattattttatcttttgatttaaaatagtactttaaaattaaggggtattattttgggctgtgactaaggaaattgagatggatgtacaactagccccatattgagcatacttcattgtattcagctgttttcctgtcagccatttgtcagctttatattagctgatggtaccaattgataaaatgaatataaagtatttcattggttcaaaaatcacacatcatattaaaccatgcagaattggagtaacttccacttttttctagaaagtaaaaccaagagcctttgcttctggataactcacttaatattaaattaaagagctcttcacgtttcttgagaattatctgaagccagttgcattctgtgatatcagttttgaaggcacatggttctctgctttagatttatcccatatgctattgtttaatactggatgtatgtaagtgttttactgcactgtattgaattggtgtcttttgcacagttagcagtaaataaaaattagcatttaaaattgc

SEQ ID NO: 106520 - DNA, 3693 bp, Homo sapiens
  Payload ID: 918
  Gene Symbol: ALG13
  Gene Name: ALG13, UDP-N-acetylglucosaminyltransferase subunit
  ENST ID: ENST00000623144
  CDS Start-End: 16-171
tgaggaacccgcgccatgaagtgcgtgtttgttaccgtagggaccaccagctttgacgacctcattgcgtgtgtgtcggcgcccgacagtctgcaagtgagtgagggaggcgagcaggcggcggcttggctcgccacccgccatctccggccatactgccagccgcgttagccttgcctgaccgtcgcgctcggaaagaaacccccgcaactctaccacagaaaatcgagagccttggttacaaccgacttatcctgcaaattggtagaggaacggtggtacctgaacccttcagtactgagtcgtttactctggatgtttacaggtacaaggattccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagagggtcatctcttctattgtacctgcagggtcctgacttgtcctgggcaagccaagtccattgcttctgctcctgggaagtgccaagattctgcagcgctgacttcaactgccttttcaggcctagactttgggctgctttccggatacctgcataagcaagcccttgttactgctacccatcctacctgcaccctgctttttccctcttgccacgctttttttcctctccctcttacccccaccctgtacaaaatgcataaaggatggaaaaactactgcagccagaagtctttgaatgaggcatcaatggatgaatatttaggcagcttagggctgtttcgaaagctgactgccaaggatgcctcttgcctctttcgggccatttcggagcagttgttttgcagccaggtccatcatttggaaatcaggaaggcttgtgtctcatatatgagggaaaatcaacaaacttttgagtcttatgtggagggatcttttgagaaatacctggaacggttgggagatcccaaggaaagtgctggccagctggaaataagagctctttctctaatttataatcgggatttcattctttatcgctttcctggaaaacctccaacttatgtcacagataatggctatgaagacaagattctactctgctactcaagtagtggtcactatgattctgtgtactcaaaacaatttcagtcaagtgcagctgtttgtcaggctgtattgtacgaaattctctataaagatgtgtttgttgtggatgaagaagagttgaagactgcgattaaattgtttcgaagtggttctaagaagaacagaaataatgctgtaactggaagcgaggatgcccatactgattacaagagttcaaatcagaataggatggaagagtggggtgcctgctacaatgctgaaaatataccagagggctacaataaaggaacagaagaaacaaagtctccagaaaatccatcaaagatgcccttcccctataaggtgctcaaagccctggatccagaaatctatcgtaatgtagaatttgatgtttggttggacagcagaaaagaacttcaaaaatctgattacatggagtatgctgggagacagtactatttgggagacaagtgtcaggtttgcttggaatcagaaggaagatattataatgctcatatccaggaagttggaaatgagaacaattcagtaacagtcttcattgaagaattggcggaaaagcatgttgttccactggctaacttaaaaccagttacccaagtgatgtctgttcctgcctggaatgctatgcccagtcggaaaggaagaggttaccagaaaatgcctgggggttatgtcccggaaatagttatatcagagatggacataaagcaacagaagaagatgttcaagaaaattcgagggaaagaagtttacatgactatggcttacggcaagggagaccccctcctcccacccaggctgcagcacagtatgcattatgggcacgatcctccaatgcactactcacagacagctggcaatgttatgtctaatgaacattttcatcctcagcatccatctccgagacaaggtcggggatatgggatgcccaggaattcatctcggtttataaacaggcacaacatgccgggccctaaagttgatttttacccaggcccaggtaaaaggtgctgccagagctatgataacttctcttatagatctcgttcatttagacgtagtcaccgccagatgagttgtgtgaataaggagtcccagtatggatttaccccagggaatggacagatgcccaggggcttggaagaaactattactttttatgaagttgaagaaggggatgagactgcttatccaactttacctaatcatggaggtccctctacaatggttcctgctacttcaggatactgtgttggaaggcggggacatagctcaggcaaacagactttgaatttagaggagggcaatggccagagtgaaaatgggcgatatcatgaagaatatctttatcgtgcagagccagactatgaaacttcaggtgtttatagcacaactgcatctacagcaaacttgtctcttcaggacagaaagtcatgttctatgtctcctcaggacacagttacctcatacaactacccccagaagatgatgggaaatattgcagcagttgcagcttcctgtgccaataatgttccagctccagtcttatctaacggtgcagcggctaatcaagctattagtaccacttcagtttcctcacagaatgctatacagcctctctttgtatctccacctacacacggcaggccagatacaaaagttttgcagtactatttcaatctaggattgcagtgctattaccacagctactggcactccatggtctatgtgccacagatgcagcagcagcttcatgtagagaattatccagtctatactgagccacctctggtagatcaaaccgttcctcaatgctacagtgaggtgaggagagaagatggcatacaggcggaagcatcagcaaatgatacttttccgaatgctgattcttcatctgtccctcatggagcagtctattatccagtaatgtcagatccctatgggcagccacctttgccaggttttgactcctgccttccggttgtgccagattattcctgtgttcccccctggcatccagttggtacagcatatggtggttcttctcaaattcatggtgctataaatcctgggccaattggctgtattgctccatctcccccagcttctcattatgtacctcagggtatgtaagatccagcagtatgaagtattcttgcactgccattttcttgctgtttttgtttttaaaaagtattttatgttagtggttaaatgatttaggtgattagtgtttactattgtatttgtctttaaaattattttatcttttgatttaaaatagtactttaaaattaaggggtattattttgggctgtgactaaggaaattgagatggatgtacaactagccccatattgagcatacttcattgtattcagctgttttcctgtcagccatttgtcagctttatattagctgatggtaccaattgataaaatgaatataaagtatttcattggttcaaaaatcacacatcatattaaaccatgcagaattggagtaactt

SEQ ID NO: 106521 - DNA, 585 bp, Homo sapiens
  Payload ID: 918
  Gene Symbol: ALG13
  Gene Name: ALG13, UDP-N-acetylglucosaminyltransferase subunit
  ENST ID: ENST00000623255
  CDS Start-End: 1-489
gttaccgtagggaccaccagctttgacgacctcattgcgtgtgtgtcggcgcccgacagtctgcaaaaaatcgagagccttggttacaaccgacttatcctgcaaattggtagaggaacggtggtacctgaacccttcagtactgagtcgtttactctggatgtttacaggtacaaggattccttgaaagaagacattcagaaagcagatcttgttattagtcacgcaggtaaaggtgcaggaagctgtttggagactctggaaaaaggaaagccactcgtagtggttataaacgaaaagttgatgaacaatcatcagctggaactggcaaagcagctacacaaagagggtcatctcttctattgtacctgcagcacgcttcctgggctgttacagtcaatggacttatcaacactgaaatgttatcctcctggccagccagaaaaattttctgcatttttggataaagttgttggattacaaaaataaacactaaactctcaacactttaaaagcaacccccaaattcaacctatgtaatgtgattaaatcaaattaaatacataatatatatttacaaaataa

SEQ ID NO: 106522 - DNA, 458 bp, Homo sapiens
  Payload ID: 918
  Gene Symbol: ALG13
  Gene Name: ALG13, UDP-N-acetylglucosaminyltransferase subunit
  ENST ID: ENST00000623189
  CDS Start-End: 142-327
tcgcagttgatcaagtacaaggattccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagagggtcatctcttctattgtacctgcagcacgcttcctgggctgttacagtcaatggacttatcaacactgaaatgttatcctcctggccagccagaaaaattttctgcatttttggataaagttgttggattacaaaaataaacactaaactctcaacactttaaaagcaacccccaaattcaacctatgtaatgtgattaaatcaaattaaatacataatatatatttacaaaataatataattaataaacttcctacatctatagaatgta

SEQ ID NO: 106523 - DNA, 436 bp, Homo sapiens
  Payload ID: 918
  Gene Symbol: ALG13
  Gene Name: ALG13, UDP-N-acetylglucosaminyltransferase subunit
  ENST ID: ENST00000474121
  CDS Start-End: 1-127
accaccactaccacctccaccttattcctgtgatccaagcggcagtgatttgcctcaagatacaaaagttttgcagtactatttcaatctaggattgcaggtaagtgccatgttaaaatttctttgataagccctattttcaaagtatagaccgttttgataatcagactcttgaacttcgaaagccaaaatcactaaggggactaaacattttaattctgtctaagagatctctgaagatgacatagttcagttgtctgctttagcctcccagtgctttagtttctcttataaaatagtcgttaaactgaagagaggggtactgggctgtaagcagcacaatcagcatatattagatgagccatcatatttaacattacatgctaacttttcactgtggtgttctgtctcaaaataaatgaattatcctaaaata

SEQ ID NO: 106524 - DNA, 594 bp, Homo sapiens
  Payload ID: 918
  Gene Symbol: ALG13
  Gene Name: ALG13, UDP-N-acetylglucosaminyltransferase subunit
  ENST ID: ENST00000622997
  CDS Start-End: 50-205
agttgcgtcatatccggcccttgcgatcagggcttgaggaacccgcgccatgaagtgcgtgtttgttaccgtagggaccaccagctttgacgacctcattgcgtgtgtgtcggcgcccgacagtctgcaagtgagtgagggaggcgagcaggcggcggcttggctcgccacccgccatctccggccatactgccagccgcgttagccttgcctgaccgtcgcgctcggaaagaaacccccgcaactctaccacagaaaatcgagagccttggttacaaccgacttatcctgcaaattggtagaggaacggtggtacctgaacccttcagtactgagtcgtttactctggatgtttacaggtacaaggattccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagagggtcatctcttctattgtacctgcagtcgggatttcattctttatcgctttcctggaaaacct

SEQ ID NO: 106525 - DNA, 1121 bp, Homo sapiens
  Payload ID: 918
  Gene Symbol: ALG13
  Gene Name: ALG13, UDP-N-acetylglucosaminyltransferase subunit
  ENST ID: ENST00000623622
  CDS Start-End: 1-1121
gattctgtgtactcaaaacaatttcagtcaagtgcagctgtttgtcaggctgtattgtacgaaattctctataaagatgtgtttgttgtggatgaagaagagttgaagactgcgattaaattgtttcgaagtggttctaagaagaacagaaataatgctgtaactggaagcgaggatgcccatactgattacaagagttcaaatcagaataggatggaagagtggggtgcctgctacaatgctgaaaatataccagagggctacaataaaggaacagaagaaacaaaggtttgcttggaatcagaaggaagatattataatgctcatatccaggaagttggaaatgagaacaattcagtaacagtcttcattgaagaattggcggaaaagcatgttgttccactggctaacttaaaaccagttacccaagtgatgtctgttcctgcctggaatgctatgcccagtcggaaaggaagaggttaccagaaaatgcctgggggttatgtcccggaaatagttatatcagagatggacataaagcaacagaagaagatgttcaagaaaattcgagggaaagaagtttacatgactatggcttacggcaagggagaccccctcctcccacccaggctgcagcacagtatgcattatgggcacgatcctccaatgcactactcacagacagctggcaatgttatgtctaatgaacattttcatcctcagcatccatctccgagacaaggtcggggatatgggatgcccaggaattcatctcggtttataaacaggcacaacatgccgggccctaaagttgatttttacccaggcccaggtaaaaggtgctgccagagctatgataacttctcttatagatctcgttcatttagacgtagtcaccgccagatgagttgtgtgaataaggagtcccagtatggatttaccccagggaatggacagatgcccaggggcttggaagaaactattactttttatgaagttgaagaaggggatgagactgcttatccaactttacctaatcatggaggtccctctacaatggttcctgctacttcaggatactgtgttggaaggcggggacatagctcaggcaaacagacttt

SEQ ID NO: 106526 - DNA, 3689 bp, Homo sapiens
  Payload ID: 918
  Gene Symbol: ALG13
  Gene Name: ALG13, UDP-N-acetylglucosaminyltransferase subunit
  ENST ID: ENST00000623148
  CDS Start-End: 1-108
attgcgtgtgtgtcggcgcccgacagtctgcaagtgagtgagggaggcgagcaggcggcggcttggctcgccacccgccatctccggccatactgccagccgcgttagccttgcctgaccgtcgcgctcggaaagaaacccccgcaactctaccacagaaaatcgagagccttggttacaaccgacttatcctgcaaattggtagaggaacggtggtacctgaacccttcagtactgagtcgtttactctggatgtttacaggtgcaggaagctgtttggagactctggaaaaaggaaagccactcgtagtggttataaacgaaaagttgatgaacaatcatcagctggaactggcaaagcagctacacaaagagggtcatctcttctattgtacctgcagggtcctgacttgtcctgggcaagccaagtccattgcttctgctcctgggaagtgccaagattctgcagcgctgacttcaactgccttttcaggcctagactttgggctgctttccggatacctgcataagcaagcccttgttactgctacccatcctacctgcaccctgctttttccctcttgccacgctttttttcctctccctcttacccccaccctgtacaaaatgcataaaggatggaaaaactactgcagccagaagtctttgaatgaggcatcaatggatgaatatttaggcagcttagggctgtttcgaaagctgactgccaaggatgcctcttgcctctttcgggccatttcggagcagttgttttgcagccaggtccatcatttggaaatcaggaaggcttgtgtctcatatatgagggaaaatcaacaaacttttgagtcttatgtggagggatcttttgagaaatacctggaacggttgggagatcccaaggaaagtgctggccagctggaaataagagctctttctctaatttataatcgggatttcattctttatcgctttcctggaaaacctccaacttatgtcacagataatggctatgaagacaagattctactctgctactcaagtagtggtcactatgattctgtgtactcaaaacaatttcagtcaagtgcagctgtttgtcaggctgtattgtacgaaattctctataaagatgtgtttgttgtggatgaagaagagttgaagactgcgattaaattgtttcgaagtggttctaagaagaacagaaataatgctgtaactggaagcgaggatgcccatactgattacaagagttcaaatcagaataggatggaagagtggggtgcctgctacaatgctgaaaatataccagagggctacaataaaggaacagaagaaacaaagtctccagaaaatccatcaaagatgcccttcccctataaggtgctcaaagccctggatccagaaatctatcgtaatgtagaatttgatgtttggttggacagcagaaaagaacttcaaaaatctgattacatggagtatgctgggagacagtactatttgggagacaagtgtcaggtttgcttggaatcagaaggaagatattataatgctcatatccaggaagttggaaatgagaacaattcagtaacagtcttcattgaagaattggcggaaaagcatgttgttccactggctaacttaaaaccagttacccaagtgatgtctgttcctgcctggaatgctatgcccagtcggaaaggaagaggttaccagaaaatgcctgggggttatgtcccggaaatagttatatcagagatggacataaagcaacagaagaagatgttcaagaaaattcgagggaaagaagtttacatgactatggcttacggcaagggagaccccctcctcccacccaggctgcagcacagtatgcattatgggcacgatcctccaatgcactactcacagacagctggcaatgttatgtctaatgaacattttcatcctcagcatccatctccgagacaaggtcggggatatgggatgcccaggaattcatctcggtttataaacaggcacaacatgccgggccctaaagttgatttttacccaggcccaggtaaaaggtgctgccagagctatgataacttctcttatagatctcgttcatttagacgtagtcaccgccagatgagttgtgtgaataaggagtcccagtatggatttaccccagggaatggacagatgcccaggggcttggaagaaactattactttttatgaagttgaagaaggggatgagactgcttatccaactttacctaatcatggaggtccctctacaatggttcctgctacttcaggatactgtgttggaaggcggggacatagctcaggcaaacagactttgaatttagaggagggcaatggccagagtgaaaatgggcgatatcatgaagaatatctttatcgtgcagagccagactatgaaacttcaggtgtttatagcacaactgcatctacagcaaacttgtctcttcaggacagaaagtcatgttctatgtctcctcaggacacagttacctcatacaactacccccagaagatgatgggaaatattgcagcagttgcagcttcctgtgccaataatgttccagctccagtcttatctaacggtgcagcggctaatcaagctattagtaccacttcagtttcctcacagaatgctatacagcctctctttgtatctccacctacacacggcaggccagtgattgcctcaccatcctatccatgccattctgctattcctcatgctggtgcctctctaccaccaccaccaccaccaccaccaccaccaccaccaccaccacctcctcctcctcctcctcctcctcctcctcctcctcctgctcttgatgtgggagagacttcaaacttacaaccaccaccaccactaccacctccaccttattcctgtgatccaagcggcagtgatttgcctcaagatacaaaagttttgcagtactatttcaatctaggattgcagtgctattaccacagctactggcactccatggtctatgtgccacagatgcagcagcagcttcatgtagagaattatccagtctatactgagccacctctggtagatcaaaccgttcctcaatgctacagtgaggtgaggagagaagatggcatacaggcggaagcatcagcaaatgatacttttccgaatgctgattcttcatctgtccctcatggagcagtctattatccagtaatgtcagatccctatgggcagccacctttgccaggttttgactcctgccttccggttgtgccagattattcctgtgttcccccctggcatccagttggtacagcatatggtggttcttctcaaattcatggtgctataaatcctgggccaattggctgtattgctccatctcccccagcttctcattatgtacctcagggtatgtaagatccagcagtatgaagtattcttgcactgccattttcttgctgtttttgtttttaaaaagtattttatgttagtggttaaatgatttaggtgattagtgtttactattgtatttgtctttaaaattattttatcttttgatttaaaatagtactttaaaattaaggggtattattttgggctgtgactaaggaaattgagatggatgtacaactagccccatattgagcatacttcattgtattcagctgttttcc

SEQ ID NO: 106527 - DNA, 9367 bp, Homo sapiens
  Payload ID: 919
  Gene Symbol: ALG14
  Gene Name: ALG14, UDP-N-acetylglucosaminyltransferase subunit
  Uniprot ID: Q96F25
  ENST ID: ENST00000370205
  CDS Start-End: 48-698
gacagcggctggtccccggaagttggacgcatgcgccgtttctctgcatggtgtgcgttctcgttctagctgcggccgcaggagctgtggcggttttcctaatcctgcgaatatgggtagtgcttcgttccatggacgttacgccccgggagtctctcagtatcttggtagtggctgggtccggtgggcataccactgagatcctgaggctgcttgggagcttgtccaatgcctactcacctagacattatgtcattgctgacactgatgaaatgagtgccaataaaataaattcttttgaactagatcgagctgatagagaccctagtaacatgtataccaaatactacattcaccgaattccaagaagccgggaggttcagcagtcctggccctccaccgttttcaccaccttgcactccatgtggctctcctttcccctaattcacagggtgaagccagatttggtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattactacctgcaaattttcttctggctgttttagtagtattttttttacagaactaaatatagagtttgtatgattagtaatatttcctgtcctacagctttttttttttttttttttttttgtaaagtattctgcattgtaaaagaagagagaaaaaaagtatttctgagttttggttcagatacaaaaggctttatttcctgtatggaaacagtgatgtccccagtgaatcctttcagcataaaggaagcagttatattaaattggcttcatgacaatttgcactccacaagcctccagaaccttgagcataaaccagtatcattttttgtacttcagtcttgctttttgagtagttggccttaatacagagtatcttttaaaatctcttgtttaggccggcatgacggctcacacctgtaatcccagcaccttgggaggctaaggcgggtggatcactggaggtcaggagtttgacaccagcctgaccaacatggtgaaaccttgtctctactaaaaatacaaaaattagtcaggcgtggtggcacatgcctgtaatcccagctactcgggaggctgaggcaggagaatcgcttgaacccgggaggcagaggctgcagtgagccgagattgcaccattgcactccatccagcctgggtgacaagagtgaaacttcgtctcaaaaaaaaaaaaaaaaaacaaaactcaatgatgtagggactgttattattcccattttacagatgacttgtccaagatcacatgagtagtaagtagcaaagccagaattcaagttcaggtaaacctgacttcttagtggggccagtttcacgggtgtgtggcctgtgcagtcacacagagttctgcactgaagagggcctccacttggtttaatgttctgctgtgactctcttgaacttctgaatatttttttaaacaatgaacttatattttagaccctctgaattctttcgctggtcctgcttgagactgtgtttctagtggtgccatgtctactggaatagaagtacaatagttagtgcagtgcctggcccaggagctcctcaaaaacaggaattccatttccttccctctaacctctgcttctttaacaaagcagccaaaaaaaaaaaaaacaaaacaaaataaaaaacagaaaagagaagattctctcctgtagtatatataggttttttcctcttaaatcttttgctttataagtatgatataaatctaataaatagtgattagtgaagtgattgaatttttgtgaaaagagacatgattatccacgatcatgtaagattaaaatcctgaggctgatccagccttttttcttttttttttttttaaaaaaaaaaagcaaaaaaaacaaaaaaactgtcttctctgaatcatgtaacaggcgcatctgtcagccggacatcttcctaggtttttggctggagaaatgtgtagccgaaggtgtctcagaatggtgagaacactttgctgtctggatttagtgggcctggggcagccaaatgatagttcattgtgctttgattttaatcctcaaatctcagtcactggttgcttccctggagtatcagagcgtattagtatcatacaaccaggggctgaggtgaaataagccttgactgttctagaaagaaagtgattttttcagggacaacagcatctgcattttattgctgtttaaggctttctctgctctgtactttgttccctgagtggcactaggtaaatgaatggtaagggaaagtgaactgcgtttagtgaatgcctctctgtgctgtggggcagcttccctgggcccccacaggtaatcctgctgcagaggcttctgtcaggtcagagcttaacaaagatcagaccagagagaattgtagaaaagatgctataattttttccagaaacatatgtcccagatgttttgcagagccttaacttaagacagtggttagcctggaatgtcagagaaagaatgtgtatgtgttatatcaccaaaagtttagaaatgttatatctttcataggttcaggctgctgtgtactcattcagagccaggctgagacatgtgttattgcatcttcctgatcattcagattactctggtaaacaagtgcatgctctgctgtgtgttactgttatggctaatttgagtcctcaaggtcccattagcagagggggctggtggcacaatttccctgctgtgcatttctgtgacattcagaaagatagtgcgccagtcccaactcaaactgaagaagatgagtagctagcttgtcccttccagtttctcttagaacactctgaatgcaacttttactgtaggagactgttcatgaaaaaattaattgaatcagtcttcaaatgagaggcagggaaaccacacatcctgcccacacctacttccctggaagatttctatctacagtccagctatcctaaaaggtctcagtagcttgccaggtcagaatgtctaactgtttcaaaaaggatgcccaaaaatcatgacaggaaactttagcctggaacgaagagtgctatgaaaccgtgtcaacaagaggagtggtgacaattgtgagttgaatagcaagatgtccttgctaggaaggagatgacccaagcttccccttataaaagcaacttggaacacatcattctacctttcaaagatacatggtaagttaaaattgagaaacgtacccctttactatacagttccttgggttgaatgagtgcttttttttttttctgaaaagccccatcccccaaaaggcatttgatagcaatgtattaagcaccttttaccaacaataagaacatcattgtaagtgttaaagaaaattgtccttctccctacaggtcagcgtttgagcctcacggggtttcttcccatgacttcagccctggcgcacaatgagcagacacccaaatcttgtccgccttcaacattcttttgttagggcccatccctctagcactctaaaaacaaatcatctacaactgtgttcctgctgcccactcattttaaacatgaatttgacatagctcctccttttcgcactggagtagttaactaatgctagcccactagcttctatcatgtccctcaagcaacaaactttgggatcatttttgctttttcactctttctttacccaattataattggttgccttttttgtttcattatccccagaattttctcgtcttcctcttctctccttgaaattacttttactgttcctctcctttgtcatcacctattgattctgcctttgacttagttcatatctaccctttccttttcagtcccatagttacaacctaagccagctcttcaacaaaaatttcttgcttgatgagcaagttttattgaggaactgaggaaacacctgtggaaggaacaaatgaatgattttgttaattacttatgtttgtcttcagagacttcccctcatgctagttctgtatacttgtttcacttttttctttcttttttttttttttttttttttttcgagacagtctcgctccatcgcccaggctggagtgcagtggtgcaatctcaccttactggctcactgtaacctctgcctcctggcttcaagcgattcttgtgcctcagcctcccgagtagctgggattacaggcatgcaccaccacacctggctaatttttgtatttttagtagagacagggttttaccatgttggccaggctgatcttgaactcccaacctcaggtgatccacccatcttggcctcccaaagtgctggaattacaggtgtaagccacacgtccggcccttgttccactttttataatatttacaccacagagaggttaagtaatttattaaagattatagaactagaaagtgacaaagctcagatttgaaccaaggcattctagctccagccaggcttaccttaatagctacgttaggtgtttttttttttttttaaagaaaaaagaaaaaatgtcctcaaaaggaaataaatggggtaacagggtactatgacggagtagaaggtagttggtgttctagatagggaaatcaggaaaggcctttctaagaaagtggtattttacctgagttccaaaggataatgccttaaatatttgtcctccttctacttcactcccaacttagattttgccccacccacaaagtctttgtcttcatttagcttgagcaaattctctaaataactctgtgacatagccacccataccaaaggttagtgctgagttatataccatcgaattgcagtccttgttcttagaaacacctgtggaaggaataatgaatgctattgctgattatttatgtttgtcttcagggactgtacctcattctagttttgtatccttgttccacttttgatagtatttacaccacagctctgtacaaaacataggcactaattaaatacataaattatttggccaggcatggtggctcacgcctgtaatcccagcactttgggaggccaaggtgggtgtatcacaaggtcaggagttcaagaccagcctggccaagatggtgaaaccccatctctactaaaaatacaaaaaatttgccggcgtggtggcgggcgcctgtaattccagctacttgggaggctgaggcaaataattgcttgaaccagggaggtggaggttgcagtgaactgagatggcaccactgcactccagcctgggggacagagcgagactccacctcaaaaaaaaaaaaagaaaaaaattatagcttcagacttgtctaggctcacttcagttatattttatctagaccagtgcttcacaaacgttttgatctcaggacctcattatactaaaaaattattgaaaactggctgggcacagtgtttcacacttgtaatcccagcactttgggaggccgaggtggatggatcacctgagcccaggagtttgagatcagcctgggcaacacagtaaaaccccatctctacaaaaaaaatacaaaaattagccaggcatggtgatgcacacctatagttccagctacttgggaggctgaggtggtaggatcacttgagcctgggaggtggaggttgcagtgagccgagatcatggcactgcactccagcctgggtgacagagtgagaccctgcctcagaaaaaaaaaaaatatatcccaatgagcttttgtttgtgtgagctatatttgtcaatatttaccattgtagaaactagacaaaaattttaaacgcaagaatataaaaggacatattccactggctgtcagaacaatatcatcacacatcttgtagcatctggaaaactataccatcataagaatgacaaggaaaaggcaaataacatcttaatattactatgaaaatagttttgacctcataaacccctaaaaacgtcttgaagactccccaggaccttggaccacattttaagaactgctgctttacataatgtcacatcagcgaattcatctcttctttttttaaaataagaggcagggtttcactatgttgtccagactggtctcaaactcctggtctcaaggaatcctcctatcttggccttccaaagtgctggaatcacaggcatgcggcactgcgcccggcctatctcctctttagtcagtcagtgatctgtgtattagttttatcgctgtgtaaaaaattgccacacatatattggcttaaaacaatacattatctctgtaggttagaaatccaggcaaagaaggttttctgctcaagatctcaaaaggctgaaatcaagatgatggccaaggctgagttctgatctgcaactctgaatccttttcagataccttcagatggttgttggcagaattcagttccttgcagttgtaggatttgtggtggcctgcttcctatcttttaaggactcacatgactgagtcagtgtaatctcccttttgattaattcaaggtcaactgattaggatcataattacgtcccttttgccatgttaatgtaacataatcagaggaatgacatgtcatgatattcacagatcccacccatactaacggatagtagattatccagggcatgtaaatcagggggtggaatattaggggacatcttttttttttttctttaagacggagtctcactctgtcacccaggctggagtgctgtggtgcaatctcaactcactgcaacctctacctccctggttcaagcgattctcgtgcctcagccgcctgactagctgggatttcaggagtgcaccaccagcccggctaacttttgtatttttagcagagatggggtttcaccatgttggccgggctggtctcgaactcctgggctcaagtgatccgcccacctcggcttcccaaagtgctggaattacaggcgtcagccaccatgcccgttctgggggccatctgagacttctgccaaccacaatcagctagatgttttttgttttgttttgaaaaaataataataataacctttcacttgggccaccaaactcctaccttagtatccaagttctctaatttttttttaatatgggaaatccacatctcccaaactctatcccttttctggcaagttacttgacctttctgtaaaataagcataatgtacctgcgttagagttgtagggagcactaaacattcagatgatgtatgtacagtgtttagcacagagcctgctaaatagtaagccctcaagccctcagtcacatttgtctccatcagtggtagctcccctggtgtgttaaggaggctcttctttcttttttttttttttttttttttttgagacagagtctcgctctgttgcccaggctgaagtgcagtggcgcgatctcggctcactgcaagctccgcctcctgggttcacgccattgtcctgcctcagcctcccgagtagctgggattacaggcgcctgtcaccacgcccggctaattttttttttgtttgttttttttgtatttttagtagagacagggtttcactgtgttagccaggatggtctccatctcctcacctcgtgatctgcccgcctcggcctcccaaagtgctgggattacaggcgtgagccactgcgcccggccaggaggctctttttaaactaagggcagcaaccccctagggtggctatagtccaagaaaacccagaaaatacatgctgccaaggatttggagaaattggagccctcctacattgctggtaggaatgtagaatggtgcagcagctgtggaaaacagttcagcagtttcacaaaaatcaaacatagggttatcatatgacccagaaattctacccataggtgtataccctggagaattaaaaacatgtatttacacaaaaacttatatgttcgcagcagcgttattcataataacccgaaagtagaaacaacccaaatgctctactaatgaacagataaacaaaatgtggtatatccatatagtggaatattactcgatcacacaaaggaatgaagtactaatacatgctacagtgtggatgaaccttgtaaacagtaggctaagttacagaagccagccacaaaagacaacaaatgcatgattctattcatatgaaatgtccagagtaggcaagtccatagacagaaagtagcttagtggtttccaggggcagtgagaaggggaaatggagggcaactcctaatgggtatgaggcttcttttggaggtgatgaaaatgttctggaattcgacagtggtgatggttgtacatctctgtgaatatactaaaagccactgaattgtatactgggtgaattttatggtatctgtagacattccaattgacagtcacatcttagtatagactttgagtcatctcactggaggcactagacatgcaagaggagaagtctccagattattccagccctgccatttgagtcactccaggctttctggtcttcccagctgaggctcagacaccttggaagagagaaaagctctcccttctgtgccctgtgatttgctgatccacagagttcataggcatgattaaatggtagtagttttccaccacgaagttttggaataatttgtcacaaagcaataggtaattagaaaaataacctttcagaaggagacagtttctccaaagcttgggtactttcgcttaatattaaaagaggaagaaattttttgcctgccaggcaaaaggcagaagatgtatttctacaccatggataggaaaatgattttttttcctcctttctccttggcctgcatgcagcagtgaaaaagaaaccaatggattcttttaaatctttaaccatatgcagatgaataagcacatggttggacttgattcctaatctcttttcctttcctgtataactgagatttttttccactctaataaacttgagcatttaaacag

SEQ ID NO: 106528 - DNA, 1627 bp, Homo sapiens
  Payload ID: 920
  Gene Symbol: ALG2
  Gene Name: ALG2, alpha-1,3/1,6-mannosyltransferase
  Uniprot ID: Q9H553
  ENST ID: ENST00000319033
  CDS Start-End: 94-1065
caggccatttgcatcccactgtccttgtgttcggagccaggccacaccgtcctcagcagtgtcatgtgttaaaaacgccaagctgaatatatcatgcccctattaaaacttgtacatggctccccattggtttttggagaaaagttcaagctttttaccttggtgtctgcctgtatcccagtgttcaggctggctagacggcggaagaagatcctattttactgtcacttcccagatctgcttctcaccaagagagattcttttcttaaacgactatacagggccccaattgactggatagaggaatacaccacaggcatggcagactgcatcttagtcaacagccagttcacagctgctgtttttaaggaaacattcaagtccctgtctcacatagaccctgatgtcctctatccatctctaaatgtcaccagctttgactcagttgttcctgaaaagctggatgacctagtccccaaggggaaaaaattcctgctgctctccatcaacagatacgaaaggaagaaaaatctgactttggcactggaagccctagtacagctgcgtggaagattgacatcccaagattgggagagggttcatctgatcgtggcaggtggttatgacgagagagtcctggagaatgtggaacattatcaggaattgaagaaaatggtccaacagtccgaccttggccagtatgtgaccttcttgaggtctttctcagacaaacagaaaatctccctcctccacagctgcacgtgtgtgctttacacaccaagcaatgagcactttggcattgtccctctggaagccatgtacatgcagtgcccagtcattgctgttaattcgggtggacccttggagtccattgaccacagtgtcacagggtttctgtgtgagcctgacccggtgcacttctcagaagcaatagaaaagttcatccgtgaaccttccttaaaagccaccatgggcctggctggaagagccagagtgaaggaaaaattttcccctgaagcatttacagaacagctctaccgatatgttaccaaactgctggtataatcagattgtttttaagatctccattaatgtcatttttatggattgtagacccagttttgaaaccaaaaaagaaacctagaatctaatgcagaagagatcttttaaaaaataaacttgagtcttgaatgtgagccactttcctatataccacacctccctgtccacttttcagaaaaaccatgtcttttatgctataatcattccaaattttgccagtgttaagttacaaatgtggtgtcattccatgttcagcagagtattttaattatattttctcgggattattgctcttctgtctataaattttgaatgatactgtgccttaattggttttcatagtttaagtgtgtatcattatcaaagttgattaatttggcttcatagtataatgagagcagggctattgtagttcccagattcaatccaccgaagtgttcactgtcatctgttagggaatttttgtttgtcctgtctttgcctggatccatagcgagagtgctctgtattttttttaagataatttgtatttttgcacactgagatataataaaaggtgtttatc

SEQ ID NO: 106529 - DNA, 1880 bp, Homo sapiens
  Payload ID: 920
  Gene Symbol: ALG2
  Gene Name: ALG2, alpha-1,3/1,6-mannosyltransferase
  Uniprot ID: Q9H553
  ENST ID: ENST00000476832
  CDS Start-End: 63-1313
agcgcggagcttgcgcagaagacccccatcagggtgcggggtgcagttgcggctccagggccatggcggaggagcagggccgggaacgggactcggttcccaagccgtcggtgctgttcctccacccagacctgggcgtgggcggcgctgagcggctggtgttggacgcggcgctggcgctgcaggcgcgcgggtgtagcgtgaagatctggacagcgcactacgacccgggccactgtttcgccgagagccgcgagctaccggtgcgctgtgccggggactggctgccgcgaggcctgggctggggcggccgcggcgccgccgtctgcgcctacgtgcgcatggttttcctggcgctctacgtgctgttcctcgccgacgaggagttcgacgtggtagtgtgcgaccaggtgtctgcctgtatcccagtgttcaggctggctagacggcggaagaagatcctattttactgtcacttcccagatctgcttctcaccaagagagattcttttcttaaacgactatacagggccccaattgactggatagaggaatacaccacaggcatggcagactgcatcttagtcaacagccagttcacagctgctgtttttaaggaaacattcaagtccctgtctcacatagaccctgatgtcctctatccatctctaaatgtcaccagctttgactcagttgttcctgaaaagctggatgacctagtccccaaggggaaaaaattcctgctgctctccatcaacagatacgaaaggaagaaaaatctgactttggcactggaagccctagtacagctgcgtggaagattgacatcccaagattgggagagggttcatctgatcgtggcaggtggttatgacgagagagtcctggagaatgtggaacattatcaggaattgaagaaaatggtccaacagtccgaccttggccagtatgtgaccttcttgaggtctttctcagacaaacagaaaatctccctcctccacagctgcacgtgtgtgctttacacaccaagcaatgagcactttggcattgtccctctggaagccatgtacatgcagtgcccagtcattgctgttaattcgggtggacccttggagtccattgaccacagtgtcacagggtttctgtgtgagcctgacccggtgcacttctcagaagcaatagaaaagttcatccgtgaaccttccttaaaagccaccatgggcctggctggaagagccagagtgaaggaaaaattttcccctgaagcatttacagaacagctctaccgatatgttaccaaactgctggtataatcagattgtttttaagatctccattaatgtcatttttatggattgtagacccagttttgaaaccaaaaaagaaacctagaatctaatgcagaagagatcttttaaaaaataaacttgagtcttgaatgtgagccactttcctatataccacacctccctgtccacttttcagaaaaaccatgtcttttatgctataatcattccaaattttgccagtgttaagttacaaatgtggtgtcattccatgttcagcagagtattttaattatattttctcgggattattgctcttctgtctataaattttgaatgatactgtgccttaattggttttcatagtttaagtgtgtatcattatcaaagttgattaatttggcttcatagtataatgagagcagggctattgtagttcccagattcaatccaccgaagtgttcactgtcatctgttagggaatttttgtttgtcctgtctttgcctggatccatagcgagagtgctctgtattttttttaagataatttgtatttttgcacactgagatataataaaaggtgtttatcataaa

SEQ ID NO: 106530 - DNA, 2966 bp, Homo sapiens
  Payload ID: 920
  Gene Symbol: ALG2
  Gene Name: ALG2, alpha-1,3/1,6-mannosyltransferase
  ENST ID: ENST00000238477
  CDS Start-End: 49-465
gcagaagacccccatcagggtgcggggtgcagttgcggctccagggccatggcggaggagcagggccgggaacgggactcggttcccaagccgtcggtgctgttcctccacccagacctgggcgtgggcggcgctgagcggctggtgttggacgcggcgctggcgctgcaggcgcgcgggtgtagcgtgaagatctggacagcgcactacgacccgggccactgtttcgccgagagccgcgagctaccggtgcgctgtgccggggactggctgccgcgaggcctgggctggggcggccgcggcgccgccgtctgcgcctacgtgcgcatggttttcctggcgctctacgtgctgttcctcgccgacgaggagttcgacgtggtagtgtgcgaccaggccatttgcatcccactgtccttgtgttcggagccaggccacaccgtcctcagcagtgtcatgtgttaaaaacgccaagctgaatatatcatgcccctattaaaacttgtacatggctccccattggtttttggagaaaagttcaagctttttaccttggtgtctgcctgtatcccagtgttcaggctggctagacggcggaagaagatcctattttactgtcacttcccagatctgcttctcaccaagagagattcttttcttaaacgactatacagggccccaattgactggatagaggaatacaccacaggcatggcagactgcatcttagtcaacagccagttcacagctgctgtttttaaggaaacattcaagtccctgtctcacatagaccctgatgtcctctatccatctctaaatgtcaccagctttgactcagttgttcctgaaaagctggatgacctagtccccaaggggaaaaaattcctgctgctctccatcaacagatacgaaaggaagaaaaatctgactttggcactggaagccctagtacagctgcgtggaagattgacatcccaagattgggagagggttcatctgatcgtggcaggtggttatgacgagagagtcctggagaatgtggaacattatcaggaattgaagaaaatggtccaacagtccgaccttggccagtatgtgaccttcttgaggtctttctcagacaaacagaaaatctccctcctccacagctgcacgtgtgtgctttacacaccaagcaatgagcactttggcattgtccctctggaagccatgtacatgcagtgcccagtcattgctgttaattcgggtggacccttggagtccattgaccacagtgtcacagggtttctgtgtgagcctgacccggtgcacttctcagaagcaatagaaaagttcatccgtgaaccttccttaaaagccaccatgggcctggctggaagagccagagtgaaggaaaaattttcccctgaagcatttacagaacagctctaccgatatgttaccaaactgctggtataatcagattgtttttaagatctccattaatgtcatttttatggattgtagacccagttttgaaaccaaaaaagaaacctagaatctaatgcagaagagatcttttaaaaaataaacttgagtcttgaatgtgagccactttcctatataccacacctccctgtccacttttcagaaaaaccatgtcttttatgctataatcattccaaattttgccagtgttaagttacaaatgtggtgtcattccatgttcagcagagtattttaattatattttctcgggattattgctcttctgtctataaattttgaatgatactgtgccttaattggttttcatagtttaagtgtgtatcattatcaaagttgattaatttggcttcatagtataatgagagcagggctattgtagttcccagattcaatccaccgaagtgttcactgtcatctgttagggaatttttgtttgtcctgtctttgcctggatccatagcgagagtgctctgtattttttttaagataatttgtatttttgcacactgagatataataaaaggtgtttatcataaaaaagaaacagtattagattttggtctccataatctattttggtattgttacgaacatggatatgacaaccaaactggaaatcagaacactagggtaaagtggatattgaaatgaagcaagaatattgtcacacatgtgttgtgcatcttgtttagggtatatttcttaatgtcatctaggtcattagttttgttaatatttgtgttgtcttgaccaagctcctactaagtataggacacaaatgttttttatcttccaaggcctggctcaaatgccactgctgcaaagctttctttgaccctctggccacctcccaagccagaagttatcttccccctccatgtactctagccttttcatgacactgatattttcgtgacactgacttatagttcactgtttacctgttggtctaacagcaaatcataaacagtagttttcaacatacttctaaggctaaattcatttccagaagtagcaaagcttactagccaaaggctccacatttatcaactcttaagagctagacttgagagcctaacagcctatatgattttgtgtaaattgatctctatacctcagcttcttcatctgcaaagtgagataattgtactattctactttcctcatagtgcggttataacagattatgataatattacaaagtacttaatacttggcatatagtatatatattagctattagtattttgcaatttggggatattgaaaattagaaattgcatgttagttcatgctgcactaccatattgttcttttggggctcttcaatgggtgaaattccattttacagtttatcatgtgcatctgtatcacaggagtattttggcaaaatgattctgtaccaaaaaggagtactataaaatgagggtgccaaatatattgagtcttttatgggattaaaagttctgttgcattcc

SEQ ID NO: 106531 - DNA, 1528 bp, Homo sapiens
  Payload ID: 921
  Gene Symbol: ALG3
  Gene Name: ALG3, alpha-1,3- mannosyltransferase
  Uniprot ID: Q92685
  ENST ID: ENST00000397676
  CDS Start-End: 32-1348
ggtgggcccacacaagcggcgcaccgttaagatggcggctgggctgcggaaacgcggccggtccggttccgcggcccaggcagagggactctgcaagcaatggctgcagcgcgcctggcaagagcggcgcctgctgctgcgggagccgcgctacacgctgctggtggccgcctgcctctgcctggcggaggtgggcatcaccttctgggtcattcacagggtggcatacacagagattgactggaaggcctacatggccgaggtagaaggcgtcatcaatggtacctatgactatacccaactgcagggtgacaccggaccacttgtgtacccagctggtttcgtgtacatctttatggggttgtactatgccaccagccgaggcactgacatccgcatggcccagaacatctttgctgtgctctacctggctaccttgctgcttgtcttcttgatctatcaccagacctgcaaggtacctcccttcgtctttttcttcatgtgctgcgcctcttaccgtgtccactccatctttgtgctgcggctcttcaatgacccagtggccatggtgctgctcttcctcagtatcaacctcctgctggcccagcgctggggctggggttgctgctttttcagcctggcagtctctgtgaagatgaatgtgctgctcttcgcccctgggttactgtttcttctcctcacacagtttggcttccgtggggccctccccaagctgggaatctgtgctggccttcaggtggtgctggggctgcccttcctgctggagaaccccagcggctacctgtcccgctcctttgaccttggccgccagtttctgttccactggacagtgaactggcgcttcctcccagaggcgctcttcctgcatcgagccttccacctggccctgttgactgcccacctcaccctgctcctgctgtttgccctctgcaggtggcacaggacaggggaaagtatcttgtcgctgctgagggatccctccaaaaggaaggttccaccccagccccttacacccaaccagatcgtttctaccctcttcacctccaacttcattggcatctgcttcagccgctccctccactaccagttctacgtctggtatttccacacactgccctacctcctgtgggccatgcctgcacgctggctcacacacctgctcaggttgttggtgctggggctcatcgagctctcctggaacacatacccttccacatcctgcagctctgctgccctgcacatatgccatgccgtcatcctgctgcagctctggctgggcccgcagcctttccccaagagcacccaacacagcaagaaagcccactgaagtccacccctttccctcaggacctgagtctaccctcaggacctggggttggttggactctgcccttccaaataaaccttgctaagtccaactctgtgcaacctacatggaggtgggggcagccgatgcctggtccaggctgtgagggacacgtatggagcagataaagaattcactcaa

SEQ ID NO: 106532 - DNA, 814 bp, Homo sapiens
  Payload ID: 921
  Gene Symbol: ALG3
  Gene Name: ALG3, alpha-1,3- mannosyltransferase
  ENST ID: ENST00000414845
  CDS Start-End: 1-317
ctgggctgcggaaacgcggccggtccggttccgcggcccaggcagagggactctgcaagcaatggctgcagcgcgcctggcaagagcggcgcctgctgctgcgggagccgcgctacacgctgctggtggccgcctgcctctgcctggcggaggtgggcatcaccttctgggtcattcacagggtggcatgtacccagctggtttcgtgtacatctttatggggttgtactatgccaccagccgaggcactgacatccgcatggcccagaacatctttgctgtgctctacctggctaccttgctgcttgtcttcttgatctatcaccagacctgcaagcctggcagtctctgtgaagatgaatgtgctgctcttcgcccctgggttactgtttcttctcctcacacagtttggcttccgtggggccctccccaagctgggaatctgtgctggccttcaggtggtgctggggctgcccttcctgctggagaaccccagcggctacctgtcccgctcctttgaccttggccgccagtttctgttccactggacagtgaactggcgcttcctcccagaggcgctcttcctgcatcgagccttccacctggccctgttgactgcccacctcaccctgctcctgctgtttgccctctgcaggtggcacaggacaggggaaagtatcttgtcgctgctgagggatccctccaaaaggaaggttccaccccagccccttacacccaaccagatcgtttctaccctcttcacctccaacttcattggcatctgcttcagccgctccctccactaccagttcta

SEQ ID NO: 106533 - DNA, 1452 bp, Homo sapiens
  Payload ID: 921
  Gene Symbol: ALG3
  Gene Name: ALG3, alpha-1,3- mannosyltransferase
  ENST ID: ENST00000411922
  CDS Start-End: 23-346
acacaagcggcgcaccgttaagatggcggctgggctgcggaaacgcggccggtccggttccgcggcccaggcagagggactctgcaagcaatggctgcagcgcgcctggcaagagcggcgcctgctgctgcgggagccgcgctacacgctgctggtggccgcctgcctctgcctggcggaggtgggcatcaccttctgggtcattcacagggtggcatgtacccagctggtttcgtgtacatctttatggggttgtactatgccaccagccgaggcactgacatccgcatggcccagaacatctttgctgtgctctacctggctaccttgctgcttgtcttcttgatctatcaccagacctgcaaggtacctcccttcgtctttttcttcatgtgctgcgcctcttaccgtgtccactccatctttgtgctgcggctcttcaatgacccagtggccatggtgctgctcttcctcagtatcaacctcctgctggcccagcgctggggctggggttgctgctttttcagcctggcagtctctgtgaagatgaatgtgctgctcttcgcccctgggttactgtttcttctcctcacacagtttggcttccgtggggccctccccaagctgggaatctgtgctggccttcaggtggtgctggggctgcccttcctgctggagaaccccagcggctacctgtcccgctcctttgaccttggccgccagtttctgttccactggacagtgaactggcgcttcctcccagaggcgctcttcctgcatcgagccttccacctggccctgttgactgcccacctcaccctgctcctgctgtttgccctctgcaggtggcacaggacaggggaaagtatcttgtcgctgctgagggatccctccaaaaggaaggttccaccccagccccttacacccaaccagatcgtttctaccctcttcacctccaacttcattggcatctgcttcagccgctccctccactaccagttctacgtctggtatttccacacactgccctacctcctgtgggccatgcctgcacgctggctcacacacctgctcaggttgttggtgctggggctcatcgagctctcctggaacacatacccttccacatcctgcagctctgctgccctgcacatatgccatgccgtcatcctgctgcagctctggctgggcccgcagcctttccccaagagcacccaacacagcaagaaagcccactgaagtccacccctttccctcaggacctgagtctaccctcaggacctggggttggttggactctgcccttccaaataaaccttgctaagtccaactctgtgcaacctacatggaggtgggggcagccgatgcctggtccaggctgtgagggacacgtatggagcagataaagaattcactcaagcagtcctaagaggcactttattgcataggatt

SEQ ID NO: 106534 - DNA, 967 bp, Homo sapiens
  Payload ID: 921
  Gene Symbol: ALG3
  Gene Name: ALG3, alpha-1,3- mannosyltransferase
  ENST ID: ENST00000446569
  CDS Start-End: 1-967
ggctgggctgcggaaacgcggccggtccggttccgcggcccaggcagagggactctgcaagcaatggctgcagcgcgcctggcaagagcggcgcctgctgctgcgggagccgcgctacacgctgctggtggccgcctgcctctgcctggcggaggtacctcccttcgtctttttcttcatgtgctgcgcctcttaccgtgtccactccatctttgtgctgcggctcttcaatgacccagtggccatggtgctgctcttcctcagtatcaacctcctgctggcccagcgctggggctggggttgctgctttttcagcctggcagtctctgtgaagatgaatgtgctgctcttcgcccctgggttactgtttcttctcctcacacagtttggcttccgtggggccctccccaagctgggaatctgtgctggccttcaggtggtgctggggctgcccttcctgctggagaaccccagcggctacctgtcccgctcctttgaccttggccgccagtttctgttccactggacagtgaactggcgcttcctcccagaggcgctcttcctgcatcgagccttccacctggccctgttgactgcccacctcaccctgctcctgctgtttgccctctgcaggtggcacaggacaggggaaagtatcttgtcgctgctgagggatccctccaaaaggaaggttccaccccagccccttacacccaaccagatcgtttctaccctcttcacctccaacttcattggcatctgcttcagccgctccctccactaccagttctacgtctggtatttccacacactgccctacctcctgtgggccatgcctgcacgctggctcacacacctgctcaggttgttggtgctggggctcatcgagctctcctggaacacatacccttccacatcctgcagctctgctgccctgcacatatgccatgccgtcatcctgctgcag

SEQ ID NO: 106535 - DNA, 1697 bp, Homo sapiens
  Payload ID: 921
  Gene Symbol: ALG3
  Gene Name: ALG3, alpha-1,3- mannosyltransferase
  ENST ID: ENST00000455059
  CDS Start-End: 456-1652
atcgtccagaccctgaatcctccggctgtactgccaagtcatttcctagggccgcactcaaggtgtcagactcacgtgggctcatcactgcgtcctctcatattttcaatatgaatgacttttatcaggaaatctgaaaattagtgaaaggttcatttttctcagcatccggaaggctcgaagggcaggcaggaggggcgcgaacaggggctttgccctcctggagagacagcatgaacacagatgttcccagcgcaggcgaaggagaatgctggcttcagcggttgtgggggaggtaggcaggaatgttgcttttctggacattcgttctaaattagcgcctgtgtacccagggctgggtataaactgaggagtaagacattgtccctgctcctatggagcgtggagtgcatcagaggagacaaatgcagaaaaattacattttagtggagtaaatgaagactggctactcggatcggcgcttagcctggtgggacgccaggcacgggaagcggaacctaagtgtcgaagacacagagattgactggaaggcctacatggccgaggtagaaggcgtcatcaatggtacctatgactatacccaactgcagggtgacaccggaccacttgtgtacccagctggtttcgtgtacatctttatggggttgtactatgccaccagccgaggcactgacatccgcatggcccagaacatctttgctgtgctctacctggctaccttgctgcttgtcttcttgatctatcaccagacctgcaaggtacctcccttcgtctttttcttcatgtgctgcgcctcttaccgtgtccactccatctttgtgctgcggctcttcaatgacccagtggccatggtgctgctcttcctcagtatcaacctcctgctggcccagcgctggggctggggttgctgctttttcagcctggcagtctctgtgaagatgaatgtgctgctcttcgcccctgggttactgtttcttctcctcacacagtttggcttccgtggggccctccccaagctgggaatctgtgctggccttcaggtggtgctggggctgcccttcctgctggagaaccccagcggctacctgtcccgctcctttgaccttggccgccagtttctgttccactggacagtgaactggcgcttcctcccagaggcgctcttcctgcatcgagccttccacctggccctgttgactgcccacctcaccctgctcctgctgtttgccctctgcaggtggcacaggacaggggaaagtatcttgtcgctgctgagggatccctccaaaaggaaggttccaccccagccccttacacccaaccagatcgtttctaccctcttcacctccaacttcattggcatctgcttcagccgctccctccactaccagttctacgtctggtatttccacacactgccctacctcctgtgggccatgcctgcacgctggctcacacacctgctcaggttgttggtgctggggctcatcgagctctcctggaacacatacccttccacatcctgcagctctgctgccctgcacatatgccatgccgtcatcctgctgcagctctggctgggcccgcagcctttccccaagagcacccaacacagcaagaaagcccactgaagtccacccctttccctcaggacctgagtctaccctcaggacctg

SEQ ID NO: 106536 - DNA, 1533 bp, Homo sapiens
  Payload ID: 921
  Gene Symbol: ALG3
  Gene Name: ALG3, alpha-1,3- mannosyltransferase
  Uniprot ID: Q92685
  ENST ID: ENST00000445626
  CDS Start-End: 272-1444
ttcgaagaatcctccggctgggaaaactatcgtccagaccctgaatcctccggctgtactgccaagtcatttcctagggccgcactcaaggtgtcagactcacgtgggctcatcactgcgtcctctcatattttcaatatgaatgacttttatcaggaaatctgaaaattagtgaaaggttcatttttctcagcatccggaaggctcgaagggcaggcaggaggggcgcgaacaggggctttgccctcctggagagacagcatgaacacagatgttcccagcgcaggcgaaggagaatgctggcttcagcggttgtgggggagacacagagattgactggaaggcctacatggccgaggtagaaggcgtcatcaatggtacctatgactatacccaactgcagggtgacaccggaccacttgtgtacccagctggtttcgtgtacatctttatggggttgtactatgccaccagccgaggcactgacatccgcatggcccagaacatctttgctgtgctctacctggctaccttgctgcttgtcttcttgatctatcaccagacctgcaaggtacctcccttcgtctttttcttcatgtgctgcgcctcttaccgtgtccactccatctttgtgctgcggctcttcaatgacccagtggccatggtgctgctcttcctcagtatcaacctcctgctggcccagcgctggggctggggttgctgctttttcagcctggcagtctctgtgaagatgaatgtgctgctcttcgcccctgggttactgtttcttctcctcacacagtttggcttccgtggggccctccccaagctgggaatctgtgctggccttcaggtggtgctggggctgcccttcctgctggagaaccccagcggctacctgtcccgctcctttgaccttggccgccagtttctgttccactggacagtgaactggcgcttcctcccagaggcgctcttcctgcatcgagccttccacctggccctgttgactgcccacctcaccctgctcctgctgtttgccctctgcaggtggcacaggacaggggaaagtatcttgtcgctgctgagggatccctccaaaaggaaggttccaccccagccccttacacccaaccagatcgtttctaccctcttcacctccaacttcattggcatctgcttcagccgctccctccactaccagttctacgtctggtatttccacacactgccctacctcctgtgggccatgcctgcacgctggctcacacacctgctcaggttgttggtgctggggctcatcgagctctcctggaacacatacccttccacatcctgcagctctgctgccctgcacatatgccatgccgtcatcctgctgcagctctggctgggcccgcagcctttccccaagagcacccaacacagcaagaaagcccactgaagtccacccctttccctcaggacctgagtctaccctcaggacctggggttggttggactctgcccttccaaataaaccttgctaagtcc

SEQ ID NO: 106537 - DNA, 904 bp, Homo sapiens
  Payload ID: 921
  Gene Symbol: ALG3
  Gene Name: ALG3, alpha-1,3- mannosyltransferase
  ENST ID: ENST00000423996
  CDS Start-End: 10-207
accgttaagatggcggctgggctgcggaaacgcggccggtccggttccgcggcccaggcagagggactctgcaagcaatggctgcagcgcgcctggcaagagcggcgcctgctgctgcgggagccgcgctacacgctgctggtggccgcctgcctctgcctggcggagacacagagattgactggaaggcctacatggccgaggtagaaggcgtcatcaatggtacctatgactatacccaactgcagggtgacaccggaccacttgtgtacccagctggtttcgtgtacatctttatggggttgtactatgccaccagccgaggcactgacatccgcatggcccagaacatctttgctgtgctctacctggctaccttgctgcttgtcttcttgatctatcaccagacctgcaaggtacctcccttcgtctttttcttcatgtgctgcgcctcttaccgtgtccactccatctttgtgctgcggctcttcaatgacccagtggccatggtgctgctcttcctcagtatcaacctcctgctggcccagcgctggggctggggttgctgctttttcagcctggcagtctctgtgaagatgaatgtgctgctcttcgcccctgggttactgtttcttctcctcacacagtttggcttccgtggggccctccccaagctgggaatctgtgctggccttcaggtggtgctggggctgcccttcctgctggagaaccccagcggctacctgtcccgctcctttgaccttggccgccagtttctgttccactggacagtgaactggcgcttcctcccagaggcgctcttcctgcatcgagccttccacctggccctgttgactgcccacctcaccctgctcctgctgtttgccctctgcaggtggcacag

SEQ ID NO: 106538 - DNA, 1154 bp, Homo sapiens
  Payload ID: 922
  Gene Symbol: ALG5
  Gene Name: ALG5, dolichyl-phosphate beta-glucosyltransferase
  Uniprot ID: Q9Y673
  ENST ID: ENST00000239891
  CDS Start-End: 68-1042
gggtcgcgcgggcgcgcttccgcctgtgtggaggtgcgggattgggcgggctgccacggcatggagaatggctccgcttctgttgcagctggcggtgctcggcgcggcgctggcggccgcagccctcgtactgatttccatcgttgcatttacaactgctacaaaaatgccagcactccatcgacatgaagaagagaaattcttcttaaatgccaaaggccagaaagaaactttacccagcatatgggactcacctaccaaacaactttctgtcgttgtgccttcatacaatgaagaaaaacggttgcctgtgatgatggatgaagctctgagctatctagagaagagacagaaacgagatcctgcgttcacttatgaagtgatagtagttgatgatggcagtaaagatcagacctcaaaggtagcttttaaatattgccagaaatatggaagtgacaaagtacgtgtgataaccctggtgaagaatcgtggaaaaggtggagcgattagaatgggtatattcagttctcgaggagaaaagatccttatggcagatgctgatggagccacaaagtttccagatgttgagaaattagaaaaggggctaaatgatctacagccttggcctaatcaaatggctatagcatgtggatctcgagctcatttagaaaaagaatcaattgctcagcgttcttacttccgtactcttctcatgtatgggttccactttctggtgtggttcctttgtgtcaaaggaatcagggacacacagtgtgggttcaaattatttactcgagaagcagcttcacggacgttttcatctctacacgttgaacgatgggcatttgatgtagaactactgtacatagcacagttctttaaaattccaatagcagaaattgctgtcaactggacagaaattgaaggttctaaattagttccattctggagctggctacaaatgggtaaagacctactttttatacgacttcgatatttgactggtgcctggaggcttgagcaaactcggaaaatgaattaggttgtttgcagtcttcagttgtgttcttatgcttcagtgtcacatttcatttcatttgaaactaaaattttaagtaaagctgaaataaacttcttgtcattgtctgcctttt

SEQ ID NO: 106539 - DNA, 1119 bp, Homo sapiens
  Payload ID: 922
  Gene Symbol: ALG5
  Gene Name: ALG5, dolichyl-phosphate beta-glucosyltransferase
  Uniprot ID: Q9Y673
  ENST ID: ENST00000443765
  CDS Start-End: 68-952
gggtcgcgcgggcgcgcttccgcctgtgtggaggtgcgggattgggcgggctgccacggcatggagaatggctccgcttctgttgcagctggcggtgctcggcgcggcgctggcggccgcagccctcgtactgatttccatcgttgcatttacaactgctacaaaaatgccagcactccatcgacatgaagaagagaaattcttcttaaatgccaaaggccagaaagaaactttacccagcatatgggactcacctaccaaacaactttctgtcgttgtgccttcatacaatgaagaaaaacggttgcctgtgatgatggatgaagctctgagctatctagagaagagacagaaatatggaagtgacaaagtacgtgtgataaccctggtgaagaatcgtggaaaaggtggagcgattagaatgggtatattcagttctcgaggagaaaagatccttatggcagatgctgatggagccacaaagtttccagatgttgagaaattagaaaaggggctaaatgatctacagccttggcctaatcaaatggctatagcatgtggatctcgagctcatttagaaaaagaatcaattgctcagcgttcttacttccgtactcttctcatgtatgggttccactttctggtgtggttcctttgtgtcaaaggaatcagggacacacagtgtgggttcaaattatttactcgagaagcagcttcacggacgttttcatctctacacgttgaacgatgggcatttgatgtagaactactgtacatagcacagttctttaaaattccaatagcagaaattgctgtcaactggacagaaattgaaggttctaaattagttccattctggagctggctacaaatgggtaaagacctactttttatacgacttcgatatttgactggtgcctggaggcttgagcaaactcggaaaatgaattaggttgtttgcagtcttcagttgtgttcttatgcttcagtgtcacatttcatttcatttgaaactaaaattttaagtaaagctgaaataaacttcttgtcattgtctgccttttgataattttaaagaaataactttccataagtaaaaaattatatatctctttggat

SEQ ID NO: 106540 - DNA, 1895 bp, Homo sapiens
  Payload ID: 923
  Gene Symbol: ALG6
  Gene Name: ALG6, alpha-1,3-glucosyltransferase
  ENST ID: ENST00000263440
  CDS Start-End: 209-1738
ggatacttctacatagacataatcaagttttgactatttggaaaccaagcatcattaaaattctctcaaactcctaattgcgaagaatcgataacatttcaagaagtgataacatttctctgaacaagaaaagaagtgattgaccacgttttaaaagtactctggcactggtgctgtgttttcttcccctccctaaatttgaagaactatggagaaatggtacttgatgacagtagtggttttaataggactaacagtacgatggacagtgtctcttaattcttattcaggtgctggtaaaccgcctatgtttggtgattatgaagctcagagacactggcaagaaataacttttaatttaccggtcaaacaatggtattttaacagcagtgataacaatttacagtattggggattggattacccacctcttacagcttatcatagtctcctatgtgcatatgtggcaaagtttataaatccagactggattgctctccatacatcacgtggatatgagagtcaggcacataagctcttcatgcgtacaacagttttaattgctgatctgctgatttacatacctgcagtggttttgtactgttgttgcttaaaagaaatctcaactaagaaaaagattgctaatgcattatgcatcttgctgtatccaggccttattcttatagactatggacattttcagaacatatataattctgtgagtcttggctttgctttgtggggtgttcttggaatatcttgtgactgcgacctcctagggtcactggcattttgcttagctataaattataaacagatggaactttaccacgccttgccatttttttgctttttacttggcaagtgttttaaaaaaggcctcaaaggaaaggggtttgtgttgctagttaagctagcttgtattgttgtggcttccttcgttctctgctggctgccattctttacagaaagggaacaaaccctgcaggttctaagaagactcttcccggttgatcgtggattatttgaggataaagtagccaatatttggtgcagcttcaatgtctttctgaagattaaggatattttgccacgtcacatccaattaataatgagcttttgttctacgtttttgagcctgcttcctgcatgcataaaattaatacttcagccctcttccaaaggattcaaatttacactggttagctgtgcgctatcattctttttattttctttccaagtacatgaaaaatccattctcttggtgtcactaccagtctgcttagttttaagtgaaattccttttatgtctacttggtttttacttgtgtcaacatttagtatgctacctcttctattgaaggatgaactcctaatgccctctgttgtgacaacaatggcattttttatagcttgtgtaacttccttttcaatatttgaaaagacttctgaagaagaactgcagttgaaatccttttccatttctgtgaggaaatatcttccatgttttacatttctttccagaattatacaatatttgtttcttatctcagtcatcactatggtgcttctgacgttgatgactgtcacactggatcctcctcagaaactaccggacttgttttctgtattggtgtgttttgtatcttgcttgaacttcctgttcttcttggtatactttaacattattattatgtgggattccaaaagtggaagaaatcagaagaaaatcagctagctgtattcctaaacaaattgtttcctaaacaaatgtgaaaatgtgaacagtgctgaaaggttttgtgaactttttgctatgtataaatgaaattaccattttgagaaccatggaaccacaggaaaggaaatggtgaaaagtcattgttgtctacaca

SEQ ID NO: 106541 - DNA, 3371 bp, Homo sapiens
  Payload ID: 923
  Gene Symbol: ALG6
  Gene Name: ALG6, alpha-1,3-glucosyltransferase
  Uniprot ID: Q9Y672
  ENST ID: ENST00000371108
  CDS Start-End: 306-1829
cggaaggccggaggggcagtccgccgcgggggcgagcgcgcatgcgccttcctgggacccacggcaggcgcgaatcccagcggccggcgggcggcggggatacttctacatagacataatcaagttttgactatttggaaaccaagcatcattaaaattctctcaaactcctaattgcgaagaatcgataacatttcaagaagtgataacatttctctgaacaagaaaagaagtgattgaccacgttttaaaagtactctggcactggtgctgtgttttcttcccctccctaaatttgaagaactatggagaaatggtacttgatgacagtagtggttttaataggactaacagtacgatggacagtgtctcttaattcttattcaggtgctggtaaaccgcctatgtttggtgattatgaagctcagagacactggcaagaaataacttttaatttaccggtcaaacaatggtattttaacagcagtgataacaatttacagtattggggattggattacccacctcttacagcttatcatagtctcctatgtgcatatgtggcaaagtttataaatccagactggattgctctccatacatcacgtggatatgagagtcaggcacataagctcttcatgcgtacaacagttttaattgctgatctgctgatttacatacctgcagtggttttgtactgttgttgcttaaaagaaatctcaactaagaaaaagattgctaatgcattatgcatcttgctgtatccaggccttattcttatagactatggacattttcaatataattctgtgagtcttggctttgctttgtggggtgttcttggaatatcttgtgactgcgacctcctagggtcactggcattttgcttagctataaattataaacagatggaactttaccacgccttgccatttttttgctttttacttggcaagtgttttaaaaaaggcctcaaaggaaaggggtttgtgttgctagttaagctagcttgtattgttgtggcttccttcgttctctgctggctgccattctttacagaaagggaacaaaccctgcaggttctaagaagactcttcccggttgatcgtggattatttgaggataaagtagccaatatttggtgcagcttcaatgtctttctgaagattaaggatattttgccacgtcacatccaattaataatgagcttttgttctacgtttttgagcctgcttcctgcatgcataaaattaatacttcagccctcttccaaaggattcaaatttacactggttagctgtgcgctatcattctttttattttctttccaagtacatgaaaaatccattctcttggtgtcactaccagtctgcttagttttaagtgaaattccttttatgtctacttggtttttacttgtgtcaacatttagtatgctacctcttctattgaaggatgaactcctaatgccctctgttgtgacaacaatggcattttttatagcttgtgtaacttccttttcaatatttgaaaagacttctgaagaagaactgcagttgaaatccttttccatttctgtgaggaaatatcttccatgttttacatttctttccagaattatacaatatttgtttcttatctcagtcatcactatggtgcttctgacgttgatgactgtcacactggatcctcctcagaaactaccggacttgttttctgtattggtgtgttttgtatcttgcttgaacttcctgttcttcttggtatactttaacattattattatgtgggattccaaaagtggaagaaatcagaagaaaatcagctagctgtattcctaaacaaattgtttcctaaacaaatgtgaaaatgtgaacagtgctgaaaggttttgtgaactttttgctatgtataaatgaaattaccattttgagaaccatggaaccacaggaaaggaaatggtgaaaagtcattgttgtctacacaaaataaatgtatatggagaccaaagaccaatggaggcttgtctaagtactgcttggccaaaacatgtggttttattattcacagctattcaagtggggaaaaaagagaaacatgtccttaatcccattgtttactcaggaaatgcactttttaaatgtctttaaaaaactgagaaatatttcttgatatttgctttgtctaaacctacttccttcatcagaccatatagtgagcttcatgggagaattgagccccttctttttaatggaaatcactaattttggtattcaaacttacattttagaatgcaagtagtgtgtatttcactgtttagaagtcatatcttagggaattaaatttgtgataatctttttaattactgagaaggcaatttaaactgcttgaagtttgaatatgccttattacacatgcaaatttgattgttttaacaaggcaaataaaccataatcttatttatttccaagaatgcatattttaatacaattaaaaatgaattttcctgaatttaaatgtaagctttaacttaactttaagtggtttgagtgaagtcttctaaattacacataatcactggttctaaacttccagaaccattctgtttaattaaacattatattatatatatattattattgacatggttcagggttaccactgccagagcattgattcatgttaacttcatcctattaatactgtatcaccctgtattagcagaagccaatatttattatagtattcaactggtaaaaataatacatgatatccatgttgcagtttctcatataaagatatgttttctttagcctctgtaataaagataatcattttcccatcaacattttttaaggaatatatttcttctttcataagatagccattaaactatattaagtggtggtatattttaatatagtgcaaatcaaaccacatacaaaaaaaaactggttctagacacggacagtcacaggctgatataagaaggtatgtgtttctaagtctggtaaaggaagtgggtttagacaaagcaaaaatctagaaaggtttctttctcaaagcaaatgtgcataaagactcaaagggcaggtcaacgcagaatagcagccttgaatcactgccgaatcagcaagaacattgctgtccatggtcaccatctgtaatcactgtgcccaaatgtcagcatcttggctggctggtgtagctttatttttaaaaatattttttgtaatagtacacttgtgtttaacatagaatgttgacttagataaatgatgaggaagttataaataattggagtagcataactttattatttggaaataaaagtattatgtacatatattagtaaaatgaaatgcacctga

SEQ ID NO: 106542 - DNA, 729 bp, Homo sapiens
  Payload ID: 923
  Gene Symbol: ALG6
  Gene Name: ALG6, alpha-1,3-glucosyltransferase
  ENST ID: ENST00000487136
  CDS Start-End: 246-377
acggcaggcgcgaatcccagcggccggcgggcggcggggatacttctacatagacataatcaagttttgactatttggaaaccaagcatcattaaaattctctcaaactcctaattgcgaagaatcgataacatttcaagaagtgataacatttctctgaacaagaaaagaagtgattgaccacgttttaaaagtactctggcactggtgctgtgttttcttcccctccctaaatttgaagaactatggagaaatggtacttgatgacagtagtggttttaataggactaacagtacgatggacagtgtctcttaattcttattcaggtaatacatttttactggttaaaaaaaaaacgaaattttcctttgaataggtgtttgtttggggaaaagtttaccattttctgaccagtacagagaagaatttcaggcctttttgatatggttgagaaaatacatttaaatgtccagttctaatagaaagaatatggataacagctaaatagaagcatgcgctttgtgatgtgagaaagcaaaaatgtgttctaacaggtgctggtaaaccgcctatgtttggtgattatgaagctcagagacactggcaagaaataacttttaatttaccggtcaaacaatggtattttaacagcagtgataacaatttacagtattggggattggattacccacctcttacagcttatcatagtctcctatgtgcatatg

SEQ ID NO: 106543 - DNA, 1811 bp, Homo sapiens
  Payload ID: 923
  Gene Symbol: ALG6
  Gene Name: ALG6, alpha-1,3-glucosyltransferase
  ENST ID: ENST00000603108
  CDS Start-End: 209-1054
ggatacttctacatagacataatcaagttttgactatttggaaaccaagcatcattaaaattctctcaaactcctaattgcgaagaatcgataacatttcaagaagtgataacatttctctgaacaagaaaagaagtgattgaccacgttttaaaagtactctggcactggtgctgtgttttcttcccctccctaaatttgaagaactatggagaaatggtacttgatgacagtagtggttttaataggactaacagtacgatggacagtgtctcttaattcttattcaggtgctggtaaaccgcctatgtttggtgattatgaagctcagagacactggcaagaaataacttttaatttaccggtcaaacaatggtattttaacagcagtgataacaatttacagtattggggattggattacccacctcttacagcttatcatagtctcctatgtgcatatgtggcaaagtttataaatccagactggattgctctccatacatcacgtggatatgagagtcaggcacataagctcttcatgcgtacaacagttttaattgctgatctgctgatttacatacctgcagtggttttgtactgttgttgcttaaaagaaatctcaactaagaaaaagattgctaatgcattatgcatcttgctgtatccaggccttattcttatagactatggacattttcagaacatatataattctgtgagtcttggctttgctttgtggggtgttcttggaatatcttgtgactgcgacctcctagggtcactggcattttgcttagctataaattataaacagatggaactttaccacgccttgccatttttttgctttttacttggcaagtgttttaaaaaaggcctcaaaggaaaggggtttgtgttgctagttaagctagcttgtattgttgtggcttccttcgttctctgctggctgccattctttacagaaagggaacaaaccctgcaggttctaagaagactcttcccggttgatcgtggattatttgaggcatcttttgttctacgtttttgagcctgcttcctgcatgcataaaattaatacttcagccctcttccaaaggattcaaatttacactggttagctgtgcgctatcattctttttattttctttccaagtacatgaaaaatccattctcttggtgtcactaccagtctgcttagttttaagtgaaattccttttatgtctacttggtttttacttgtgtcaacatttagtatgctacctcttctattgaaggatgaactcctaatgccctctgttgtgacaacaatggcattttttatagcttgtgtaacttccttttcaatatttgaaaagacttctgaagaagaactgcagttgaaatccttttccatttctgtgaggaaatatcttccatgttttacatttctttccagaattatacaatatttgtttcttatctcagtcatcactatggtgcttctgacgttgatgactgtcacactggatcctcctcagaaactaccggacttgttttctgtattggtgtgttttgtatcttgcttgaacttcctgttcttcttggtatactttaacattattattatgtgggattccaaaagtggaagaaatcagaagaaaatcagctagctgtattcctaaacaaattgtttcctaaacaaatgtgaaaatgtgaacagtgctgaaaggttttgtgaactttttgctatgtataaatgaaattaccattttgagaaccatggaaccacaggaaaggaaatggtgaaaagtcattgttgtctaca

SEQ ID NO: 106544 - DNA, 1675 bp, Homo sapiens
  Payload ID: 924
  Gene Symbol: ALG8
  Gene Name: ALG8, alpha-1,3-glucosyltransferase
  Uniprot ID: Q9BVK2
  ENST ID: ENST00000299626
  CDS Start-End: 73-1653
agagggctttctccgcatgcgcgggatcccggatgtggatcaagttggtgggaagcgtgcggtgccgcagcaatggcggcgctcacaattgccacgggtactggcaattggttttcggctttggcgctcggggtgactcttctcaaatgccttctcatccccacataccattccacagattttgaagtacaccgaaactggcttgctatcactcacagtttgccaatatcacagtggtattatgaggcaacttcagagtggacgttggattacccccctttctttgcatggtttgagtatatcctgtcacatgttgccaaatattttgatcaagaaatgctgaatgtccataatttgaattactccagctcaaggaccttacttttccagagattttccgtcatctttatggatgtactctttgtgtatgctgtccgtgagtgctgtaaatgcattgatggaaaaaaagtgggtaaagaacttacagaaaagccaaaatttattctgtcggtattacttctgtggaacttcgggttattaattgtggaccatattcattttcagtacaatggctttttatttggattaatgctactctccattgcacgattatttcagaaaaggcatatggaaggagcatttctctttgctgttctcctacatttcaagcatatctacctctatgtagcaccagcttatggtgtatatctgctgcgatcctactgtttcactgcaaataaaccagatgggtctattcgatggaagagtttcagctttgttcgtgttatttccctgggactggttgttttcttagtttctgctctttcattgggtcctttcctggccttgaatcagctgcctcaagtcttttcccgactctttcctttcaagaggggcctctgtcatgcatattgggctccaaacttctgggctttgtacaatgctttggacaaagtgctgtctgtcatcggtttgaaattgaaatttcttgatcccaacaatattcccaaggcctcaatgacaagtggtttggttcagcagttccaacacacagtccttccctcagtgactcccttggcaaccctcatctgcacactgattgccatattgccctctattttctgtctttggtttaaaccccaagggcccagaggctttctccgatgtctaactctttgtgccttgagctcctttatgtttgggtggcatgttcatgaaaaagccatacttctagcaattctcccaatgagccttttgtctgtgggaaaagcaggagacgcttcgatttttctgattctgaccacaacaggacattattccctctttcctctgctcttcactgcaccagaacttcccattaaaatcttactcatgttactattcaccatatatagtatttcgtcactgaagactttattcagaaaagaaaaacctctttttaattggatggaaactttctacctgcttggcctggggcctctggaagtctgctgtgaatttgtattccctttcacctcctggaaggtgaagtaccccttcatccctttgttactaacctcagtgtattgtgcagtaggcatcacatatgcttggttcaaactgtatgtttcagtattgattgactctgctattggcaagacaaagaaacaatgaataaaggaactgcttagatatg

SEQ ID NO: 106545 - DNA, 1677 bp, Homo sapiens
  Payload ID: 924
  Gene Symbol: ALG8
  Gene Name: ALG8, alpha-1,3-glucosyltransferase
  Uniprot ID: Q9BVK2
  ENST ID: ENST00000376156
  CDS Start-End: 5-1408
agcaatggcggcgctcacaattgccacgggtactggcaattggttttcggctttggcgctcggggtgactcttctcaaatgccttctcatccccacataccattccacagattttgaagtacaccgaaactggcttgctatcactcacagtttgccaatatcacagtggtattatgaggcaacttcagagtggacgttggattacccccctttctttgcatggtttgagtatatcctgtcacatgttgccaaatattttgatcaagaaatgctgaatgtccataatttgaattactccagctcaaggaccttacttttccagagattttccgtcatctttatggatgtactctttgtgtatgctgtccgtgagtgctgtaaatgcattgatggaaaaaaagtgggtaaagaacttacagaaaagccaaaatttattctgtcggtattacttctgtggaacttcgggttattaattgtggaccatattcattttcagtacaatggctttttatttggattaatgctactctccattgcacgattatttcagaaaaggcatatggaaggagcatttctctttgctgttctcctacatttcaagcatatctacctctatgtagcaccagcttatggtgtatatctgctgcgatcctactgtttcactgcaaataaaccagatgggtctattcgatggaagagtttcagctttgttcgtgttatttccctgggactggttgttttcttagtttctgctctttcattgggtcctttcctggccttgaatcagctgcctcaagtcttttcccgactctttcctttcaagaggggcctctgtcatgcatattgggctccaaacttctgggctttgtacaatgctttggacaaagtgctgtctgtcatcggtttgaaattgaaatttcttgatcccaacaatattcccaaggcctcaatgacaagtggtttggttcagcagttccaacacacagtccttccctcagtgactcccttggcaaccctcatctgcacactgattgccatattgccctctattttctgtctttggtttaaaccccaagggcccagaggctttctccgatgtctaactctttgtgccttgagctcctttatgtttgggtggcatgttcatgaaaaagccatacttctagcaattctcccaatgagccttttgtctgtgggaaaagcaggagacgcttcgatttttctgattctgaccacaacaggacattattccctctttcctctgctcttcactgcaccagaacttcccattaaaatcttactcatgttactattcaccatatatagtatttcgtcactgaagactttattcagacggagtttcacccttgttgcccaggctggagtgcaatggcacgatctcagctaactgaaacctccgcctcccagaaaagaaaaacctctttttaattggatggaaactttctacctgcttggcctggggcctctggaagtctgctgtgaatttgtattccctttcacctcctggaaggtgaagtaccccttcatccctttgttactaacctcagtgtattgtgcagtaggcatcacatatgcttggttcaaactgtatgtttcagtattgattgactctgctattggcaagacaaagaaacaatgaataaaggaactgcttag

SEQ ID NO: 106546 - DNA, 468 bp, Homo sapiens
  Payload ID: 924
  Gene Symbol: ALG8
  Gene Name: ALG8, alpha-1,3-glucosyltransferase
  ENST ID: ENST00000525761
  CDS Start-End: 179-468
ggatgtggatcaagttggtgggaagcgtgcggtgccgcagcaatggcggcgctcacaattgccacgggtactggcaattggttttcggctttggcgctcggggtgactcttctcaaatgccttctcatccccacataggccaagactgaaagcgtggaaaccaagaagcaaccatgaaatggtggtgtgtatacaccattccacagattttgaagtacaccgaaactggcttgctatcactcacagtttgccaatatcacagtggtattatgaggcaacttcagagtggacgttggattacccccctttctttgcatggtttgagtatatcctgtcacatgttgccaaatattttgatcaagaaatgctgaatgtccataatttgaattactccagctcaaggaccttacttttccagagattttccgtcatctttatggatgtactctttgtgtatgctgtccgtga

SEQ ID NO: 106547 - DNA, 714 bp, Homo sapiens
  Payload ID: 924
  Gene Symbol: ALG8
  Gene Name: ALG8, alpha-1,3-glucosyltransferase
  ENST ID: ENST00000530608
  CDS Start-End: 1-686
tgggactggttgttttcttagtttctgctctttcattgggtcctttcctggccttgaatcagctgcctcaagtcttttcccgactctttcctttcaagaggggcctctgtcatgcatattgggctccaaacttctgggctttgtacaatgctttggacaaagtgctgtctgtcatcgggcccagaggctttctccgatgtctaactctttgtgccttgagctcctttatgtttgggtggcatgttcatgaaaaagccatacttctagcaattctcccaatgagccttttgtctgtgggaaaagcaggagacgcttcgatttttctgattctgaccacaacaggacattattccctctttcctctgctcttcactgcaccagaacttcccattaaaatcttactcatgttactattcaccatatatagtatttcgtcactgaagactttattcagaaaagaaaaacctctttttaattggatggaaactttctacctgcttggcctggggcctctggaagtctgctgtgaatttgtattccctttcacctcctggaaggtgaagtaccccttcatccctttgttactaacctcagtgtattgtgcagtaggcatcacatatgcttggttcaaactgtatgtttcagtattgattgactctgctattggcaagacaaagaaacaatgaataaaggaactgcttagatatgtgccaa

SEQ ID NO: 106548 - DNA, 702 bp, Homo sapiens
  Payload ID: 924
  Gene Symbol: ALG8
  Gene Name: ALG8, alpha-1,3-glucosyltransferase
  ENST ID: ENST00000529139
  CDS Start-End: 1-473
taattgtggaccatattcattttcagtacaatggctttttatttggattaatgctactctccattgcacgattatttcagaaaaggcatatggaaggagcatttctctttgctgttctcctacatttcaagcatatctacctctatgtagcaccagcttatggtgtatatctgctgcgatcctactgtttcactgcaaataaaccagatgggtctattcgatggaagagtttcagctttgttcgtgttatttccctgggactggttgttttcttagtttctgctctttcattgggtcctttcctggccttgaatcagctgcctcaagtcttttcccgactctttcctttcaagaggggcctctgtcatgcatattgggctccaaacttctgggctttgtacaatgctttggacaaagtgctgtctgtcatcggtatggtagcgagcattttttactcagactctgaatattgaaaggacttaggcacatggagaaatggaaaaacctttgtgttttgaatgtggctgaattgtttgttctccagtcctgcatttcagctttcaggatgaacagggggagcagttcttgggactgaggctttagtgcagtaaacagactgttttccttataaaagctccttgtggtaatgaggttattgatcctttcctggggaaaaaataaaatatgtagacactctataaa

SEQ ID NO: 106549 - DNA, 680 bp, Homo sapiens
  Payload ID: 924
  Gene Symbol: ALG8
  Gene Name: ALG8, alpha-1,3-glucosyltransferase
  ENST ID: ENST00000532440
  CDS Start-End: 1-680
aaaaggcatatggaaggagcatttctctttgctgttctcctacatttcaagcatatctacctctatgtagcaccagcttatggtgtatatctgctgcgatcctactgtttcactgcaaataaaccagatgggtctattcgatggaagagtttcagctttgttcgtgttatttccctgggactggttgttttcttagtttctgctctttcattgggtcctttcctggccttgaatcagctgcctcaagtcttttcccgactctttcctttcaagaggggcctctgtcatgcatattgggctccaaacttctgggctttgtacaatgctttggacaaagtgctgtctgtcatcggtttgaaattgaaatttcttgatcccaacaatattcccaaggcctcaatgacaagtggtttggttcagcagttccaacacacagtccttccctcagtgactcccttggcaaccctcatctgcacactgattgccatattggttcaagcgattctcctgcctcagcctccagagtacctgggaatacagccctctattttctgtctttggtttaaaccccaagggcccagaggctttctccgatgtctaactctttgtgccttgagctcctttatgtttgggtggcatgttcatgaaaaagccatacttctagcaattctcccaatgag

SEQ ID NO: 106550 - DNA, 493 bp, Homo sapiens
  Payload ID: 924
  Gene Symbol: ALG8
  Gene Name: ALG8, alpha-1,3-glucosyltransferase
  ENST ID: ENST00000525783
  CDS Start-End: 1-263
tttcccgactctttcctttcaagaggggcctctgtcatgcatattgggctccaaacttctgggctttgtacaatgctttggacaaagtgctgtctgtcatcggtttgaaattgaaatttcttgatcccaacaatattcccaaggcctcaatgacaagtggtttggttcagcagttccaacacacagtccttccctcagtgactcccttggcaaccctcatctgcacactgattgccatattgaaaagaaaaacctctttttaattggatggaaactttctacctgcttggcctggggcctctggaagtctgctgtgaatttgtattccctttcacctcctggaaggtgaagtaccccttcatccctttgttactaacctcagtgtattgtgcagtaggcatcacatatgcttggttcaaactgtatgtttcagtattgattgactctgctattggcaagacaaagaaacaatgaataaaggaactgcttagat

SEQ ID NO: 106551 - DNA, 612 bp, Homo sapiens
  Payload ID: 924
  Gene Symbol: ALG8
  Gene Name: ALG8, alpha-1,3-glucosyltransferase
  ENST ID: ENST00000526849
  CDS Start-End: 1-594
tggtttggttcagcagttccaacacacagtccttccctcagtgactcccttggcaaccctcatctgcacactgattgccatattgggcccagaggctttctccgatgtctaactctttgtgccttgagctcctttatgtttgggtggcatgttcatgaaaaagccatacttctagcaattctcccaatgagccttttgtctgtgggaaaagcaggagacgcttcgatttttctgattctgaccacaacaggacattattccctctttcctctgctcttcactgcaccagaacttcccattaaaatcttactcatgttactattcaccatatatagtatttcgtcactgaagactttattcagaaaagaaaaacctctttttaattggatggaaactttctacctgcttggcctggggcctctggaagtctgctgtgaatttgtattccctttcacctcctggaaggtgaagtaccccttcatccctttgttactaacctcagtgtattgtgcagtaggcatcacatatgcttggttcaaactgtatgtttcagtattgattgactctgctattggcaagacaaagaaacaatgaataaaggaactgcttaga

SEQ ID NO: 106552 - DNA, 881 bp, Homo sapiens
  Payload ID: 924
  Gene Symbol: ALG8
  Gene Name: ALG8, alpha-1,3-glucosyltransferase
  ENST ID: ENST00000530454
  CDS Start-End: 35-881
atcaagttggtgggaagcgtgcggtgccgcagcaatggcggcgctcacaattgccacgggtactggcaattggttttcggctttggcgctcggggtgactcttctcaaatgccttctcatccccacatatagccattccacagattttgaagtacaccgaaactggcttgctatcactcacagtttgccaatatcacagtggtattatgaggcaacttcagagtggacgttggattacccccctttctttgcatggtttgagtatatcctgtcacatgttgccaaatattttgatcaagaaatgctgaatgtccataatttgaattactccagctcaaggaccttacttttccagagattttccgtcatctttatggatgtactctttgtgtatgctgtccgtgagtgctgtaaatgcattgatggaaaaaaagtgggtaaagaacttacagaaaagccaaaatttattctgtcggtattacttctgtggaacttcgggttattaattgtggaccatattcattttcagtacaatggctttttatttggattaatgctactctccattgcacgattatttcagaaaaggcatatggaaggagcatttctctttgctgttctcctacatttcaagcatatctacctctatgtagcaccagcttatggtgtatatctgctgcgatcctactgtttcactgcaaataaaccagatgggtctattcgatggaagagtttcagctttgttcgtgttatttccctgggactggttgttttcttagtttctgctctttcattgggtcctttcctggccttgaatcagctgcctcaagtcttttcccgactctttcctttcaagaggggcctctgtcatgcatattggg

SEQ ID NO: 106553 - DNA, 778 bp, Homo sapiens
  Payload ID: 924
  Gene Symbol: ALG8
  Gene Name: ALG8, alpha-1,3-glucosyltransferase
  ENST ID: ENST00000525870
  CDS Start-End: 261-778
aagttggtgggaagcgtgcggtgccgcagcaatggcggcgctcacaattgccacgggtactggcaattggttttcggctttggcgctcgggccattccacagattttgaagtacaccgaaactggcttgctatcactcacagtttgccaatatcacagtggtattatgaggcaacttcagagtggacgttggattacccccctttctttgcatggtttgagtatatcctgtcacatgttgccaaatattttgatcaagaaatgctgaatgtccataatttgaattactccagctcaaggaccttacttttccagagattttccgtcatctttatggatgtactctttgtgtatgctgtccgtgagtgctgtaaatgcattgatggaaaaaaagtgggtaaagaacttacagaaaagccaaaatttattctgtcggtattacttctgtggaacttcgggttattaattgtggaccatattcattttcagtacaatggctttttatttggattaatgctactctccattgcacgattatttcagaaaaggcatatggaaggagcatttctctttgctgttctcctacatttcaagcatatctacctctatgtagcaccagcttatggtgtatatctgctgcgatcctactgtttcactgcaaataaaccagatgggtctattcgatggaagagtttcagctttgttcgtgttatttccctgggactggttgttttcttagtttctgctctttcattgggtcctttcctggccttgaatca

SEQ ID NO: 106554 - DNA, 838 bp, Homo sapiens
  Payload ID: 924
  Gene Symbol: ALG8
  Gene Name: ALG8, alpha-1,3-glucosyltransferase
  ENST ID: ENST00000525755
  CDS Start-End: 111-838
ggatcaagttggtgggaagcgtgcggtgccgcagcaatggcggcgctcacaattgccacgggtactggcaattggttttcggctttggcgctcggggtgactcttctcaaatgccttctcatccccacatagcaacttcagagtggacgttggattacccccctttctttgcatggtttgagtatatcctgtcacatgttgccaaatattttgatcaagaaatgctgaatgtccataatttgaattactccagctcaaggaccttacttttccagagattttccgtcatctttatggatgtactctttgtgtatgctgtccgtgagtgctgtaaatgcattgatggaaaaaaagtgggtaaagaacttacagaaaagccaaaatttattctgtcggtattacttctgtggaacttcgggttattaattgtggaccatattcattttcagtacaatggctttttatttggattaatgctactctccattgcacgattatttcagaaaaggcatatggaaggagcatttctctttgctgttctcctacatttcaagcatatctacctctatgtagcaccagcttatggtgtatatctgctgcgatcctactgtttcactgcaaataaaccagatgggtctattcgatggaagagtttcagctttgttcgtgttatttccctgggactggttgttttcttagtttctgctctttcattgggtcctttcctggccttgaatcagctgcctcaagtcttttcccgactctttcctttcaagaggggcctctgtcatgcatattgggctccaaacttctgggctttgtacaatgctttggacaa

SEQ ID NO: 106555 - DNA, 844 bp, Homo sapiens
  Payload ID: 924
  Gene Symbol: ALG8
  Gene Name: ALG8, alpha-1,3-glucosyltransferase
  ENST ID: ENST00000532306
  CDS Start-End: 1-844
gcattgatggaaaaaaagtgggtaaagaacttacagaaaagccaaaatttattctgtcggtattacttctgtggaacttcgggttattaattgtggaccatattcattttcagtacaatggctttttatttggattaatgctactctccattgcacgattatttcagaaaaggcatatggaaggagcatttctctttgctgttctcctacatttcaagcatatctacctctatgtagcaccagcttatggtgtatatctgctgcgatcctactgtttcactgcaaataaaccagatgggtctattcgatggaagagtttcagctttgttcgtgttatttccctgggactggttgttttcttagtttctgctctttcattgggtcctttcctggccttgccctctattttctgtctttggtttaaaccccaagggcccagaggctttctccgatgtctaactctttgtgccttgagctcctttatgtttgggtggcatgttcatgaaaaagccatacttctagcaattctcccaatgagccttttgtctgtgggaaaagcaggagacgcttcgatttttctgattctgaccacaacaggacattattccctctttcctctgctcttcactgcaccagaacttcccattaaaatcttactcatgttactattcaccatatatagtatttcgtcactgaagactttattcagaaaagaaaaacctctttttaattggatggaaactttctacctgcttggcctggggcctctggaagtctgctgtgaatttgtattccctttcacctcctggaaggtgaagtaccccttcatccctttgttactaac

SEQ ID NO: 106556 - DNA, 829 bp, Homo sapiens
  Payload ID: 924
  Gene Symbol: ALG8
  Gene Name: ALG8, alpha-1,3-glucosyltransferase
  ENST ID: ENST00000527099
  CDS Start-End: 421-829
gtggatcaagttggtgggaagcgtgcggtgccgcagcaatggcggcgctcacaattgccacgggtactggcaattggttttcggctttggcgctcggggtgactcttctcaaatgccttctcatccccacataggtctcactctgcctctcaggctgtagtgcagtagcatgatctcatctcactgcaacctccacctttcaggctcaagcaatcctcctacctcaacctgccaagtagctgggacttaagccattccacagattttgaagtacaccgaaactggcttgctatcactcacagtttgccaatatcacagtggtattatgaggcaacttcagagtggacgttggattacccccctttctttgcatggtttgagtatatcctgtcacatgttgccaaatattttgatcaagaaatgctgaatgtccataatttgaattactccagctcaaggaccttacttttccagagattttccgtcatctttatggatgtactctttgtgtatgctgtccgtgagtgctgtaaatgcattgatggaaaaaaagtgggtaaagaacttacagaaaagccaaaatttattctgtcggtattacttctgtggaacttcgggttattaattgtggaccatattcattttcagtacaatggctttttatttggattaatgctactctccattgcacgattatttcagaaaaggcatatggaaggagcatttctctttgctgttctcctacatttcaagcatatctacctctatgtagcaccagcttatggtgtatatctgctgcgatcctactgtttcactgcaaataaaccag

SEQ ID NO: 106557 - DNA, 1674 bp, Homo sapiens
  Payload ID: 924
  Gene Symbol: ALG8
  Gene Name: ALG8, alpha-1,3-glucosyltransferase
  ENST ID: ENST00000526737
  CDS Start-End: 62-463
tccgcatgcgcgggatcccggatgtggatcaagttggtgggaagcgtgcggtgccgcagcaatggcggcgctcacaattgccacgggtactggcaattggttttcggctttggcgctcggggtgactcttctcaaatgccttctcatccccacataccattccacagattttgaagtacaccgaaactggcttgctatcactcacagtttgccaatatcacagtggtattatgaggcaacttcagagtggacgttggattacccccctttctttgcatggtttgagtatatcctgtcacatgttgccaaatattttgatcaagaaatgctgaatgtccataatttgaattactccagctcaaggaccttacttttccagagattttccgtcatctttatggatgtactctttgtgtatgctgtccgtgattgtttctgtttctttcctaatgtttcaatgtaggtgctgtaaatgcattgatggaaaaaaagtgggtaaagaacttacagaaaagccaaaatttattctgtcggtattacttctgtggaacttcgggttattaattgtggaccatattcattttcagtacaatggctttttatttggattaatgctactctccattgcacgattatttcagaaaaggcatatggaaggagcatttctctttgctgttctcctacatttcaagcatatctacctctatgtagcaccagcttatggtgtatatctgctgcgatcctactgtttcactgcaaataaaccagatgggtctattcgatggaagagtttcagctttgttcgtgttatttccctgggactggttgttttcttagtttctgctctttcattgggtcctttcctggccttgaatcagctgcctcaagtcttttcccgactctttcctttcaagaggggcctctgtcatgcatattgggctccaaacttctgggctttgtacaatgctttggacaaagtgctgtctgtcatcggtttgaaattgaaatttcttgatcccaacaatattcccaaggcctcaatgacaagtggtttggttcagcagttccaacacacagtccttccctcagtgactcccttggcaaccctcatctgcacactgattgccatattgccctctattttctgtctttggtttaaaccccaagggcccagaggctttctccgatgtctaactctttgtgccttgagctcctttatgtttgggtggcatgttcatgaaaaagccatacttctagcaattctcccaatgagccttttgtctgtgggaaaagcaggagacgcttcgatttttctgattctgaccacaacaggacattattccctctttcctctgctcttcactgcaccagaacttcccattaaaatcttactcatgttactattcaccatatatagtatttcgtcactgaagactttattcagaaaagaaaaacctctttttaattggatggaaactttctacctgcttggcctggggcctctggaagtctgctgtgaatttgtattccctttcacctcctggaaggtgaagtaccccttcatccctttgttactaacctcagtgtattgtgcagtaggcatcacatatgcttggttcaaactgtatgtttcagtattgattgactctgctattggcaagacaaagaaacaat

SEQ ID NO: 106558 - DNA, 860 bp, Homo sapiens
  Payload ID: 924
  Gene Symbol: ALG8
  Gene Name: ALG8, alpha-1,3-glucosyltransferase
  ENST ID: ENST00000530910
  CDS Start-End: 482-860
tcagggtcctcatccttaataggcagttaagaacctctgcctccaacagccattcagccagtattatcagatgcctgaggtgccaggtaccgttctaactcccgggagatgcggtggtgagcaagacattgctggtccttgccctcgaagttggtgggtggagctagacaaacaggaacttttcagattgtgataaaggaaatagagggttactaagtggctgtgcgctattcctttagaaggtgatgtttgagttgaaattcaaaaaatgaaaaagaataagtgatgtggaaagcagttcaggcataggaaagagtaagttcaaaggccctgtggcaggaaagaagtcagagcattctaggaacagaaagtgccccttgtggctgcagagcattgagggagaggagtggcacagcatggggtgcactggggacagataacacagggtttcgaagaccacagttagactgctgtgtaaaaaatggatgtagggccaagactgaaagcgtggaaaccaagaagcaaccatgaaatggtggtgtgtatacaccattccacagattttgaagtacaccgaaactggcttgctatcactcacagtttgccaatatcacagtggtattatgaggcaacttcagagtggacgttggattacccccctttctttgcatggtttgagtatatcctgtcacatgttgccaaatattttgatcaagaaatgctgaatgtccataatttgaattactccagctcaaggaccttacttttccagagattttccgtcatctttatggatgtactctttgtgtatgctgtccgtgagtgctgtaaatgcattgatggaaaaaaagtgggtaaag

SEQ ID NO: 106559 - DNA, 892 bp, Homo sapiens
  Payload ID: 924
  Gene Symbol: ALG8
  Gene Name: ALG8, alpha-1,3-glucosyltransferase
  ENST ID: ENST00000532050
  CDS Start-End: 35-745
atcaagttggtgggaagcgtgcggtgccgcagcaatggcggcgctcacaattgccacgggtactggcaattggttttcggctttggcgctcggggtgactcttctcaaatgccttctcatccccacataccattccacagattttgaagtacaccgaaactggcttgctatcactcacagtttgccaatatcacagtggtattatgaggcaacttcagagtggacgttggattacccccctttctttgcatggtttgagtatatcctgtcacatgttgccaaatattttgatcaagaaatgctgaatgtccataatttgaattactccagctcaaggaccttacttttccagagattttccgtcatctttatggatgtactctttgtgtatgctgtccgtgagtgctgtaaatgcattgatggaaaaaaagtgggtaaagaacttacagaaaagccaaaatttattctgtcggtattacttctgtggaacttcgggttattaattgtggaccatattcattttcagtacaatggctttttatttggattaatgctactctccattgcacgattatttcagagacagggcctccctattttgtccaggctggtcttgaactcctggggtcaagcaatccttccacgtcggcttaccaaagtgctgggattgcaggtaaaaggcatatggaaggagcatttctctttgctgttctcctacatttcaagcatatctacctctatgtagcaccagcttatggtgtatatctgctgcgatcctactgtttcactgcaaataaaccagatgggtctattcgatggaagagtttcagctttgttcgtgttatttccctgggactggttgttttcttagtttctgctctttcattgggtc

SEQ ID NO: 106560 - DNA, 1469 bp, Homo sapiens
  Payload ID: 924
  Gene Symbol: ALG8
  Gene Name: ALG8, alpha-1,3-glucosyltransferase
  Uniprot ID: Q9BVK2
  ENST ID: ENST00000615266
  CDS Start-End: 66-1469
tttctccgcatgcgcgggatcccggatgtggatcaagttggtgggaagcgtgcggtgccgcagcaatggcggcgctcacaattgccacgggtactggcaattggttttcggctttggcgctcggggtgactcttctcaaatgccttctcatccccacataccattccacagattttgaagtacaccgaaactggcttgctatcactcacagtttgccaatatcacagtggtattatgaggcaacttcagagtggacgttggattacccccctttctttgcatggtttgagtatatcctgtcacatgttgccaaatattttgatcaagaaatgctgaatgtccataatttgaattactccagctcaaggaccttacttttccagagattttccgtcatctttatggatgtactctttgtgtatgctgtccgtgagtgctgtaaatgcattgatggaaaaaaagtgggtaaagaacttacagaaaagccaaaatttattctgtcggtattacttctgtggaacttcgggttattaattgtggaccatattcattttcagtacaatggctttttatttggattaatgctactctccattgcacgattatttcagaaaaggcatatggaaggagcatttctctttgctgttctcctacatttcaagcatatctacctctatgtagcaccagcttatggtgtatatctgctgcgatcctactgtttcactgcaaataaaccagatgggtctattcgatggaagagtttcagctttgttcgtgttatttccctgggactggttgttttcttagtttctgctctttcattgggtcctttcctggccttgaatcagctgcctcaagtcttttcccgactctttcctttcaagaggggcctctgtcatgcatattgggctccaaacttctgggctttgtacaatgctttggacaaagtgctgtctgtcatcggtttgaaattgaaatttcttgatcccaacaatattcccaaggcctcaatgacaagtggtttggttcagcagttccaacacacagtccttccctcagtgactcccttggcaaccctcatctgcacactgattgccatattgccctctattttctgtctttggtttaaaccccaagggcccagaggctttctccgatgtctaactctttgtgccttgagctcctttatgtttgggtggcatgttcatgaaaaagccatacttctagcaattctcccaatgagccttttgtctgtgggaaaagcaggagacgcttcgatttttctgattctgaccacaacaggacattattccctctttcctctgctcttcactgcaccagaacttcccattaaaatcttactcatgttactattcaccatatatagtatttcgtcactgaagactttattcagacggagtttcacccttgttgcccaggctggagtgcaatggcacgatctcagctaa

SEQ ID NO: 106561 - DNA, 2345 bp, Homo sapiens
  Payload ID: 925
  Gene Symbol: ALG9
  Gene Name: ALG9, alpha-1,2-mannosyltransferase
  Uniprot ID: Q9H6U8
  ENST ID: ENST00000398006
  CDS Start-End: 910-2232
gctgcccccgggagggtcttagctgtggcgcgcggggctcagtccggcctggcctcaccgcgggaggcccgagctccctcttcagctaggtcctattggtcttcctgggcgggtcagcattcagtcttcgcccaccttagatccctccactgcgctgtaaaactgccttggagtgcggatctgtgatgctcctgggccaggcctagagtgggcacagcctctgtgggagatgtagacaggatcaaagagtataccttttacggctgttcctcacagctccttttattctccctcaagtcccgaccctttactgggcccatccaacccgccatcacctcttcccaaaccctggaggctgcaggttagaactgcattaagggagctgtcaacatatggaattggagtaggctatgtaccttgcacctaggcttctatctgaacataagggggaatgaataaagccatcaaaagcaatgaccttgttaagaaaagaaagaaaaggagaatgacagctttgtggccttcaagttatctgggaacaaagcaggacaagtctgggcacctgaaggatctactgctttcaagtgtctgctttcagcaaggttatgtgctgctctcctgagcaacatctctgactgtgatgaaacattcaactactgggagccaacacactacctcatctatggggaagggtttcagacttgggaatattccccagcatatgccattcgctcctatgcttacctgttgcttcatgcctggccagctgcatttcatgcaagaattctacaaactaataagattcttgtgttttactttttgcgatgtcttctggcttttgtgagctgtatttgtgaactttacttttacaaggctgtgtgcaagaagtttgggttgcacgtgagtcgaatgatgctagccttcttggttctcagcactggcatgttttgctcatcatcagcattccttcctagtagcttctgtatgtacactacgttgatagccatgactggatggtatatggacaagacttccattgctgtgctgggagtagcagctggggctatcttaggctggccattcagtgcagctcttggtttacccattgcctttgatttgctggtcatgaaacacaggtggaagagtttctttcattggtcgctgatggccctcatactatttctggtgcctgtggtggtcattgacagctactattatgggaagttggtgattgcaccactcaacattgttttgtataatgtctttactcctcatggacctgatctttatggtacagaaccctggtatttctatttaattaatggatttctgaatttcaatgtagcctttgctttggctctcctagtcctaccactgacttctcttatggaatacctgctgcagagatttcatgttcagaatttaggccacccgtattggcttaccttggctccaatgtatatttggtttataattttcttcatccagcctcacaaagaggagagatttcttttccctgtgtatccacttatatgtctctgtggcgctgtggctctctctgcacttcagaaatgttaccactttgtgtttcaacgatatcgcctggagcactatactgtgacatcgaattggctggcattaggaactgtcttcctgtttgggctcttgtcattttctcgctctgtggcactgttcagaggatatcacgggccccttgatttgtatccagaattttaccgaattgctacagacccaaccatccacactgtcccagaaggcagacctgtgaatgtctgtgtgggaaaagagtggtatcgatttcccagcagcttccttcttcctgacaattggcagcttcagttcattccatcagagttcagaggtcagttaccaaaaccttttgcagaaggacctctggccacccggattgttcctactgacatgaatgaccagaatctagaagagccatccagatatattgatatcagtaaatgccattatttagtggatttggacaccatgagagaaacaccccgggagccaaaatattcatccaataaagaagaatggatcagcttggcctatagaccattccttgatgcttctagatcttcaaagctgctgcgggcattctatgtccccttcctgtcagatcagtatacagtgtacgtaaactacaccatcctcaaaccccggaaagcaaagcaaatcaggaagaaaagtggaggttagcaacacacctgtggccccaaaggacaaccatcttgttaactattgattccagtgacctgactccctgcaagtcatcgcctgtaacatttgtaataaaggtcttctgacatgaa

SEQ ID NO: 106562 - DNA, 4485 bp, Homo sapiens
  Payload ID: 925
  Gene Symbol: ALG9
  Gene Name: ALG9, alpha-1,2-mannosyltransferase
  ENST ID: ENST00000532425
  CDS Start-End: 1-623
gaactgtcttcctgtttgggctcttgtcattttctcgctctgtggcactgttcagaggatatcacgggccccttgatttgtatccagaattttaccgaattgctacagacccaaccatccacactgtcccagaaggcagacctgtgaatgtctgtgtgggaaaagagtggtatcgatttcccagcagcttccttcttcctgacaattggcagcttcagttcattccatcagagttcagaggtcagttaccaaaaccttttgcagaaggacctctggccacccggattgttcctactgacatgaatgaccagaatctagaagagccatccagatatattgatatcagtaaatgccattatttagtggatttggacaccatgagagaaacaccccgggagccaaaatattcatccaataaagaagaatggatcagcttggcctatagaccattccttgatgcttctagatcttcaaagctgctgcgggcattctatgtccccttcctgtcagatcagtatacagtgtacgtaaactacaccatcctcaaaccccggaaagcaaagcaaatcaggaagaaaagtggagaccggagaagagcagaaccaacttacaggaagaattgaaaatcctggtactggatggctgtgataagctgttctccacactctggcctggcatctgagaactagcaagcctctcttaggccatatgggcttctccaccaaagctgtttggcagctcctagcagaccttcttattgaaatcctcatgctgaaaatgaacacagcctagttgccaacccacatgtccttttcacctccagcaagactaagcttctttaaagcacttcacaggactaggaccctgtcctggagctatctcaggaaaaaggtgaccatttgaggaactgtgacctaattttattataatgatgcctctaattttcatttcctttacaaccaactgtaactataaggttgtattgcttttttgttcagttttagcatgctattttttgaattctagactcctccatgtgaagatatcaacagacaaaactacaactgtataggacatatttggagaaaattctatcaattgatacatttggatgacatcacatttttaagtaatgtaatctgaggccattgctgaggaaattaagaattttcctttttttttaaccacccccagtgaaaaggatcagtgtatatttatagcacctattttttagttctgtctgttgtgaggcacatcctgcatggggcacttctagtcaaataggcaatgataaggacctaattaaaatgtgataagtgtatactattactttaaaagcctttacagtcagtacttcagtttacaaggcactttcacagcatctcgtttgatcctcacagtcacaacatgtggtagacaaggcaggtgatttttatccccattttacagataaggaaacaggctgcgggtggggagtgaggggaggtaaagatagttagttgcctaaggtcacacagccagtaagtaatagagctgggactggaacccaggtttccttactctcatctattgctcctccatattcctcactcaaccatgaaaacattacttgaaaggactgatgaggttaaccagagacctaactgatattgtaactttctattttaaggaagaattgtgtctgtatttgagttctttggagcctccagtctgcctgtgtgttagaccagcacagcagtgctgtgtgatgcagcctgacctgtggcaggaaagtagtgcttctgtttggaagtcatgttcttttgcagccacacaggatccaaatatcagtactattcctgtagtcaatctggggtcacattataggtgccttatttccctaagggtaactgatctgaatatctgcaaataggatgaatctatttttcagaagttccatctttcatttttctttttttttttgagacagagtctcattctgtcgcccatgctggagtgcagtggcgcgatctcggctcgctgcaacctctgcctcccaggttgaagcaattctcatgcctcagccacccgagtagctgggattacaggcatgcgccatcatgcccagctaatttatgtatttttagtagagttggagtttcaccatgttggccaggctggtcttggactcctgacctcaggtcatccacccgcctcagcctcccaaagtgctggtattacaggcgtgagccaccgcacccagccccatctttcattttcaaagagaagggcattctaataggaactggtgccaagagagaagaaaagaagtgataacagaagaaatggctagttacaatattaaaaagctcctctttgagatctcctctgcaggaatatcagagacggagttgaagcgctggagaggtaataggtctagacagtacagaacaataactggggagtgtgtgaggatagactgggctcccccttgcttgaaagatctctggcatttaattctcaattcttgattactattttccagtgtaaaactagcacatatgatctgactacaggacagagaattttaagtgaaacatttgccttacttgcagtaataatgtgctgttcttcacagtagctaaggccctctatgtttcccagaggtaaataagaatccaggaatggaggtccatctgtgatgaatggcttttttctaatcaaagtagtataatgctgttttatctgttttgtcatcttgtttttttttttttttaaaaaaacaaaaccttaattataatatagcgcaaagaaaggccaggactgatgcagggattccttggaaatatcagttcctatcacttttaaaacctgattttggatctctctgttctatgtatgtctttagtgagagcacaatacatggcagaacgctgtgccaaatgttataggtaaggaatatagaaatgaatgttttttgttgtgaaggtgttttcatgtgatattttataaacacattttaaaaaatctccatcactttttagtataggaaggatagctttgcctgggaaaaacagtttcaacacacctgctcagagtagcagttctccctcaaaaaagcagtgttcagcctgcactgactgttctgcttgccaaaaggaggaagcatgcaagatacttatttctccatagattgtggagtatagagggatgtgggactacagattattattttttttccccgagacagagtcttgctctgtcgcccaggttggaacacaatggcacgacctcagctcactgcaacctctgtctcccgggttcaagcaattctcctgcttcagcctcctgagtagctgggattacaggcacacaccaccaccgcactcagctaatttttgtatttttagtagaggtggggttttaccatgttggccaggctggtcttaaactcctgaccttgtaatcatcccgcctcggcctcctaaagtgctaggattacaggcatgagccaccgcacccggcccagataatttttaatagcctttgatcatggggtgagtgagggagtaggtatacttggcaaatgcatggttctctgatttctagctctaaagcagccttatctgaatccccaaatcttgtgatgctgagtaccattactgaaccagtctgcacggtaggcatctgctaccaaaatttacctcctacctggtaggtgtcatctgataagaaagaagacaggttattttaattttttgagataatcacagaaaattgcagcccatactctttattaccgaattcaagtttggaaatagaccctttgttttaaatcatgatgggtctttatcccaatcatttatctgggtcatttttccaactttggagttctaggaaagaaccttgaaaacctgatatgattctgcagcatgaggtctacggtgaccatttgggcaaagctccagtggcaatcatttattgtgttttgcatttcctgggatttattgaaataagaattcactgtgattatgtagtcttctggctagtatcaggcagctctgcttttaatttggttaattttattttctctgaagagggagaagaggtacaatttaatcttggcctccacaagcatattaaagctcacgtgttaatcagtgcattcttatgctcctacattaaatgccttgggtaaatggataaatggacatgtgcccagctttaattttttttgcaacagaaagatcagacttccgtatggcatcgttggatttcagaggctttctggtgtatctgtaaatctgaatgttgccttctgccagtctgtataaccaggtgattcatgctgcaaatgaaatcaggaagcagtaaagtgttaaagcaagagtattgtccaattcacttgtcttcctgatccttgtactttatttcacgtgtcggtgtttacattacatacttatatttcctgtgaaagaaagagttaaataaattgtagcagtttga

SEQ ID NO: 106563 - DNA, 1930 bp, Homo sapiens
  Payload ID: 925
  Gene Symbol: ALG9
  Gene Name: ALG9, alpha-1,2-mannosyltransferase
  Uniprot ID: Q9H6U8
  ENST ID: ENST00000531154
  CDS Start-End: 474-1817
tgaacataagggggaatgaataaagccatcaaaagcaatgaccttgttaagaaaagaaagaaaaggagaatgacagctttgtggccttcaagttatctgggaacaaagcaggacaagtctgggcacctgaaggatctactgctttcaagtgtctgctttcagcaaggttatgtgctgctctcctgagcaacatctctgactgtgatgaaacattcaactactgggagccaacacactacctcatctatggggaagggtttcagacttgggaatattccccagcatatgccattcgctcctatgcttacctgttgcttcatgcctggccagctgcatttcatgcaagaattctacaaactaataagattcttgtgttttactttttgcgatgtcttctggcttttgtgagctgtatttgtgaactttacttttacaaggctgtgtgcaagaagtttgggttgcacgtgagtcgaatgatgctagccttcttggttctcagcactggcatgttttgctcatcatcagcattccttcctagtagcttctgtatgtacactacgttgatagccatgactggatggtatatggacaagacttccattgctgtgctgggagtagcagctggggctatcttaggctggccattcagtgcagctcttggtttacccattgcctttgatttgctggtcatgaaacacaggtggaagagtttctttcattggtcgctgatggccctcatactatttctggtgcctgtggtggtcattgacagctactattatgggaagttggtgattgcaccactcaacattgttttgtataatgtctttactcctcatggacctgatctttatggtacagaaccctggtatttctatttaattaatggatttctgaatttcaatgtagcctttgctttggctctcctagtcctaccactgacttctcttatggaatacctgctgcagagatttcatgttcagaatttaggccacccgtattggcttaccttggctccaatgtatatttggtttataattttcttcatccagcctcacaaagaggagagatttcttttccctgtgtatccacttatatgtctctgtggcgctgtggctctctctgcacttcagcacagttttctgtacttccagaaatgttaccactttgtgtttcaacgatatcgcctggagcactatactgtgacatcgaattggctggcattaggaactgtcttcctgtttgggctcttgtcattttctcgctctgtggcactgttcagaggatatcacgggccccttgatttgtatccagaattttaccgaattgctacagacccaaccatccacactgtcccagaaggcagacctgtgaatgtctgtgtgggaaaagagtggtatcgatttcccagcagcttccttcttcctgacaattggcagcttcagttcattccatcagagttcagaggtcagttaccaaaaccttttgcagaaggacctctggccacccggattgttcctactgacatgaatgaccagaatctagaagagccatccagatatattgatatcagtaaatgccattatttagtggatttggacaccatgagagaaacaccccgggagccaaaatattcatccaataaagaagaatggatcagcttggcctatagaccattccttgatgcttctagatcttcaaagctgctgcgggcattctatgtccccttcctgtcagatcagtatacagtgtacgtaaactacaccatcctcaaaccccggaaagcaaagcaaatcaggaagaaaagtggaggttagcaacacacctgtggccccaaaggacaaccatcttgttaactattgattccagtgacctgactccctgcaagtcatcgcctgtaacatttgtaataaaggtcttctgacatgaa

SEQ ID NO: 106564 - DNA, 526 bp, Homo sapiens
  Payload ID: 925
  Gene Symbol: ALG9
  Gene Name: ALG9, alpha-1,2-mannosyltransferase
  ENST ID: ENST00000524671
  CDS Start-End: 1-107
caaaatattcatccaataaagaagaatggatcagcttggcctatagaccattccttgatgcttctagttttgaaggctggaagaccaagatcacgatgccagtatagtcaagttctggtaaaggccatctttctggctgcagacagctgacttgtatcctcacatggctgcaagaagacaagctagctctctagcctcttcttataaggacattaatcccattgttgagtgctccactcttttgacctaattcccttccaaaggcccacctccaaataccatcacatagatcttcaaagctgctgcgggcattctatgtccccttcctgtcagatcagtatacagtgtacgtaaactacaccatcctcaaaccccggaaagcaaagcaaatcaggaagaaaagtggaggttagcaacacacctgtggccccaaaggacaaccatcttgttaactattgattccagtgacctgactccctgcaagtcatcgcctgtaacatttgtaataaaggtcttctgacatgaa

SEQ ID NO: 106565 - DNA, 385 bp, Homo sapiens
  Payload ID: 925
  Gene Symbol: ALG9
  Gene Name: ALG9, alpha-1,2-mannosyltransferase
  ENST ID: ENST00000525910
  CDS Start-End: 1-73
agaagaatggatcagcttggcctatagaccattccttgatgcttctagggtctcgctctgttgcccaggctagagtgcagtgacacaatctctgttcactgcaacctccacctcctggactcaagccatcctcccatctcagtctcccaaatcttcaaagctgctgcgggcattctatgtccccttcctgtcagatcagtatacagtgtacgtaaactacaccatcctcaaaccccggaaagcaaagcaaatcaggaagaaaagtggaggttagcaacacacctgtggccccaaaggacaaccatcttgttaactattgattccagtgacctgactccctgcaagtcatcgcctgtaacatttgtaataaaggtcttctgacatg

SEQ ID NO: 106566 - DNA, 804 bp, Homo sapiens
  Payload ID: 925
  Gene Symbol: ALG9
  Gene Name: ALG9, alpha-1,2-mannosyltransferase
  ENST ID: ENST00000612489
  CDS Start-End: 100-504
gtcttttgtccctcggcggacaccgtttgccagccaaagctatgtctgcgcgctcaccgacttcatagggtgccgaattcttttttccccaggcttgccatggctagtcgaggggctcggcagcgcctgaagggcagcggggccagcagtggggatacggccccggctgcggacaagctgcgggagctgctgggcagccgagaggcgggcggcgcggagcaccggaccgagttatctgggaacaaagcaggacaagtctgggcacctgaaggatctactgctttcaagtgtctgctttcagcaaggttatgtgctgctctcctgagcaacatctctgactgtgatgaaacattcaactactgggagccagtagacacactacctcatctatggggaagggtttcagacttgggaatattccccagcatatgccattcgctcctatgcttacctgttgcttcatgcctggccagctgcatttcatgcaagaattctacaaactaataagattcttgtgttttactttttgcgatgtcttctggcttttgtgagctgtatttgtgaactttacttttacaaggctgtgtgcaagaagtttgggttgcacgtgagtcgaatgatgctagccttcttggttctcagcactggcatgttttgctcatcatcagcattccttcctagtagcttctgtatgtacactacgttgatagccatgactggatggtatatggacaagacttccattgctgtgctgggagtagcagctggggctatcttaggctggccattcagtgcagctcttgg

SEQ ID NO: 106567 - DNA, 1373 bp, Homo sapiens
  Payload ID: 925
  Gene Symbol: ALG9
  Gene Name: ALG9, alpha-1,2-mannosyltransferase
  ENST ID: ENST00000613181
  CDS Start-End: 65-571
aaagctatgtctgcgcgctcaccgacttcatagggtgccgaattcttttttccccaggcttgccatggctagtcgaggggctcggcagcgcctgaagggcagcggggccagcagtggggatacggccccggctgcggacaagctgcgggagctgctgggcagccgagaggcgggcggcgcggagcaccggaccgagttatctgggaacaaagcaggacaagtctgggcacctgaaggatctactgctttcaagtgtctgctttcagcaaggttatgtgctgctctcctgagcaacatctctgactgtgatgaaacattcaactactgggagccaacacactacctcatctatggggaagggtttcagacttgggaatattccccagcatatgccattcgctcctatgcttacctgttgcttcatgcctggccagctgcatttcatgcaagaattctacaaactaataagggctgtgtgcaagaagtttgggttgcacgtgagtcgaatgatgctagccttcttggttctcagcactggcatgttttgctcatcatcagcattccttcctagtagcttctgtatgtacactacgttgatagccatgactggatggtatatggacaagacttccattgctgtgctgggagtagcagctggggctatcttaggctggccattcagtgcagctcttggtttacccattgcctttgatttgctggtcatgaaacacaggtggaagagtttctttcattggtcgctgatggccctcatactatttctggtgcctgtggtggtcattgacagctactattatgggaagttggtgattgcaccactcaacattgttttgtataatgtctttactcctcatggacctgatctttatggtacagaaccctggtatttctatttaattaatggatttctgaatttcaatgtagcctttgctttggctctcctagtcctaccactgacttctcttatggaatacctgctgcagagatttcatgttcagaatttaggccacccgtattggcttaccttggctccaatgtatatttggtttataattttcttcatccagcctcacaaagaggagagatttcttttccctgtgtatccacttatatgtctctgtggcgctgtggctctctctgcacttcagaaatgttaccactttgtgtttcaacgatatcgcctggagcactatactgtgacatcgaattggctggcattaggaactgtcttcctgtttgggctcttgtcattttctcgctctgtggcactgttcagaggatatcacgggccccttgatttgtatccagaattttaccgaattgctacagacccaaccatccacactgtcccagaa

SEQ ID NO: 106568 - DNA, 2020 bp, Homo sapiens
  Payload ID: 925
  Gene Symbol: ALG9
  Gene Name: ALG9, alpha-1,2-mannosyltransferase
  ENST ID: ENST00000619129
  CDS Start-End: 79-387
accgtttgccagccaaagctatgtctgcgcgctcaccgacttcatagggtgccgaattcttttttccccaggcttgccatggctagtcgaggggctcggcagcgcctgaagggcagcggggccagcagtggggatacggccccggctgcggacaagctgcgggagctgctgggcagccgagaggcgggcggcgcggagcaccggaccgaacacactacctcatctatggggaagggtttcagacttgggaatattccccagcatatgccattcgctcctatgcttacctgttgcttcatgcctggccagctgcatttcatgcaagaattctacaaactaataagattcttgtgttttactttttgcgatgtcttctggcttttgtgagctgtatttgtgaactttacttttacaaggctgtgtgcaagaagtttgggttgcacgtgagtcgaatgatgctagccttcttggttctcagcactggcatgttttgctcatcatcagcattccttcctagtagcttctgtatgtacactacgttgatagccatgactggatggtatatggacaagacttccattgctgtgctgggagtagcagctggggctatcttaggctggccattcagtgcagctcttggtttacccattgcctttgatttgctggtcatgaaacacaggtggaagagtttctttcattggtcgctgatggccctcatactatttctggtgcctgtggtggtcattgacagctactattatgggaagttggtgattgcaccactcaacattgttttgtataatgtctttactcctcatggacctgatctttatggtacagaaccctggtatttctatttaattaatggatttctgaatttcaatgtagcctttgctttggctctcctagtcctaccactgacttctcttatggaatacctgctgcagagatttcatgttcagaatttaggccacccgtattggcttaccttggctccaatgtatatttggtttataattttcttcatccagcctcacaaagaggagagatttcttttccctgtgtatccacttatatgtctctgtggcgctgtggctctctctgcacttcagaaatgttaccactttgtgtttcaacgatatcgcctggagcactatactgtgacatcgaattggctggcattaggaactgtcttcctgtttgggctcttgtcattttctcgctctgtggcactgttcagaggatatcacgggccccttgatttgtatccagaattttaccgaattgctacagacccaaccatccacactgtcccagaaggcagacctgtgaatgtctgtgtgggaaaagagtggtatcgatttcccagcagcttccttcttcctgacaattggcagcttcagttcattccatcagagttcagaggtcagttaccaaaaccttttgcagaaggacctctggccacccggattgttcctactgacatgaatgaccagaatctagaagagccatccagatatattgatatcagtaaatgccattatttagtggatttggacaccatgagagaaacaccccgggagccaaaatattcatccaataaagaagaatggatcagcttggcctatagaccattccttgatgcttctaggtctcaatttgttgcccaggctgggctcaaactcctgggctcaagcaatcctcccacctcagcctctcaaaatattgggattacaggcctgagccaccgtgcctggccattaacttctccttgactgggatcttcaaagctgctgcgggcattctatgtccccttcctgtcagatcagtatacagtgtacgtaaactacaccatcctcaaaccccggaaagcaaagcaaatcaggaagaaaagtggaggttagcaacacacctgtggccccaaaggacaaccatcttgttaactattgattccagtgacctgactccctgcaagtcatcgcctgtaacatttgtaataaaggtcttctgacatgaatac

SEQ ID NO: 106569 - DNA, 2069 bp, Homo sapiens
  Payload ID: 925
  Gene Symbol: ALG9
  Gene Name: ALG9, alpha-1,2-mannosyltransferase
  Uniprot ID: Q9H6U8
  ENST ID: ENST00000616540
  CDS Start-End: 100-1956
gtcttttgtccctcggcggacaccgtttgccagccaaagctatgtctgcgcgctcaccgacttcatagggtgccgaattcttttttccccaggcttgccatggctagtcgaggggctcggcagcgcctgaagggcagcggggccagcagtggggatacggccccggctgcggacaagctgcgggagctgctgggcagccgagaggcgggcggcgcggagcaccggaccgagttatctgggaacaaagcaggacaagtctgggcacctgaaggatctactgctttcaagtgtctgctttcagcaaggttatgtgctgctctcctgagcaacatctctgactgtgatgaaacattcaactactgggagccaacacactacctcatctatggggaagggtttcagacttgggaatattccccagcatatgccattcgctcctatgcttacctgttgcttcatgcctggccagctgcatttcatgcaagaattctacaaactaataagattcttgtgttttactttttgcgatgtcttctggcttttgtgagctgtatttgtgaactttacttttacaaggctgtgtgcaagaagtttgggttgcacgtgagtcgaatgatgctagccttcttggttctcagcactggcatgttttgctcatcatcagcattccttcctagtagcttctgtatgtacactacgttgatagccatgactggatggtatatggacaagacttccattgctgtgctgggagtagcagctggggctatcttaggctggccattcagtgcagctcttggtttacccattgcctttgatttgctggtcatgaaacacaggtggaagagtttctttcattggtcgctgatggccctcatactatttctggtgcctgtggtggtcattgacagctactattatgggaagttggtgattgcaccactcaacattgttttgtataatgtctttactcctcatggacctgatctttatggtacagaaccctggtatttctatttaattaatggatttctgaatttcaatgtagcctttgctttggctctcctagtcctaccactgacttctcttatggaatacctgctgcagagatttcatgttcagaatttaggccacccgtattggcttaccttggctccaatgtatatttggtttataattttcttcatccagcctcacaaagaggagagatttcttttccctgtgtatccacttatatgtctctgtggcgctgtggctctctctgcacttcagcacagttttctgtacttccagaaatgttaccactttgtgtttcaacgatatcgcctggagcactatactgtgacatcgaattggctggcattaggaactgtcttcctgtttgggctcttgtcattttctcgctctgtggcactgttcagaggatatcacgggccccttgatttgtatccagaattttaccgaattgctacagacccaaccatccacactgtcccagaaggcagacctgtgaatgtctgtgtgggaaaagagtggtatcgatttcccagcagcttccttcttcctgacaattggcagcttcagttcattccatcagagttcagaggtcagttaccaaaaccttttgcagaaggacctctggccacccggattgttcctactgacatgaatgaccagaatctagaagagccatccagatatattgatatcagtaaatgccattatttagtggatttggacaccatgagagaaacaccccgggagccaaaatattcatccaataaagaagaatggatcagcttggcctatagaccattccttgatgcttctagatcttcaaagctgctgcgggcattctatgtccccttcctgtcagatcagtatacagtgtacgtaaactacaccatcctcaaaccccggaaagcaaagcaaatcaggaagaaaagtggaggttagcaacacacctgtggccccaaaggacaaccatcttgttaactattgattccagtgacctgactccctgcaagtcatcgcctgtaacatttgtaataaaggtcttctgacatgaa

SEQ ID NO: 106570 - DNA, 1147 bp, Homo sapiens
  Payload ID: 925
  Gene Symbol: ALG9
  Gene Name: ALG9, alpha-1,2-mannosyltransferase
  ENST ID: ENST00000618252
  CDS Start-End: 62-658
gctatgtctgcgcgctcaccgacttcatagggtgccgaattcttttttccccaggcttgccatggctagtcgaggggctcggcagcgcctgaagggcagcggggccagcagtggggatacggccccggctgcggacaagctgcgggagctgctgggcagccgagaggcgggcggcgcggagcaccggaccgagttatctgggaacaaagcaggacaagtctgggcacctgaaggatctactgctttcaagtgtctgctttcagcaaggttatgtgctgctctcctgagcaacatctctgactgtgatgaaacattcaactactgggagccaacacactacctcatctatggggaagggtttcagacttgggaatattccccagcatatgccattcgctcctatgcttacctgttgcttcatgcctggccagctgcatttcatgcaagaattctacaaactaataagattcttgtgttttactttttgcgatgtcttctggcttttgtgagctgtatttgtgaactttacttttacaaggctgtgtgcaagaagtttgggttgcacgtgagtcgaatgatgctagccttcttggttctcagcactggcatgttttgctcatcatcagtttacccattgcctttgatttgctggtcatgaaacacaggtggaagagtttctttcattggtcgctgatggccctcatactatttctggtgcctgtggtggtcattgacagctactattatgggaagttggtgattgcaccactcaacattgttttgtataatgtctttactcctcatggacctgatctttatgggacatggatggaactgaaagccattatcctcagcaaactaacacaggagcagaaaaccaaacaccacatcttctcacttataaatgggagctgaacgatgagaacacatggacacagggaggggagcaacatacactggggcctgtggagggggcggagggagggagagagcatcaggataatagctaatgcatgctgggcttaatatctaggtgatgggttgatctgtgcagcaaaccaccatggctcaagtttacctatgtaacaaacctgcacatcctgcacatgtaccccagaacttaaaacaatttaaaaacaggaaaaaa

SEQ ID NO: 106571 - DNA, 2028 bp, Homo sapiens
  Payload ID: 925
  Gene Symbol: ALG9
  Gene Name: ALG9, alpha-1,2-mannosyltransferase
  Uniprot ID: Q9H6U8
  ENST ID: ENST00000614444
  CDS Start-End: 52-1887
cgcgctcaccgacttcatagggtgccgaattcttttttccccaggcttgccatggctagtcgaggggctcggcagcgcctgaagggcagcggggccagcagtggggatacggccccggctgcggacaagctgcgggagctgctgggcagccgagaggcgggcggcgcggagcaccggaccgagttatctgggaacaaagcaggacaagtctgggcacctgaaggatctactgctttcaagtgtctgctttcagcaaggttatgtgctgctctcctgagcaacatctctgactgtgatgaaacattcaactactgggagccaacacactacctcatctatggggaagggtttcagacttgggaatattccccagcatatgccattcgctcctatgcttacctgttgcttcatgcctggccagctgcatttcatgcaagaattctacaaactaataagattcttgtgttttactttttgcgatgtcttctggcttttgtgagctgtatttgtgaactttacttttacaaggctgtgtgcaagaagtttgggttgcacgtgagtcgaatgatgctagccttcttggttctcagcactggcatgttttgctcatcatcagcattccttcctagtagcttctgtatgtacactacgttgatagccatgactggatggtatatggacaagacttccattgctgtgctgggagtagcagctggggctatcttaggctggccattcagtgcagctcttggtttacccattgcctttgatttgctggtcatgaaacacaggtggaagagtttctttcattggtcgctgatggccctcatactatttctggtgcctgtggtggtcattgacagctactattatgggaagttggtgattgcaccactcaacattgttttgtataatgtctttactcctcatggacctgatctttatggtacagaaccctggtatttctatttaattaatggatttctgaatttcaatgtagcctttgctttggctctcctagtcctaccactgacttctcttatggaatacctgctgcagagatttcatgttcagaatttaggccacccgtattggcttaccttggctccaatgtatatttggtttataattttcttcatccagcctcacaaagaggagagatttcttttccctgtgtatccacttatatgtctctgtggcgctgtggctctctctgcacttcagaaatgttaccactttgtgtttcaacgatatcgcctggagcactatactgtgacatcgaattggctggcattaggaactgtcttcctgtttgggctcttgtcattttctcgctctgtggcactgttcagaggatatcacgggccccttgatttgtatccagaattttaccgaattgctacagacccaaccatccacactgtcccagaaggcagacctgtgaatgtctgtgtgggaaaagagtggtatcgatttcccagcagcttccttcttcctgacaattggcagcttcagttcattccatcagagttcagaggtcagttaccaaaaccttttgcagaaggacctctggccacccggattgttcctactgacatgaatgaccagaatctagaagagccatccagatatattgatatcagtaaatgccattatttagtggatttggacaccatgagagaaacaccccgggagccaaaatattcatccaataaagaagaatggatcagcttggcctatagaccattccttgatgcttctagatcttcaaagctgctgcgggcattctatgtccccttcctgtcagatcagtatacagtgtacgtaaactacaccatcctcaaaccccggaaagcaaagcaaatcaggaagaaaagtggaggttagcaacacacctgtggccccaaaggacaaccatcttgttaactattgattccagtgacctgactccctgcaagtcatcgcctgtaacatttgtaataaaggtcttctgacatgaatactggaatctgggtgctctgggctagt

SEQ ID NO: 106572 - DNA, 1445 bp, Homo sapiens
  Payload ID: 926
  Gene Symbol: ACER1
  Gene Name: alkaline ceramidase 1
  Uniprot ID: Q8TDN7
  ENST ID: ENST00000301452
  CDS Start-End: 79-873
cctcatcagggcccagccttcccaagctcgccttctctctgccgggcgcagccggctggtggtggccactgagacaagatgcctagcatcttcgcctatcagagctccgaggtggactggtgtgagagcaacttccagtactcggagctggtggccgagttctacaacacgttctccaatatccccttcttcatcttcgggccactgatgatgctcctgatgcacccgtatgcccagaagcgctcccgctacatttacgttgtctgggtcctcttcatgatcataggcctgttctccatgtatttccacatgacgctcagcttcctgggccagctgctggacgagatcgccatcctgtggctcctgggcagtggctatagcatatggatgccccgctgctatttcccctccttccttggggggaacaggtcccagttcatccgcctggtcttcatcaccactgtggtcagcacccttctgtccttcctgcggcccacggtcaacgcctacgccctcaacagcattgccctgcacattctctacatcgtgtgccaggagtacaggaagaccagcaataaggagcttcggcacctgattgaggtctccgtggttttatgggctgttgctctgaccagctggatcagtgaccgtctgctttgcagcttctggcagaggattcatttcttctatctgcacagcatctggcatgtgctcatcagcatcaccttcccttatggcatggtcaccatggccttggtggatgccaactatgagatgccaggtgaaaccctcaaagtccgctactggcctcgggacagttggcccgtggggctgccctacgtggaaatccggggtgatgacaaggactgctgagacctgccagcctcttgactatccaaccacccaacaacttgcctgtgtcttgagaagatagccccggtcaggacttgcacctgcgggacactcgtggttccttcctctgtttccccttccgtgtcctccttgtcctgcgctgccctgccttgaggcagatgatggactttgtgacatctctgagcagcagcctggtgactgtggggggctgtctcgtgcatctcccctccatgaccccccccatcctctttcatttcctcctctgtgtccacagcctcccagtgaccattgtcacatgagctggtgggactgtgtcaccaggtactggggtgactgaaggatgtggcatctaaatattagcttctaggctgggaacggtggctcacgcctataatcccagcactttgggaggccgaggtgggtggatcacctgaggtcagaagttcaagactagcctggccaacatggcaaaaccccgcctctactaaaaatacaaaaattagccgggcgtggtggtgcatgcctgtaatctcagctacttgggaggctgaggcaggagaatcgcttgaacc

SEQ ID NO: 106573 - DNA, 2238 bp, Homo sapiens
  Payload ID: 927
  Gene Symbol: ACER2
  Gene Name: alkaline ceramidase 2
  Uniprot ID: Q5QJU3
  ENST ID: ENST00000340967
  CDS Start-End: 27-854
agctgctccaatgccccggagtggccatgggcgccccgcactggtgggaccagctgcaggctggtagctcggaggtggactggtgcgaggacaactacaccatcgtgcctgctatcgccgagttctacaacacgatcagcaatgtcttatttttcattttaccgcccatctgcatgtgcttgtttcgtcagtatgcaacatgcttcaacagtggcatctacttaatctggactcttttggttgtagtgggaattggatccgtctacttccatgcaacccttagtttcttgggtcagatgcttgatgaacttgcagtcctttgggttctgatgtgtgctttggccatgtggttccccagaaggtatctaccaaagatctttcggaatgaccggggtaggttcaaggtggtggtcagtgtcctgtctgcggttacgacgtgcctggcatttgtcaagcctgccatcaacaacatctctctgatgaccctgggagttccttgcactgcactgctcatcgcagagctaaagaggtgtgacaacatgcgtgtgtttaagctgggcctcttctcgggcctctggtggaccctggccctgttctgctggatcagtgaccgagctttctgcgagctgctgtcatccttcaacttcccctacctgcactgcatgtggcacatcctcatctgccttgctgcctacctgggctgtgtatgctttgcctactttgatgctgcctcagagattcctgagcaaggccctgtcatcaagttctggcccaatgagaaatgggccttcattggtgtcccctatgtgtccctcctgtgtgccaacaagaaatcatcagtcaagatcacgtgatggcaagatggtggctggcttctctgcttatcgcccctcatgcagtgggcttcctttgctaggaagacagccaagggagttcgaatagttggggtgtgggctatcttttcaaaaatctatttgctggggctcttaatttctttagtgttctttgtatgtagggatttaaactttgtcatatggtacaaatattccctgcccccctgcagtttcccatttgtctttcagtatgttaatatttttgtgccatactggttttaaactttcatgttgtcacatctgttaatcttttctttaggatttctggattttgtgtaatttttaaaaaggtcccctcctcctccctaatgtgtctgtggaccacctggattccactgtacaaggggaaaagtgtctattcctttcccaaagatggaaaatggagggcttagggacactagatgcatctttctcagcatcacttccagatgcagtgacttgttgggctgcgtccttaatggccatggcagagcagtcccttgggggatccagccctgtacaatgcatctcttcctggagaaagctggcctgctccagaccccaccattcccaggcgcccttggagtggactctactgatgacagacagaccctctgagagacaagaccctctgactctgtgatggaagatgccagagattttcctttggggtaattgtccttaaacaaaaccaaacagatgaaacacacacaggacttgtggctaaaaaggctagtttttcacttgcatttctcaactaacccaggttttacatgcatctgtgaatccttttactactacctctgtggagagatggagagacttcagataaacgtgaagctaatgagtaaaaccctctctgccaaaacctacactccactttaggcccttcttgaagatgagcacaatttttaaatactgagcacaatttttaaatactgacatcacttcctcttccccctcccaccccagctcagcagcctcaaatctacagagaagaagaattatggcatgaacattcccacagacccaccatctttaagacttgacctctgtaagtttaccaaagggctcctcacaattgtggtgggggttctggttcaaaatttggagcaaacatgaagtttttggaaacgttttctcatttgaagcctccagtatgctgtactattctggaaattaccttcaagagtctcacttcttgtttctgttgtgttttctgtgggcatcatgttcttcacgcttgcagtagaaggtgctttctcggtttcccagagtatccaacggctcacctttctcaagtgctggcagtagctatgcactcacgggctggtttgggtcgctggtgcagcagcgcaaatctgtt

SEQ ID NO: 106574 - DNA, 3500 bp, Homo sapiens
  Payload ID: 928
  Gene Symbol: ACER3
  Gene Name: alkaline ceramidase 3
  ENST ID: ENST00000278544
  CDS Start-End: 28-258
cgcctgggcggcggcggcggcggcgtgatggctccggccgcggaccgagagggctactggggccccacgacctccacgctggactggtgcgaggagaactactccgtgacctggtacatcgccgagttctggaatacagtgagtaacctgatcatgattatacctccaatgttcggtgcagttcagagtgttagagacggtctggaaaagcggtacattgcttcttatttagcactcacagaagtacttcagatttgagaaaagagcacataactatggctaaaagatgggatttgtaatctctggagttttttacttcaagtctgaggatccaaactgactaagtgaagtaaagaaataagcagctattggatgaactcccaatgatatacagctgttgcatatttgtgtactgcatgtttgaatgtttcaagatcaagaactcagtaaactaccatctgctttttaccttagttctattcagtttaatagtaaccacagtttaccttaaggtaaaagagccgatattccatcaggtcatgtatggaatgttggtctttacattagtacttcgatctatttatattgttacatgggtttatccatggcttagaggactgggttatacatcattgggtatatttttattgggatttttattttggaatatagataacatattttgtgagtcactgaggaactttcgaaagaaggtaccacctatcataggtattaccacacaatttcatgcatggtggcatattttaactggccttggttcctatcttcacatccttttcagtttgtatacaagaacactttacctgagatataggccaaaagtgaagtttctctttggaatctggccagtgatcctgtttgagcctctcaggaagcattgatgaatcattccaccaagaaaacaaacaagcacctaccatagacctggcagaataaataaggaaatccttaaagatctacaagttcaaatatgtcatgaccatcacagcagaggagtgactttctgactaatgctgccacccacacagagaataaggagtagggcctgctgggtgtttagctcatggctttatcttatttgtccccctcctcctttcacgctccagtttataaagaaacagagatgatgtgtgtgtatgcctcaaatgcagaaacagttgggcttttcttaacaggttaacagtttgtgctggttataagaaattaaccttcttttctttttgccaagggttgcatgtgaattatacctttcttaatatttgattaaataatgcagtcagctaagagccaacaaaaccccatatccagatagttagctgtgagccagcactcagctgtgtcagatttgattaatattgtattaatctcatggatggttctcaaaggtaaaaaaagagagagaaagagagagagctagctgtgggattctgtgtagttcttcactatctgttccagggctagtcggaggatcataagcaagctcagacctgcccccagttcagtacttgaccacatcccaggatttatggtgtctgtctatggccacagccaaccagaatgagtgggtcatcttataacctttctgaagctccatgaggacatgtatagaatgctgcaccttcagccagctctgctctgatctttgcagatctttaagttgtcactgtttctacggctagacaaatatgactggtggtctagactacccatagttcatcctcctcacataacttatttgaagttgtcagggaatgtcattacactctgatttttaaaattatgcagtattttccagttctcagagaggtcatggttgtgcccagggaagtgtgttgcattaactaaagctaaaattatcagaatcctatttacataaagcatattaaaatatctgctccttaattttctgaaggaaatagatgtaagtttctgctacttgaaacctacagaaccgacaaaaattagggtgctaaaaaaatgacagtgaaatctcatcgtaaggcagctagttctaatttgcatttgaatgtataacaaattgcatcacttttcacaaacttaacacctgcctggagtaaaaatctgatttgacccctctgctcatgtttcatcatatttgtagctctgcatcatttagcatttttatgactttttttgctttatataaattattgtaaaatccagattgtttttaccacatgatgacgtgactcaggattaaatcctgagctacagtttcaaaaggaaaatcatttttttcttatgcaaagatggtaaaacactgttgtcattttttccagtattcaataagtagcctttgtacaaatttaaaaccaaaaactattctgttgtttttcttcacctactagccttagtttttaaccaagtatccaaggatgtcaacttgacatccttcccttagcatgccaacaagccattagactgattcttccacctatttttatgaacctccaggaagaaaaacacttgccaaaacattaagagaactttgattctgccttaagagggtataaaactaaaccatttgaaggcacagcccataagactatacttgattttgccccaagattctgacttctggctacatttcacctgcagttacctgggctatcggccgtgatacattttttaattcatttgttttccaccattatatttttatacttttcagttagatatacttctgcataaagagtatatatacagtgtaggataaaggcatatcgtacatggcaatgctgttaaacatggtaagactgaggttctgcaggattaaagtcagattaagggtacagaaagcacaccttgatactgaggccatttagagcaatttgtttaatgagtggttcagccatcaccaccagtggccacctgttcaataaaattgcctagcaccacagtggagagtcatctacaccccaaggtgagctgtaagactggccaattctttgaagacctttttttctgttgggagaatggaaagcagaaagggaagccaggctctttaatgttccaagtcagctgtgcctcacacaaggctctctttttagctactaagtaacatactcaagactttgtatctgtgcagcattttatggaaatcactggtgacctataggatattactaaattatttcaatagctttatttttttcctacttggattctaggtggacattacagagttgaattcctcactaccccctcccgctgtcatttgttttattggaaaacttcatgttaactagagtgtacaaaaagtctgtttcctgctgagccaatagtgatttgtttgcatatcacctaatgtgaaaagtgctcatctgtgaactctacagcaaattatattttagaaaatactttgtgaggccgggcatggtggcagagcgagactccgtctcaaaaaaaaaaaaaaaaaaaaaaaagaaaagaaaagaaaatataaggatgtaaaagaa

SEQ ID NO: 106575 - DNA, 1269 bp, Homo sapiens
  Payload ID: 928
  Gene Symbol: ACER3
  Gene Name: alkaline ceramidase 3
  ENST ID: ENST00000526597
  CDS Start-End: 378-896
agtgagcggagcgcctgggcggcggcggcggcggcgtgatggctccggccgcggaccgagagggctactggggccccacgacctccacgctggactggtgcgaggagaactactccgtgacctgggaatacagtgagtaacctgatcatgattatacctccaatgttcggtgcagttcagagtgttagagacggtctggaaaagcggtacattgcttcttatttagcactcacagaagtacttcagatttgagaaaagagcacataactatggctaaaagatgggatttgtaatctctggagttttttacttcaagtctgaggatccaaactgactaagtgaagtaaagaaataagcagctattggatgaactcccaatgatatacagctgttgcatatttgtgtactgcatgtttgaatgtttcaagatcaagaactcagtaaactaccatctgctttttaccttagttctattcagtttaatagtaaccacagtttaccttaaggtaaaagagccgatattccatcaggtcatgtatggaatgttggtctttacattagtacttcgatctatttatattgttacatgggtttatccatggcttagaggactgggttatacatcattgggtatatttttattgggatttttattttggaatatagataacatattttgtgagtcactgaggaactttcgaaagaaggtaccacctatcataggtattaccacacaatttcatgcatggtggcatattttaactggccttggttcctatcttcacatccttttcagtttgtatacaagaacactttacctgagatataggccaaaagtgaagtttctctttggaatctggccagtgatcctgtttgagcctctcaggaagcattgatgaatcattccaccaagaaaacaaacaagcacctaccatagacctggcagaataaataaggaaatccttaaagatctacaagttcaaatatgtcatgaccatcacagcagaggagtgactttctgactaatgctgccacccacacagagaataaggagtagggcctgctgggtgtttagctcatggctttatcttatttgtccccctcctcctttcacgctccagtttataaagaaacagagatgatgtgtgtgtatgcctcaaatgcagaaacagttgggcttttcttaacaggttaacagtttgtgctggttataagaaattaaccttcttttctttttgccaagggttgcatgtgaattatacctttctt

SEQ ID NO: 106576 - DNA, 2093 bp, Homo sapiens
  Payload ID: 928
  Gene Symbol: ACER3
  Gene Name: alkaline ceramidase 3
  ENST ID: ENST00000531352
  CDS Start-End: 35-190
agcggagcgcctgggcggcggcggcggcggcgtgatggctccggccgcggaccgagagggctactggggccccacgacctccacgctggactggtgcgaggagaactactccgtgacctggtacatcgccgagttctgttccttcctaccatcctccctgaagagcaacctcaaggaatacagtgagtaacctgatcatgattatacctccaatgttcggtgcagttcagagtgttagagacggtctggaaaagcggtacattgcttcttatttagcactcacagtggtaggaatgggatcctggtgcttccacatgactctgaaatatgaaatgcagctattggatgaactcccaatgatatacagctgttgcatatttgtgtactgcatgtttgaatgtttcaagatcaagaactcagtaaactaccatctgctttttaccttagttctattcagtttaatagtaaccacagtttaccttaaggtaaaagagccgatattccatcaggtcatgtatggaatgttggtctttacattagtacttcgatctatttatattgttacatgggtttatccatggcttagaggactgggttatacatcattgggtatatttttattgggatttttattttggaatatagataacatattttgtgagtcactgaggaactttcgaaagaaggtaccacctatcataggtattaccacacaatttcatgcatggtggcatattttaactggccttggttcctatcttcacatccttttcagtttgtatacaagaacactttacctgagatataggccaaaagtgaagtttctctttggaatctggccagtgatcctgtttgagcctctcaggaagcattgatgaatcattccaccaagaaaacaaacaagcacctaccatagacctggcagaataaataaggaaatccttaaagatctacaagttcaaatatgtcatgaccatcacagcagaggagtgactttctgactaatgctgccacccacacagagaataaggagtagggcctgctgggtgtttagctcatggctttatcttatttgtccccctcctcctttcacgctccagtttataaagaaacagagatgatgtgtgtgtatgcctcaaatgcagaaacagttgggcttttcttaacaggttaacagtttgtgctggttataagaaattaaccttcttttctttttgccaagggttgcatgtgaattatacctttcttaatatttgattaaataatgcagtcagctaagagccaacaaaaccccatatccagatagttagctgtgagccagcactcagctgtgtcagatttgattaatattgtattaatctcatggatggttctcaaaggtaaaaaaagagagagaaagagagagagctagctgtgggattctgtgtagttcttcactatctgttccagggctagtcggaggatcataagcaagctcagacctgcccccagttcagtacttgaccacatcccaggatttatggtgtctgtctatggccacagccaaccagaatgagtgggtcatcttataacctttctgaagctccatgaggacatgtatagaatgctgcaccttcagccagctctgctctgatctttgcagatctttaagttgtcactgtttctacggctagacaaatatgactggtggtctagactacccatagttcatcctcctcacataacttatttgaagttgtcagggaatgtcattacactctgatttttaaaattatgcagtattttccagttctcagagaggtcatggttgtgcccagggaagtgtgttgcattaactaaagctaaaattatcagaatcctatttacataaagcatattaaaatatctgctccttaattttctgaaggaaatagatgtaagtttctgctacttgaaacctacagaaccgacaaaaattagggtgctaaaaaaatgacagtgaaatctcatcgtaaggcagctagttctaatttgcatttgaatgtataacaaattgcatcacttttcacaaacttaacacctgcctggagtaaaaatctgatttgacccctctg

SEQ ID NO: 106577 - DNA, 846 bp, Homo sapiens
  Payload ID: 928
  Gene Symbol: ACER3
  Gene Name: alkaline ceramidase 3
  ENST ID: ENST00000525194
  CDS Start-End: 54-209
agcctaacccggcacagtgagcggagcgcctgggcggcggcggcggcggcgtgatggctccggccgcggaccgagagggctactggggccccacgacctccacgctggactggtgcgaggagaactactccgtgacctggtacatcgccgagttctgttccttcctaccatcctccctgaagagcaacctcaaggaatacagtgagtaacctgatcatgattatacctccaatgttcggtgcagttcagagtgttagagacggtctggaaaagcggtacattgcttcttatttagcactcacagaagtacttcagatttgagaaaagagcacataactatggctaaaagatgggatttgtaatctctggagttttttacttcaagtctgaggatccaaactgactaagtgaagtaaagaaataagcagctattggatgaactcccaatgatatacagctgttgcatatttgtgtactgcatgtttgaatgtttcaagatcaagaactcagtaaactaccatctgctttttaccttagttctattcagtttaatagtaaccacagtttaccttaaggtaaaagagccgatattccatcaggagtctcactctgtcaccccggctgaagtgcaatggcacaatctcggctcattggaacctccacctcccaggtcatgtatggaatgttggtctttacattagtacttcgatctatttatattgttacatgggtttatccatggcttagaggactgggttatacatcattgggtatatttttattgggatttttattttggaatatagataacatattttgtgagtcactgaggaactttcgaaagaa

SEQ ID NO: 106578 - DNA, 2058 bp, Homo sapiens
  Payload ID: 928
  Gene Symbol: ACER3
  Gene Name: alkaline ceramidase 3
  ENST ID: ENST00000525861
  CDS Start-End: 43-285
gcacagtgagcggagcgcctgggcggcggcggcggcggcgtgatggctccggccgcggaccgagagggctactggggccccacgacctccacgctggactggtgcgaggagaactactccgtgacctggtacatcgccgagttctggaatacagtgagtaacctgatcatgattatacctccaatgttcggtgcagttcagagtgttagagacggtctggaaaagcggtacattgcttcttatttagcactcacagatggagtctcactctgtcgccgaggctgaagtgcagtggcacaatctcggctcactgcaacctccatttcccaggtttacgcgatccttctgcctcagcctcccaagtagctgggactacagtggtaggaatgggatcctggtgcttccacatgactctgaaatatgaaatgcagctattggatgaactcccaatgatatacagctgttgcatatttgtgtactgcatgtttgaatgtttcaagatcaagaactcagtaaactaccatctgctttttaccttagttctattcagtttaatagtaaccacagtttaccttaaggtaaaagagccgatattccatcaggagtctcactctgtcaccccggctgaagtgcaatggcacaatctcggctcattggaacctccacctcccaggtcatgtatggaatgttggtctttacattagtacttcgatctatttatattgttacatgggtttatccatggcttagaggactgggttatacatcattgggtatatttttattgggatttttattttggaatatagataacatattttgtgagtcactgaggaactttcgaaagaaggtaccacctatcataggtattaccacacaatttcatgcatggtggcatattttaactggccttggttcctatcttcacatccttttcagtttgtatacaagaacactttacctgagatataggccaaaagtgaagtttctctttggaatctggccagtgatcctgtttgagcctctcaggaagcattgatgaatcattccaccaagaaaacaaacaagcacctaccatagacctggcagaataaataaggaaatccttaaagatctacaagttcaaatatgtcatgaccatcacagcagaggagtgactttctgactaatgctgccacccacacagagaataaggagtagggcctgctgggtgtttagctcatggctttatcttatttgtccccctcctcctttcacgctccagtttataaagaaacagagatgatgtgtgtgtatgcctcaaatgcagaaacagttgggcttttcttaacaggttaacagtttgtgctggttataagaaattaaccttcttttctttttgccaagggttgcatgtgaattatacctttcttaatatttgattaaataatgcagtcagctaagagccaacaaaaccccatatccagatagttagctgtgagccagcactcagctgtgtcagatttgattaatattgtattaatctcatggatggttctcaaaggtaaaaaaagagagagaaagagagagagctagctgtgggattctgtgtagttcttcactatctgttccagggctagtcggaggatcataagcaagctcagacctgcccccagttcagtacttgaccacatcccaggatttatggtgtctgtctatggccacagccaaccagaatgagtgggtcatcttataacctttctgaagctccatgaggacatgtatagaatgctgcaccttcagccagctctgctctgatctttgcagatctttaagttgtcactgtttctacggctagacaaatatgactggtggtctagactacccatagttcatcctcctcacataacttatttgaagttgtcagggaatgtcattacactctgatttttaaaattatgcagtattttccagttctcagagaggtcatggttgtgcccagggaagtgtgttgcattaactaaagctaaaattatcagaatcctatttacataaagcatattaaaatatctgctcctt

SEQ ID NO: 106579 - DNA, 1292 bp, Homo sapiens
  Payload ID: 928
  Gene Symbol: ACER3
  Gene Name: alkaline ceramidase 3
  ENST ID: ENST00000531461
  CDS Start-End: 42-266
cacagtgagcggagcgcctgggcggcggcggcggcggcgtgatggctccggccgcggaccgagagggctactggggccccacgacctccacgctggactggtgcgaggagaactactccgtgacctggtacatcgccgagttctggaatacagtgagtaacctgatcatgattatacctccaatgttcggtgcagttcagagtgttagagacggtctggaaaagcggtacattgcttcttatttagcactcacagctattggatgaactcccaatgatatacagctgttgcatatttgtgtactgcatgtttgaatgtttcaagatcaagaactcagtaaactaccatctgctttttaccttagttctattcagtttaatagtaaccacagtttaccttaaggtaaaagagccgatattccatcaggtcatgtatggaatgttggtctttacattagtacttcgatctatttatattgttacatgggtttatccatggcttagaggactgggttatacatcattgggtatatttttattgggatttttattttggaatatagataacatattttgtgagtcactgaggaactttcgaaagaaggtaccacctatcataggtattaccacacaatttcatgcatggtggcatattttaactggccttggttcctatcttcacatccttttcagtttgtatacaagaacactttacctgagatataggccaaaagtgaagtttctctttggaatctggccagtgatcctgtttgagcctctcaggaagcattgatgaatcattccaccaagaaaacaaacaagcacctaccatagacctggcagaataaataaggaaatccttaaagatctacaagttcaaatatgtcatgaccatcacagcagaggagtgactttctgactaatgctgccacccacacagagaataaggagtagggcctgctgggtgtttagctcatggctttatcttatttgtccccctcctcctttcacgctccagtttataaagaaacagagatgatgtgtgtgtatgcctcaaatgcagaaacagttgggcttttcttaacaggttaacagtttgtgctggttataagaaattaaccttcttttctttttgccaagggttgcatgtgaattatacctttcttaatatttgattaaataatgcagtcagctaagagccaacaaaaccccatatccagatagttagctgtgagccagcactcagctgtgtcagatttgattaatattgtattaatctcatggatggttctc

SEQ ID NO: 106580 - DNA, 7378 bp, Homo sapiens
  Payload ID: 928
  Gene Symbol: ACER3
  Gene Name: alkaline ceramidase 3
  Uniprot ID: Q9NUN7
  ENST ID: ENST00000532485
  CDS Start-End: 105-908
gggcggggcgcgagcgagcgcgcgggctgggccggagccggcctggtcgccagcctaacccggcacagtgagcggagcgcctgggcggcggcggcggcggcgtgatggctccggccgcggaccgagagggctactggggccccacgacctccacgctggactggtgcgaggagaactactccgtgacctggtacatcgccgagttctggaatacagtgagtaacctgatcatgattatacctccaatgttcggtgcagttcagagtgttagagacggtctggaaaagcggtacattgcttcttatttagcactcacagtggtaggaatgggatcctggtgcttccacatgactctgaaatatgaaatgcagctattggatgaactcccaatgatatacagctgttgcatatttgtgtactgcatgtttgaatgtttcaagatcaagaactcagtaaactaccatctgctttttaccttagttctattcagtttaatagtaaccacagtttaccttaaggtaaaagagccgatattccatcaggtcatgtatggaatgttggtctttacattagtacttcgatctatttatattgttacatgggtttatccatggcttagaggactgggttatacatcattgggtatatttttattgggatttttattttggaatatagataacatattttgtgagtcactgaggaactttcgaaagaaggtaccacctatcataggtattaccacacaatttcatgcatggtggcatattttaactggccttggttcctatcttcacatccttttcagtttgtatacaagaacactttacctgagatataggccaaaagtgaagtttctctttggaatctggccagtgatcctgtttgagcctctcaggaagcattgatgaatcattccaccaagaaaacaaacaagcacctaccatagacctggcagaataaataaggaaatccttaaagatctacaagttcaaatatgtcatgaccatcacagcagaggagtgactttctgactaatgctgccacccacacagagaataaggagtagggcctgctgggtgtttagctcatggctttatcttatttgtccccctcctcctttcacgctccagtttataaagaaacagagatgatgtgtgtgtatgcctcaaatgcagaaacagttgggcttttcttaacaggttaacagtttgtgctggttataagaaattaaccttcttttctttttgccaagggttgcatgtgaattatacctttcttaatatttgattaaataatgcagtcagctaagagccaacaaaaccccatatccagatagttagctgtgagccagcactcagctgtgtcagatttgattaatattgtattaatctcatggatggttctcaaaggtaaaaaaagagagagaaagagagagagctagctgtgggattctgtgtagttcttcactatctgttccagggctagtcggaggatcataagcaagctcagacctgcccccagttcagtacttgaccacatcccaggatttatggtgtctgtctatggccacagccaaccagaatgagtgggtcatcttataacctttctgaagctccatgaggacatgtatagaatgctgcaccttcagccagctctgctctgatctttgcagatctttaagttgtcactgtttctacggctagacaaatatgactggtggtctagactacccatagttcatcctcctcacataacttatttgaagttgtcagggaatgtcattacactctgatttttaaaattatgcagtattttccagttctcagagaggtcatggttgtgcccagggaagtgtgttgcattaactaaagctaaaattatcagaatcctatttacataaagcatattaaaatatctgctccttaattttctgaaggaaatagatgtaagtttctgctacttgaaacctacagaaccgacaaaaattagggtgctaaaaaaatgacagtgaaatctcatcgtaaggcagctagttctaatttgcatttgaatgtataacaaattgcatcacttttcacaaacttaacacctgcctggagtaaaaatctgatttgacccctctgctcatgtttcatcatatttgtagctctgcatcatttagcatttttatgactttttttgctttatataaattattgtaaaatccagattgtttttaccacatgatgacgtgactcaggattaaatcctgagctacagtttcaaaaggaaaatcatttttttcttatgcaaagatggtaaaacactgttgtcattttttccagtattcaataagtagcctttgtacaaatttaaaaccaaaaactattctgttgtttttcttcacctactagccttagtttttaaccaagtatccaaggatgtcaacttgacatccttcccttagcatgccaacaagccattagactgattcttccacctatttttatgaacctccaggaagaaaaacacttgccaaaacattaagagaactttgattctgccttaagagggtataaaactaaaccatttgaaggcacagcccataagactatacttgattttgccccaagattctgacttctggctacatttcacctgcagttacctgggctatcggccgtgatacattttttaattcatttgttttccaccattatatttttatacttttcagttagatatacttctgcataaagagtatatatacagtgtaggataaaggcatatcgtacatggcaatgctgttaaacatggtaagactgaggttctgcaggattaaagtcagattaagggtacagaaagcacaccttgatactgaggccatttagagcaatttgtttaatgagtggttcagccatcaccaccagtggccacctgttcaataaaattgcctagcaccacagtggagagtcatctacaccccaaggtgagctgtaagactggccaattctttgaagacctttttttctgttgggagaatggaaagcagaaagggaagccaggctctttaatgttccaagtcagctgtgcctcacacaaggctctctttttagctactaagtaacatactcaagactttgtatctgtgcagcattttatggaaatcactggtgacctataggatattactaaattatttcaatagctttatttttttcctacttggattctaggtggacattacagagttgaattcctcactaccccctcccgctgtcatttgttttattggaaaacttcatgttaactagagtgtacaaaaagtctgtttcctgctgagccaatagtgatttgtttgcatatcacctaatgtgaaaagtgctcatctgtgaactctacagcaaattatattttagaaaatactttgtgaggccgggcatggtggcagagcgagactccgtctcaaaaaaaaaaaaaaaaaaaaaaaagaaaagaaaagaaaatataaggatgtaaaagaagcaatttgcttgcacatctgaatatccttcttgtgcctccattttcactcttgaaaactgaaagcaatttgacttttatttttgtttttctaaagaacagctaggtgaaaggaggttaagctgattgtcactctgcctgcccactacctactccccaccatggtgtttcatgaaacatccccaccacctgaagtgatctttttaatccttgtgatagtaaatgcattgataattaacaggaaaaacatgtttttaaataatctacaaatgagaacccaaatagtagtgttttgtttgacagaagtaaatcaaatattatggtttaaatataatgcaaaatttcaggacagttaatttggacttcccttaccctaagagggtttttcttataataaggagaagaggtgtggttcaaagaaaattaagagacaaaaccttcaggtacataatgcatgaaaatctttaaatgcctgcaaaaattaagttctgttataataccagccaattctgaattagccaatgccctaaaagcatctaacaatttaaggttatcttatgagtcctatgaaaacaattatttgttgctaaatttgagttttagctaccaacgccatgtttacgtgacaagaaattgttttggccctgtggtttatgacgtgctgctggataagcatttatgtaaaactgagtatttcaaagagaaccatttacaattggaatttccacctgtgtggctgtttgcagacctacctctgtcttccattttgcatcctgtcagtgctataattagtttgatcactttgtcttgtttttcagtgtctacaattatagcttattcactatgttctaactatttaaaaataatgggccgggcgcggtggctcatgcctgtaatcccagcactttgggaggccgaggtgagcagatcacaaggtcaggagatcgagaccatcctggctaacacagtgaaaccccgtctctactaaaaatacaaaaaaattagtcgggcatggtggcgggcgcctgtagtcccagctactcgggaggctgaggcaggagaatggcgtgaacctgggaggcagagcttgcagtgagccaagattgtgccactgcactccagcctgggcaacagagcgagactctgtctcaaaaaaaaaaaaaaaaaaaaaaaaaaaagactaaaatttgatttaaagtagttaaacccctttatggaaggagctgcaaaatgaaaaaaaaaaaaaaaaggaatcatgtcatcttgacccagctgactggaaattttcaatactgtcttttaactgttgtactccagccagcctgggcaacagagtgagaccctgtctcaaaaaaaaaaaaaaaaaaaaaaaaaaaaagaattaggaaatacttgttaaaatatctaactacgtaattgctacatgggggagctgctggtgttgttgaggtccttgggagcattccactggacttcaccatttctccaaaattatcagcccagtcagcttcatatacccagatatggacacttctacacgtgaaattcaaactgaagataaaactctgactttggagtataaacttttgccttgagtatgaaaccttgacattgctgaaagaaaagtggaaactgtaagggacaacaagtttcaccaaggcacagtcttctctgataggccagcagagcagctaaggagaagacagatcattcaagaacttaagtcgtttgttagctacagcatttccattgctgtgatacacattcagccattttggaggaaagctaagcaggttctgaccacccattttcatgtactttaaataacaaatattatttctcaaggtcttcattttatcattaaattcagctaattactacctgatttcaaaggcagctagtgtagaagactggtcacaagaatttttttttaaatagaaaaccctaaaatgcaaatcaagaaattcagttacaggctgcaagtgacctaaaattcccctactctagctcagcagccatcagtcagtatagcatcagccacaggtcactgctctgcatacagttccttttcaacccttacaagacctgcttcattgctttaaaaatgtagtgttgatacttgaactgaatttagtcattggtaacttaaatattcacaaaattgtcataaagcttctgaaacatctggcaatgccagatctgtaatcatcacttttaaattgaatttgcagaattaactctaaagttgcagcaaccatatttattagagaaatctttaagcatatacatatggttccctataagcattcattcagagatcatctgtgcctaaaagaaaatgataaaaatgtgtcataatatcaaaggggtctagatcaggggttggtaaactacaacccatgggccaaattcaggctgcgttgtatggcctgcaaggtaagaatggttattttattttattttattctttatatatatatatatatatttatttatttttttgagacagagtctctctctgtcacccacgctggagtgcagtggcaggatctcaactcattgcaacctccgcctcccaaggttcaagcgattctcctgcctcagcctcccgagtagctgggactacaggcacatgccaccatgccaccatgcctggctgatttttgtatttttagtagagctgggttggccaggctggtcttgaactcctgacctcaagtgattcacctgccttggcctcccaaagtcctggaattacaggcgtgagctaccgtgcccagctggtttttacattttaaaaacgtttagagaaagaagaatatgcaacagaaactgtatgtagcctgcaaagcctaaaatgtttactctctggcttgggagtttgtctcccctgctctagactgtcagcaagtggtacagtggtacagtacagtggtactgcccaactgcacttctctgcaaggtgattctagtgtgcacttgtcagaatgaaaatatgttattcatttaagacatctcatgtctttgaatgtaatcacatgatttgtatttaatatttacatgacctaattattttttcacgtcagtttttctagattggcaatagcctgttgcaaagtgcctaaacctttgagaaaaattactatgagcaaggtccatgatttagttttcaatataaagggaattccattctatactgtaaaatccaaaaatgctagttgccctcagcttttgagttgacttccagaaagttgagatcttttgaccattttttctcatgtcatataaaatgtgccacatggtagttgtcaagctgtggtagtcatgtacactttttttcttttttttaactttctaaaaggaaaagttcaaagtcctttccacagttagtcttcgcttcttttggatttttctttttagagctaaattattcataccaatgaataagtgagtctgttctaagatataggggccattatctatttttgcttaatggactcatgtggcattgttcactatcatgcctttccatacttgtaatatttctgagtcacttattaatgtgaccaacagataaactgttcaagctaatacagcatttcctaacttcatagttgtcgcagatgtttgttctagtagcgattatttaataaacatacattgtactgaatcttactagcaactaactattttcaggtaatctcagtctgcttattcactttttccatttgatttgctaatgccacaatcatttttctagaaaatagtaggataatgtattttttcctgtctgctataatggagactatatttctgcattcattacctctcataggtgaaaatattaaattaaataatattgttttgaataaga

SEQ ID NO: 106581 - DNA, 931 bp, Homo sapiens
  Payload ID: 928
  Gene Symbol: ACER3
  Gene Name: alkaline ceramidase 3
  ENST ID: ENST00000530334
  CDS Start-End: 41-256
acagtgagcggagcgcctgggcggcggcggcggcggcgtgatggctccggccgcggaccgagagggctactggggccccacgacctccacgctggactggtgcgaggagaactactccgtgacctggtacatcgccgagttctgttccttcctaccatcctccctgaagagcaacctcaagttagtgagcacacatcaggcttcttttttggtcttgggactctgggctggcagaggtgacatccctgtcatatgaaggaagatgctcctttctctgaaggttattgacagggaatacagtgagtaacctgatcatgattatacctccaatgttcggtgcagttcagagtgttagagacggtctggaaaagcggtacattgcttcttatttagcactcacagtggtaggaatgggatcctggtgcttccacatgactctgaaatatgaaatgcagctattggatgaactcccaatgatatacagctgttgcatatttgtgtactgcatgtttgaatgtttcaagatcaagaactcagtaaactaccatctgctttttaccttagttctattcagtttaatagtaaccacagtttaccttaaggtaaaagagccgatattccatcaggtcatgtatggaatgttggtctttacattagtacttcgatctatttatattgttacatgggtttatccatggcttagaggactgggttatacatcattgggtatatttttattgggatttttattttggaatatagataacatattttgtgagtcactgaggtaagatatattttcattccttcagaaatatttttggaagcattttattaagtagagaattttataaacatatagaaatagtagtgccctgaaatgaatttttactattgttgacatttaaaagatatatacagtataataaag

SEQ ID NO: 106582 - DNA, 834 bp, Homo sapiens
  Payload ID: 928
  Gene Symbol: ACER3
  Gene Name: alkaline ceramidase 3
  ENST ID: ENST00000534206
  CDS Start-End: 220-834
agggccgggcggggcgcgagcgagcgcgcgggctgggccggagccggcctggtcgccagcctaacccggcacagtgagcggagcgcctgggcggcggcggcggcggcgtgatggctccggccgcggaccgagagggctactggggccccacgacctccacgctggactggtgcgaggagaactactccgtgacctgggaatacagtgagtaacctgatcatgattatacctccaatgttcggtgcagttcagagtgttagagacggtctggaaaagcggtacattgcttcttatttagcactcacagtggtaggaatgggatcctggtgcttccacatgactctgaaatatgaaatgcagctattggatgaactcccaatgatatacagctgttgcatatttgtgtactgcatgtttgaatgtttcaagatcaagaactcagtaaactaccatctgctttttaccttagttctattcagtttaatagtaaccacagtttaccttaaggtaaaagagccgatattccatcaggtcatgtatggaatgttggtctttacattagtacttcgatctatttatattgttacatgggtttatccatggcttagaggactgggttatacatcattgggtatatttttattgggatttttattttggaatatagataacatattttgtgagtcactgaggaactttcgaaagaaggtaccacctatcataggtattaccacacaatttcatgcatggtggcatattttaactggccttggttcctatcttcacatccttttcagtttgtatacaagaacactttacctgagatataggcca

SEQ ID NO: 106583 - DNA, 929 bp, Homo sapiens
  Payload ID: 928
  Gene Symbol: ACER3
  Gene Name: alkaline ceramidase 3
  ENST ID: ENST00000533873
  CDS Start-End: 36-728
gagcggagcgcctgggcggcggcggcggcggcgtgatggctccggccgcggaccgagagggctactggggccccacgacctccacgctggactggtgcgaggagaactactccgtgacctggtacatcgccgagttcttggtaggaatgggatcctggtgcttccacatgactctgaaatatgaaatgcagctattggatgaactcccaatgatatacagctgttgcatatttgtgtactgcatgtttgaatgtttcaagatcaagaactcagtaaactaccatctgctttttaccttagttctattcagtttaatagtaaccacagtttaccttaaggtaaaagagccgatattccatcaggtcatgtatggaatgttggtctttacattagtacttcgatctatttatattgttacatgggtttatccatggcttagaggactgggttatacatcattgggtatatttttattgggatttttattttggaatatagataacatattttgtgagtcactgaggaactttcgaaagaaggtaccacctatcataggtattaccacacaatttcatgcatggtggcatattttaactggccttggttcctatcttcacatccttttcagtttgtatacaagaacactttacctgagatataggccaaaagtgaagtttctctttggaatctggccagtgatcctgtttgagcctctcaggaagcattgatgaatcattccaccaagaaaacaaacaagcacctaccatagacctggcagaataaataaggaaatccttaaagatctacaagttcaaatatgtcatgaccatcacagcagaggagtgactttctgactaatgctgccacccacacagagaataaggagtagggcctgctgggtgtttagctcatggctttatcttatttgt

SEQ ID NO: 106584 - DNA, 2550 bp, Homo sapiens
  Payload ID: 929
  Gene Symbol: ALPI
  Gene Name: alkaline phosphatase, intestinal
  Uniprot ID: P09923
  ENST ID: ENST00000295463
  CDS Start-End: 78-1664
gatttaaacccaggcagcctgcgctgcagccggttcctggtgtccccacttcgcctccctcctgctgcccccaagacatgcaggggccctgggtgctgctgctgctgggcctgaggctacagctctccctgggcgtcatcccagctgaggaggagaacccggccttctggaaccgccaggcagctgaggccctggatgctgccaagaagctgcagcccatccagaaggtcgccaagaacctcatcctcttcctgggcgatgggttgggggtgcccacggtgacagccaccaggatcctaaaggggcagaagaatggcaaactggggcctgagacgcccctggccatggaccgcttcccatacctggctctgtccaagacatacaatgtggacagacaggtgccagacagcgcagccacagccacggcctacctgtgcggggtcaaggccaacttccagaccatcggcttgagtgcagccgcccgctttaaccagtgcaacacgacacgcggcaatgaggtcatctccgtgatgaaccgggccaagcaagcaggaaagtcagtaggagtggtgaccaccacacgggtgcagcacgcctcgccagccggcacctacgcacacacagtgaaccgcaactggtactcagatgctgacatgcctgcctcagcccgccaggaggggtgccaggacatcgccactcagctcatctccaacatggacattgacgtgatccttggcggaggccgcaagtacatgtttcccatggggaccccagaccctgagtacccagctgatgccagccagaatggaatcaggctggacgggaagaacctggtgcaggaatggctggcaaagcaccagggtgcctggtatgtgtggaaccgcactgagctcatgcaggcgtccctggaccagtctgtgacccatctcatgggcctctttgagcccggagacacgaaatatgagatccaccgagaccccacactggacccctccctgatggagatgacagaggctgccctgcgcctgctgagcaggaacccccgcggcttctacctctttgtggagggcggccgcatcgaccatggtcatcatgagggtgtggcttaccaggcactcactgaggcggtcatgttcgacgacgccattgagagggcgggccagctcaccagcgaggaggacacgctgaccctcgtcaccgctgaccactcccatgtcttctcctttggtggctacaccttgcgagggagctccatcttcgggttggcccccagcaaggctcaggacagcaaagcctacacgtccatcctgtacggcaatggcccgggctacgtgttcaactcaggcgtgcgaccagacgtgaatgagagcgagagcgggagccccgattaccagcagcaggcggcggtgcccctgtcgtccgagacccacggaggcgaagacgtggcggtgtttgcgcgcggcccgcaggcgcacctggtgcatggtgtgcaggagcagagcttcgtagcgcatgtcatggccttcgctgcctgtctggagccctacacggcctgcgacctggcgcctcccgcctgcaccaccgacgccgcgcacccagttgccgcgtcgctgccactgctggccgggaccctgctgctgctgggggcgtccgctgctccctgagtgccccactccggagttatcctgctccccacctccgggcgtcctgccctgttccccgtcctgagccgccacttccagcgaacacacacaggtgtcctgccgttggaccttcacctcctagagataaaccagcctcagctggcgcagcggggcccttcttccctccgcatccccttcagggagcaggagcccagggcgccctgggagctgagcctgggacttccaggacctcccctcaggttgttctctgattcttcctcccaaccccagagactgcagatttgtgccatgcggctgcctgcaccccagacaataaagggaccaaaaccacccaacccccaccctgcctctatcctaaggaagaccaagcaggcctggacccagagacgtcccccatcgtgggacacgacacacccagaccgcgtgccccaccgtcttagcttcaatcctggcagcacctggtagacccaaggacttgggtggatcaggacacctgaagaagagaagcttccggcaaccctgcaacccacccaaggaggctactggatcggggattcccaggggggctttgacacagtcctctgctgtctccccactaggatcattccacacccctgcacctgaccaagggaccaatgaggcagaggcttgccccaagtcacagccactcagatgcttcctgccccccagtgcccattccaggtcaccagatccaaggagcgcttgaggagctctgggtacagggcagcaacccagagcccatgggccctcccgggacatctggatgctgggcatagatttctcaacaaggaagactcccctgcctcctcaaggtctccattctcctaggagacaaagcaataataaaaggtgttagacaatgtaa

SEQ ID NO: 106585 - DNA, 1882 bp, Homo sapiens
  Payload ID: 929
  Gene Symbol: ALPI
  Gene Name: alkaline phosphatase, intestinal
  ENST ID: ENST00000457560
  CDS Start-End: 76-228
tttaaacccaggcagcctgcgctgcagccggttcctggtgtccccacttcgcctccctcctgctgcccccaagacatgcaggggccctgggtgctgctgctgctgggcctgaggctacagctctccctgggcgtcatcccaggtaatgaggctccccaagctgttccacacacagggcaccccctcagccaggctgacctgatctctactctccccctggccagctgaggaggagaacccggccttctggaaccgccaggcagctgaggccctggatgctgccaagaagctgcagcccatccagaaggtcgccaagaacctcatcctcttcctgggcgatgggttgggggtgcccacggtgacagccaccaggatcctaaaggggcagaagaatggcaaactggggcctgagacgcccctggccatggaccgcttcccatacctggctctgtccaagacatacaatgtggacagacaggtgccagacagcgcagccacagccacggcctacctgtgcggggtcaaggccaacttccagaccatcggcttgagtgcagccgcccgctttaaccagtgcaacacgacacgcggcaatgaggtcatctccgtgatgaaccgggccaagcaagcaggaaagtcagtaggagtggtgaccaccacacgggtgcagcacgcctcgccagccggcacctacgcacacacagtgaaccgcaactggtactcagatgctgacatgcctgcctcagcccgccaggaggggtgccaggacatcgccactcagctcatctccaacatggacattgacgtgatccttggcggaggccgcaagtacatgtttcccatggggaccccagaccctgagtacccagctgatgccagccagaatggaatcaggctggacgggaagaacctggtgcaggaatggctggcaaagcaccagggtgcctggtatgtgtggaaccgcactgagctcatgcaggcgtccctggaccagtctgtgacccatctcatgggcctctttgagcccggagacacgaaatatgagatccaccgagaccccacactggacccctccctgatggagatgacagaggctgccctgcgcctgctgagcaggaacccccgcggcttctacctctttgtggagggcggccgcatcgaccatggtcatcatgagggtgtggcttaccaggcactcactgaggcggtcatgttcgacgacgccattgagagggcgggccagctcaccagcgaggaggacacgctgaccctcgtcaccgctgaccactcccatgtcttctcctttggtggctacaccttgcgagggagctccatcttcgggttggcccccagcaaggctcaggacagcaaagcctacacgtccatcctgtacggcaatggcccgggctacgtgttcaactcaggcgtgcgaccagacgtgaatgagagcgagagcgggagccccgattaccagcagcaggcggcggtgcccctgtcgtccgagacccacggaggcgaagacgtggcggtgtttgcgcgcggcccgcaggcgcacctggtgcatggtgtgcaggagcagagcttcgtagcgcatgtcatggccttcgctgcctgtctggagccctacacggcctgcgacctggcgcctcccgcctgcaccaccgacgccgcgcacccagttgccgcgtcgctgccactgctggccgggaccctgctgctgctgggggcgtccgctgctccctgagtgccccactccggagttatcctgctccccacctccgggcgtcctgccctgttccccgtcctgagccgccacttccagcgaacacacacaggtgtcctgccgttggaccttcacctcctagagataaaccagcctcag

SEQ ID NO: 106586 - DNA, 733 bp, Homo sapiens
  Payload ID: 930
  Gene Symbol: ALPL
  Gene Name: alkaline phosphatase, liver/bone/kidney
  ENST ID: ENST00000374830
  CDS Start-End: 1-650
agcactcccacttcatctggaaccgcacggaactcctgacccttgacccccacaatgtggactacctattgggaggcagaattgaccacgggcaccatgaaggaaaagccaagcaggccctgcatgaggcggtggagatggaccgggccatcgggcaggcaggcagcttgacctcctcggaagacactctgaccgtggtcactgcggaccattcccacgtcttcacatttggtggatacaccccccgtggcaactctatctttggtctggcccccatgctgagtgacacagacaagaagcccttcactgccatcctgtatggcaatgggcctggctacaaggtggtgggcggtgaacgagagaatgtctccatggtggactatgctcacaacaactaccaggcgcagtctgctgtgcccctgcgccacgagacccacggcggggaggacgtggccgtcttctccaagggccccatggcgcacctgctgcacggcgtccacgagcagaactacgtcccccacgtgatggcgtatgcagcctgcatcggggccaacctcggccactgtgctcctgccagctcggcaggcagccttgctgcaggccccctgctgctcgcgctggccctctaccccctgagcgtcctgttctgagggcccagggcccgggcacccacaagcccgtgacagatgccaacttcccacacggcagcccccccctcaaggggcagggaggt

SEQ ID NO: 106587 - DNA, 2193 bp, Homo sapiens
  Payload ID: 930
  Gene Symbol: ALPL
  Gene Name: alkaline phosphatase, liver/bone/kidney
  Uniprot ID: P05186
  ENST ID: ENST00000374832
  CDS Start-End: 255-1829
agaaactcccggtgtggcagctgagatggcccaggaaagaactatattaccttcaaaaagagaggtacatgcgatgtttgaggtggcatgaagctcagtggtgttatattggaatgagtgagtgaccatcctggagccttcctgaaagaggattggaacatcagttaacatctgaccactgccagcccaccccctcccacccacgtcgattgcatctctgggctccagggataaagcaggtcttggggtgcaccatgatttcaccattcttagtactggccattggcacctgccttactaactccttagtgccagagaaagagaaagaccccaagtactggcgagaccaagcgcaagagacactgaaatatgccctggagcttcagaagctcaacaccaacgtggctaagaatgtcatcatgttcctgggagatgggatgggtgtctccacagtgacggctgcccgcatcctcaagggtcagctccaccacaaccctggggaggagaccaggctggagatggacaagttccccttcgtggccctctccaagacgtacaacaccaatgcccaggtccctgacagtgccggcaccgccaccgcctacctgtgtggggtgaaggccaatgagggcaccgtgggggtaagcgcagccactgagcgttcccggtgcaacaccacccaggggaacgaggtcacctccatcctgcgctgggccaaggacgctgggaaatctgtgggcattgtgaccaccacgagagtgaaccatgccacccccagcgccgcctacgcccactcggctgaccgggactggtactcagacaacgagatgccccctgaggccttgagccagggctgtaaggacatcgcctaccagctcatgcataacatcagggacattgacgtgatcatggggggtggccggaaatacatgtaccccaagaataaaactgatgtggagtatgagagtgacgagaaagccaggggcacgaggctggacggcctggacctcgttgacacctggaagagcttcaaaccgagatacaagcactcccacttcatctggaaccgcacggaactcctgacccttgacccccacaatgtggactacctattgggtctcttcgagccaggggacatgcagtacgagctgaacaggaacaacgtgacggacccgtcactctccgagatggtggtggtggccatccagatcctgcggaagaaccccaaaggcttcttcttgctggtggaaggaggcagaattgaccacgggcaccatgaaggaaaagccaagcaggccctgcatgaggcggtggagatggaccgggccatcgggcaggcaggcagcttgacctcctcggaagacactctgaccgtggtcactgcggaccattcccacgtcttcacatttggtggatacaccccccgtggcaactctatctttggtctggcccccatgctgagtgacacagacaagaagcccttcactgccatcctgtatggcaatgggcctggctacaaggtggtgggcggtgaacgagagaatgtctccatggtggactatgctcacaacaactaccaggcgcagtctgctgtgcccctgcgccacgagacccacggcggggaggacgtggccgtcttctccaagggccccatggcgcacctgctgcacggcgtccacgagcagaactacgtcccccacgtgatggcgtatgcagcctgcatcggggccaacctcggccactgtgctcctgccagctcggcaggcagccttgctgcaggccccctgctgctcgcgctggccctctaccccctgagcgtcctgttctgagggcccagggcccgggcacccacaagcccgtgacagatgccaacttcccacacggcagcccccccctcaaggggcagggaggtgggggcctcctcagcctctgcaactgcaagaaaggggacccaagaaaccaaagtctgccgcccacctcgctcccctctggaatcttccccaagggccaaacccacttctggcctccagcctttgctccctccccgctgccctttggccaacagggtagatttctcttgggcaggcagagagtacagactgcagacattctcaaagcctcttatttttctagcgaacgtatttctccagacccagaggccctgaagcctccgtggaacattctggatctgac

SEQ ID NO: 106588 - DNA, 2589 bp, Homo sapiens
  Payload ID: 930
  Gene Symbol: ALPL
  Gene Name: alkaline phosphatase, liver/bone/kidney
  Uniprot ID: P05186
  ENST ID: ENST00000374840
  CDS Start-End: 251-1825
tcactcgggccccgcggccgcctttataaggcggcgggggtggtggcccgggccgcgttgcgctcccgccactccgcgcccgctatcctggctccgtgctcccacgcgcttgtgcctggacggaccctcgccagtgctctgcgcaggattggaacatcagttaacatctgaccactgccagcccaccccctcccacccacgtcgattgcatctctgggctccagggataaagcaggtcttggggtgcaccatgatttcaccattcttagtactggccattggcacctgccttactaactccttagtgccagagaaagagaaagaccccaagtactggcgagaccaagcgcaagagacactgaaatatgccctggagcttcagaagctcaacaccaacgtggctaagaatgtcatcatgttcctgggagatgggatgggtgtctccacagtgacggctgcccgcatcctcaagggtcagctccaccacaaccctggggaggagaccaggctggagatggacaagttccccttcgtggccctctccaagacgtacaacaccaatgcccaggtccctgacagtgccggcaccgccaccgcctacctgtgtggggtgaaggccaatgagggcaccgtgggggtaagcgcagccactgagcgttcccggtgcaacaccacccaggggaacgaggtcacctccatcctgcgctgggccaaggacgctgggaaatctgtgggcattgtgaccaccacgagagtgaaccatgccacccccagcgccgcctacgcccactcggctgaccgggactggtactcagacaacgagatgccccctgaggccttgagccagggctgtaaggacatcgcctaccagctcatgcataacatcagggacattgacgtgatcatggggggtggccggaaatacatgtaccccaagaataaaactgatgtggagtatgagagtgacgagaaagccaggggcacgaggctggacggcctggacctcgttgacacctggaagagcttcaaaccgagatacaagcactcccacttcatctggaaccgcacggaactcctgacccttgacccccacaatgtggactacctattgggtctcttcgagccaggggacatgcagtacgagctgaacaggaacaacgtgacggacccgtcactctccgagatggtggtggtggccatccagatcctgcggaagaaccccaaaggcttcttcttgctggtggaaggaggcagaattgaccacgggcaccatgaaggaaaagccaagcaggccctgcatgaggcggtggagatggaccgggccatcgggcaggcaggcagcttgacctcctcggaagacactctgaccgtggtcactgcggaccattcccacgtcttcacatttggtggatacaccccccgtggcaactctatctttggtctggcccccatgctgagtgacacagacaagaagcccttcactgccatcctgtatggcaatgggcctggctacaaggtggtgggcggtgaacgagagaatgtctccatggtggactatgctcacaacaactaccaggcgcagtctgctgtgcccctgcgccacgagacccacggcggggaggacgtggccgtcttctccaagggccccatggcgcacctgctgcacggcgtccacgagcagaactacgtcccccacgtgatggcgtatgcagcctgcatcggggccaacctcggccactgtgctcctgccagctcggcaggcagccttgctgcaggccccctgctgctcgcgctggccctctaccccctgagcgtcctgttctgagggcccagggcccgggcacccacaagcccgtgacagatgccaacttcccacacggcagcccccccctcaaggggcagggaggtgggggcctcctcagcctctgcaactgcaagaaaggggacccaagaaaccaaagtctgccgcccacctcgctcccctctggaatcttccccaagggccaaacccacttctggcctccagcctttgctccctccccgctgccctttggccaacagggtagatttctcttgggcaggcagagagtacagactgcagacattctcaaagcctcttatttttctagcgaacgtatttctccagacccagaggccctgaagcctccgtggaacattctggatctgaccctcccagtctcatctcctgaccctcccactcccatctccttacctctggaaccccccaggccctacaatgctcatgtccctgtccccaggcccagccctccttcaggggagttgaggtctttctcctcaggacaaggccttgctcactcactcactccaagaccaccagggtcccaggaagccggtgcctgggtggccatcctacccagcgtggcccaggccgggaagagccacctggcagggctcacactcctgggctctgaacacacacgccagctcctctctgaagcgactctcctgtttggaacggcaaaaaaaaatttttttttctctttttggtggtggttaaaagggaacacaaaacatttaaataaaactttccaaatatttccgaggaca

SEQ ID NO: 106589 - DNA, 2241 bp, Homo sapiens
  Payload ID: 930
  Gene Symbol: ALPL
  Gene Name: alkaline phosphatase, liver/bone/kidney
  Uniprot ID: P05186
  ENST ID: ENST00000539907
  CDS Start-End: 147-1490
gcgttgcgctcccgccactccgcgcccgctatcctggctccgtgctcccacgcgcttgtgcctggacggaccctcgccagtgctctgcgcagagaaagagaaagaccccaagtactggcgagaccaagcgcaagagacactgaaatatgccctggagcttcagaagctcaacaccaacgtggctaagaatgtcatcatgttcctgggagatgacgtacaacaccaatgcccaggtccctgacagtgccggcaccgccaccgcctacctgtgtggggtgaaggccaatgagggcaccgtgggggtaagcgcagccactgagcgttcccggtgcaacaccacccaggggaacgaggtcacctccatcctgcgctgggccaaggacgctgggaaatctgtgggcattgtgaccaccacgagagtgaaccatgccacccccagcgccgcctacgcccactcggctgaccgggactggtactcagacaacgagatgccccctgaggccttgagccagggctgtaaggacatcgcctaccagctcatgcataacatcagggacattgacgtgatcatggggggtggccggaaatacatgtaccccaagaataaaactgatgtggagtatgagagtgacgagaaagccaggggcacgaggctggacggcctggacctcgttgacacctggaagagcttcaaaccgagatacaagcactcccacttcatctggaaccgcacggaactcctgacccttgacccccacaatgtggactacctattgggtctcttcgagccaggggacatgcagtacgagctgaacaggaacaacgtgacggacccgtcactctccgagatggtggtggtggccatccagatcctgcggaagaaccccaaaggcttcttcttgctggtggaaggaggcagaattgaccacgggcaccatgaaggaaaagccaagcaggccctgcatgaggcggtggagatggaccgggccatcgggcaggcaggcagcttgacctcctcggaagacactctgaccgtggtcactgcggaccattcccacgtcttcacatttggtggatacaccccccgtggcaactctatctttggtctggcccccatgctgagtgacacagacaagaagcccttcactgccatcctgtatggcaatgggcctggctacaaggtggtgggcggtgaacgagagaatgtctccatggtggactatgctcacaacaactaccaggcgcagtctgctgtgcccctgcgccacgagacccacggcggggaggacgtggccgtcttctccaagggccccatggcgcacctgctgcacggcgtccacgagcagaactacgtcccccacgtgatggcgtatgcagcctgcatcggggccaacctcggccactgtgctcctgccagctcggcaggcagccttgctgcaggccccctgctgctcgcgctggccctctaccccctgagcgtcctgttctgagggcccagggcccgggcacccacaagcccgtgacagatgccaacttcccacacggcagcccccccctcaaggggcagggaggtgggggcctcctcagcctctgcaactgcaagaaaggggacccaagaaaccaaagtctgccgcccacctcgctcccctctggaatcttccccaagggccaaacccacttctggcctccagcctttgctccctccccgctgccctttggccaacagggtagatttctcttgggcaggcagagagtacagactgcagacattctcaaagcctcttatttttctagcgaacgtatttctccagacccagaggccctgaagcctccgtggaacattctggatctgaccctcccagtctcatctcctgaccctcccactcccatctccttacctctggaaccccccaggccctacaatgctcatgtccctgtccccaggcccagccctccttcaggggagttgaggtctttctcctcaggacaaggccttgctcactcactcactccaagaccaccagggtcccaggaagccggtgcctgggtggccatcctacccagcgtggcccaggccgggaagagccacctggcagggctcacactcctgggctctgaacacacacgccagctcctctctgaagcgactctcctgtttggaacggcaaaaaaaaatttttttttctctttttggtggtggttaaaagggaacacaaaacatttaaataaaactttccaaat

SEQ ID NO: 106590 - DNA, 2131 bp, Homo sapiens
  Payload ID: 930
  Gene Symbol: ALPL
  Gene Name: alkaline phosphatase, liver/bone/kidney
  Uniprot ID: P05186
  ENST ID: ENST00000540617
  CDS Start-End: 195-1604
gttgcgctcccgccactccgcgcccgctatcctggctccgtgctcccacgcgcttgtgcctggacggaccctcgccagtgctctgcgcagagaaagagaaagaccccaagtactggcgagaccaagcgcaagagacactgaaatatgccctggagcttcagaagctcaacaccaacgtggctaagaatgtcatcatgttcctgggagatgggatgggtgtctccacagtgacggctgcccgcatcctcaagggtcagctccaccacaaccctggggaggagaccaggctggagatggacaagttccccttcgtggccctctccaagacgtacaacaccaatgcccaggtccctgacagtgccggcaccgccaccgcctacctgtgtggggtgaaggccaatgagggcaccgtgggggtaagcgcagccactgagcgttcccggtgcaacaccacccaggggaacgaggtcacctccatcctgcgctgggccaaggacgctgggaaatctgtgggcattgtgaccaccacgagagtgaaccatgccacccccagcgccgcctacgcccactcggctgaccgggactggtactcagacaacgagatgccccctgaggccttgagccagggctgtaaggacatcgcctaccagctcatgcataacatcagggacattgacgtgatcatggggggtggccggaaatacatgtaccccaagaataaaactgatgtggagtatgagagtgacgagaaagccaggggcacgaggctggacggcctggacctcgttgacacctggaagagcttcaaaccgagatacaagcactcccacttcatctggaaccgcacggaactcctgacccttgacccccacaatgtggactacctattgggtctcttcgagccaggggacatgcagtacgagctgaacaggaacaacgtgacggacccgtcactctccgagatggtggtggtggccatccagatcctgcggaagaaccccaaaggcttcttcttgctggtggaaggaggcagaattgaccacgggcaccatgaaggaaaagccaagcaggccctgcatgaggcggtggagatggaccgggccatcgggcaggcaggcagcttgacctcctcggaagacactctgaccgtggtcactgcggaccattcccacgtcttcacatttggtggatacaccccccgtggcaactctatctttggtctggcccccatgctgagtgacacagacaagaagcccttcactgccatcctgtatggcaatgggcctggctacaaggtggtgggcggtgaacgagagaatgtctccatggtggactatgctcacaacaactaccaggcgcagtctgctgtgcccctgcgccacgagacccacggcggggaggacgtggccgtcttctccaagggccccatggcgcacctgctgcacggcgtccacgagcagaactacgtcccccacgtgatggcgtatgcagcctgcatcggggccaacctcggccactgtgctcctgccagctcggcaggcagccttgctgcaggccccctgctgctcgcgctggccctctaccccctgagcgtcctgttctgagggcccagggcccgggcacccacaagcccgtgacagatgccaacttcccacacggcagcccccccctcaaggggcagggaggtgggggcctcctcagcctctgcaactgcaagaaaggggacccaagaaaccaaagtctgccgcccacctcgctcccctctggaatcttccccaagggccaaacccacttctggcctccagcctttgctccctccccgctgccctttggccaacagggtagatttctcttgggcaggcagagagtacagactgcagacattctcaaagcctcttatttttctagcgaacgtatttctccagacccagaggccctgaagcctccgtggaacattctggatctgaccctcccagtctcatctcctgaccctcccactcccatctccttacctctggaaccccccaggccctacaatgctcatgtccctgtccccaggcccagccctccttcaggggagttgaggtctttctcctcaggacaaggccttgctcactcactcactccaaga

SEQ ID NO: 106591 - DNA, 2971 bp, Homo sapiens
  Payload ID: 931
  Gene Symbol: ALPP
  Gene Name: alkaline phosphatase, placental
  Uniprot ID: P05187
  ENST ID: ENST00000392027
  CDS Start-End: 270-1877
aataccgcacccttccctgggggacacctggtcccaacctgagctgcctttctcaggaccccagccccagcccggcccagcccagccacaccctgccactcccttcagccagtgtggcttcaggtcaagaggctgggcagggtcaaggtggcaacgaggggagaagccgggacacagttctccctgatttaaacccgggcagcctggagtgcagctcatactccatgcccagaattcctgcctcgccactgtcctgctgccctccagacatgctggggccctgcatgctgctgctgctgctgctgctgggcctgaggctacagctctccctgggcatcatcccagttgaggaggagaacccggacttctggaaccgcgaggcagccgaggccctgggtgccgccaagaagctgcagcctgcacagacagccgccaagaacctcatcatcttcctgggcgatgggatgggggtgtctacggtgacagctgccaggatcctaaaagggcagaagaaggacaaactggggcctgagatacccctggccatggaccgcttcccatatgtggctctgtccaagacatacaatgtagacaaacatgtgccagacagtggagccacagccacggcctacctgtgcggggtcaagggcaacttccagaccattggcttgagtgcagccgcccgctttaaccagtgcaacacgacacgcggcaacgaggtcatctccgtgatgaatcgggccaagaaagcagggaagtcagtgggagtggtaaccaccacacgagtgcagcacgcctcgccagccggcacctacgcccacacggtgaaccgcaactggtactcggacgccgacgtgcctgcctccgcccgccaggaggggtgccaggacatcgctacgcagctcatctccaacatggacattgacgtgatcctaggtggaggccgaaagtacatgtttcgcatgggaaccccagaccctgagtacccagatgactacagccaaggtgggaccaggctggacgggaagaatctggtgcaggaatggctggcgaagcgccagggtgcccggtatgtgtggaaccgcactgagctcatgcaggcttccctggacccgtctgtgacccatctcatgggtctctttgagcctggagacatgaaatacgagatccaccgagactccacactggacccctccctgatggagatgacagaggctgccctgcgcctgctgagcaggaacccccgcggcttcttcctcttcgtggagggtggtcgcatcgaccatggtcatcatgaaagcagggcttaccgggcactgactgagacgatcatgttcgacgacgccattgagagggcgggccagctcaccagcgaggaggacacgctgagcctcgtcactgccgaccactcccacgtcttctccttcggaggctaccccctgcgagggagctccatcttcgggctggcccctggcaaggcccgggacaggaaggcctacacggtcctcctatacggaaacggtccaggctatgtgctcaaggacggcgcccggccggatgttaccgagagcgagagcgggagccccgagtatcggcagcagtcagcagtgcccctggacgaagagacccacgcaggcgaggacgtggcggtgttcgcgcgcggcccgcaggcgcacctggttcacggcgtgcaggagcagaccttcatagcgcacgtcatggccttcgccgcctgcctggagccctacaccgcctgcgacctggcgccccccgccggcaccaccgacgccgcgcacccggggcggtccgtggtccccgcgttgcttcctctgctggccgggaccctgctgctgctggagacggccactgctccctgagtgtcccgtccctggggctcctgcttccccatcccggagttctcctgctccccacctcctgtcgtcctgcctggcctccagcccgagtcgtcatccccggagtccctatacagaggtcctgccatggaaccttcccctccccgtgcgctctggggactgagcccatgacaccaaacctgccccttggctgctctcggactccctaccccaaccccagggactgcaggttgtgccctgtggctgcctgcaccccaggaaaggagggggctcaggccatccagccaccacctacagcccagtgggtaccaggcaggctcccttcctggggaaaagaagcacccagaccccgcgccccgctgatctttgcttcagtccttgaatcacctgtgggacttgaggactcgggatcttcaggacgcctggagaagggtggtttcctgccaccctgctggccaaggaggctcctggggtggggatcaccagggggattttgacacagccttcggctgccccccactaagctaattccacacccctgtacccccccagggggccctctgcctcatggcaaaggcttgccccaaatctcaacttctcagacgttccatacccccacatgccaatttcagcacccaactgagatccgaggagctcctgggaagccctgggtgcaggacactggtcgagagccaaaggtccctccccagacatctggacactgggcatagatttctcaagaaggaagactcccctgcctccccagggcctctgctctcctgggagacaaagcaataataaaaggaagtgtttgtaatcccagcactttgggaggccgaggtgggcggatcacgaggtcaggagatggagaccatcctggctaacacggtgaaaccccttatctatgcgcctgtagtcccagctacccaggaggctgaagcaggataatcgcttgaacccgggcggcggagattgcagtgagccgaggtcatgccactgcactgcagcctgggcgacagagcgagattctgcctcaaaaataaacaaataaattttaaaaataaataaataataaaaggaagtgttagacaatgtaa

SEQ ID NO: 106592 - DNA, 2493 bp, Homo sapiens
  Payload ID: 932
  Gene Symbol: ALPPL2
  Gene Name: alkaline phosphatase, placental-like 2
  Uniprot ID: P10696
  ENST ID: ENST00000295453
  CDS Start-End: 53-1651
catactccatacctgggatttccgcctcgccgctctccgactgcttccagacatgcaggggccctgggtgctgctcctgctgggcctgaggctacagctctccctgggcatcatcccagttgaggaggagaacccggacttctggaaccgccaggcagccgaggccctgggtgccgccaagaagctgcagcctgcacagacagccgccaagaacctcatcatcttcctgggtgacgggatgggggtgtctacggtgacagctgccaggatcctaaaagggcagaagaaggacaaactggggcctgagaccttcctggccatggaccgcttcccgtacgtggctctgtccaagacatacagtgtagacaagcatgtgccagacagtggagccacagccacggcctacctgtgcggggtcaagggcaacttccagaccattggcttgagtgcagccgcccgctttaaccagtgcaacacgacacgcggcaacgaggtcatctccgtgatgaatcgggccaagaaagcaggaaagtcagtgggagtggtaaccaccacacgggtgcagcatgcctcgccagccggcgcctacgcccacacggtgaaccgcaactggtactcggatgccgacgtgcctgcctcggcccgccaggaggggtgccaggacatcgccacgcagctcatctccaacatggacattgatgtgatcctaggtggaggccgaaagtacatgtttcccatggggaccccagaccctgagtacccagatgactacagccaaggtgggaccaggctggacgggaagaatctggtgcaggaatggctggcgaagcaccagggtgcccggtacgtgtggaaccgcactgagctcctgcaggcttccctggacccgtctgtgacccatctcatgggtctctttgagcctggagacatgaaatacgagatccaccgagactccacactggacccctccctgatggagatgacagaggctgccctgctcctgctgagcaggaacccccgcggcttcttcctcttcgtggagggtggtcgcatcgaccatggtcatcatgaaagcagggcttaccgggcactgactgagacgatcatgttcgacgacgccattgagagggcgggccagctcaccagcgaggaggacacgctgagcctcgtcactgccgaccactcccacgtcttctccttcggaggctaccccctgcgagggagctccatcttcgggctggcccctggcaaggcccgggacaggaaggcctacacggtcctcctatacggaaacggtccaggctatgtgctcaaggacggcgcccggccggatgttacggagagcgagagcgggagccccgagtatcggcagcagtcagcagtgcccctggacggagagacccacgcaggcgaggacgtggcggtgttcgcgcgcggcccgcaggcgcacctggttcacggcgtgcaggagcagaccttcatagcgcacgtcatggccttcgccgcctgcctggagccctacaccgcctgcgacctggcgccccgcgccggcaccaccgacgccgcgcacccggggccgtccgtggtccccgcgttgcttcctctgctggcagggaccttgctgctgctggggacggccactgctccctgagtgtcccgtccctggggctcctgcttccccatcccggagttcccctgctccccacctccagtcgtcctgccggacctccacctggagctgtcacccccggagtcgccacacagacgtcctgccatggaaccttcccctcccggtgcaccctggggaccgagcccttgacaccacgccctttgctttatcttgctcttgaaattttggccccaactccagggactggggatttgtgcctggcagctgcctgcatttcaggaaaagaggaggctcagaccatccagcccccgcccatatcctgaggtggatcaggcaggctctctccccggggacatgaggcacccatacctaggaccccctgcgccttttttagcttcagtcatggcagcacctgagggacacaaggacttgggtgcatcaggacgccttggagaagcgtggcttcctgccaccctgcaacccaccctcccagccaaggaggctgctgtggtggggatccccaggggggctttgacacagtcctctgctgtccctccactgggctaattctacacccctgtgcccctcctaggggcccatgagtcagagaggcttgccccaagtcacagccactcagatgttcgacgccccctaaggtccattccagcacccacctgagttccgaggagcacctgggaagctctgggtgcaggatagcagtccagagtccatggccccgcctaggccatctgggtgctgggcatggatttctcagcaaggaagactcattaccttccctccctgggcctccattcttctgggaaacacaaagcaataataaaaggaagtgttagacaatgtaa

SEQ ID NO: 106593 - DNA, 1596 bp, Homo sapiens
  Payload ID: 932
  Gene Symbol: ALPPL2
  Gene Name: alkaline phosphatase, placental-like 2
  ENST ID: ENST00000611550
  CDS Start-End: 1-1596
atgcaggggccctgggtgctgctcctgctgggcctgaggctacagctctccctgggcatcatcccagttgaggaggagaacccggacttctggaaccgccaggcagccgaggccctgggtgccgccaagaagctgcagcctgcacagacagccgccaagaacctcatcatcttcctgggtgacgggatgggggtgtctacggtgacagctgccaggatcctaaaagggcagaagaaggacaaactggggcctgagaccttcctggccatggaccgcttcccgtacgtggctctgtccaagacatacagtgtagacaagcatgtgccagacagtggagccacagccacggcctacctgtgcggggtcaagggcaacttccagaccattggcttgagtgcagccgcccgctttaaccagtgcaacacgacacgcggcaacgaggtcatctccgtgatgaatcgggccaagaaagcaggaaagtcagtgggagtggtaaccaccacacgggtgcagcatgcctcgccagccggcgcctacgcccacacggtgaaccgcaactggtactcggatgccgacgtgcctgcctcggcccgccaggaggggtgccaggacatcgccacgcagctcatctccaacatggacattgatgtgatcctaggtggaggccgaaagtacatgtttcccatggggaccccagaccctgagtacccagatgactacagccaaggtgggaccaggctggacgggaagaatctggtgcaggaatggctggcgaagcaccagggtgcccggtacgtgtggaaccgcactgagctcctgcaggcttccctggacccgtctgtgacccatctcatgggtctctttgagcctggagacatgaaatacgagatccaccgagactccacactggacccctccctgatggagatgacagaggctgccctgctcctgctgagcaggaacccccgcggcttcttcctcttcgtggagggtggtcgcatcgaccatggtcatcatgaaagcagggcttaccgggcactgactgagacgatcatgttcgacgacgccattgagagggcgggccagctcaccagcgaggaggacacgctgagcctcgtcactgccgaccactcccacgtcttctccttcggaggctaccccctgcgagggagctccatcttcgggctggcccctggcaaggcccgggacaggaaggcctacacggtcctcctatacggaaacggtccaggctatgtgctcaaggacggcgcccggccggatgttacggagagcgagagcgggagccccgagtatcggcagcagtcagcagtgcccctgacggagacccacgcaggcgaggacgtggcggtgttcgcgcgcggcccgcaggcgcacctggttcacggcgtgcaggagcagaccttcatagcgcacgtcatggccttcgccgcctgcctggagccctacaccgcctgcgacctggcgccccgcgccggcaccaccgacgccgcgcacccggggccgtccgtggtccccgcgttgcttcctctgctggcagggaccttgctgctgctggggacggccactgctccctga

SEQ ID NO: 106594 - DNA, 2594 bp, Homo sapiens
  Payload ID: 933
  Gene Symbol: ALKBH1
  Gene Name: alkB homolog 1, histone H2A dioxygenase
  Uniprot ID: Q13686
  ENST ID: ENST00000216489
  CDS Start-End: 17-1186
gggtataggccgcgagatggggaagatggcagcggccgtgggctctgtggcgactctggcgactgagcccggggaggacgcctttcggaaacttttccgcttctaccgtcagagccggcccgggaccgcagacctggaaggggtcatcgacttctcggcggcccacgcagcccgtggcaagggtcctggtgcccaaaaggtgatcaaatctcagctaaatgtgtcttctgtcagtgagcagaatgcatatagagcaggtcttcagcccgtcagcaagtggcaagcctatggactcaaaggctatcctgggtttatttttatcccaaaccccttcctcccaggttaccagtggcactgggtgaaacagtgccttaagttatattcccagaaacctaatgtatgtaacctggacaaacacatgtctaaagaagagacccaagatctgtgggaacagagcaaagagttcctgaggtataaagaagcgactaaacggagaccccgaagtttactggagaaactgcgttgggtgaccgtaggctaccattataactgggacagtaagaaatactcagcagatcattacacacctttcccttctgacctgggtttcctctcagagcaagtagccgctgcctgtggatttgaggatttccgagctgaagcagggatcctgaattactaccgcctggactccacactgggaatccacgtagacagatctgagctagatcactccaaacccttgctgtcattcagctttggacagtccgccatctttctcctgggtggtcttcaaagggatgaggcccccacggccatgtttatgcacagtggtgacatcatgataatgtcgggtttcagccgcctcttgaaccacgcagtccctcgtgtccttccaaatccagaaggggaaggcctgcctcactgcctagaggcacctctccctgctgtcctcccgagagattcaatggtagagccttgttctatggaggactggcaggtgtgtgccagctacttgaagaccgctcgtgttaacatgactgtccgacaggtcctggccacagaccagaatttccctctagaacccatcgaggatgaaaaaagagacatcagtacagaaggtttctgccatctggatgaccagaatagcgaagtaaaacgggccaggataaaccctgacagctgagacttggagatcccatcctttttactcaggcacctgcttaccgtaaatgatcatgttattgtgtattgccgtggacttcagcacccagacaagccaaaaacagagacagggaagaactcattgttgatcacactgttgccttggaacccacgcagaagtaaactcagccactttgctcagagaagtgtttgacatggtctgttcctagttacatgttggctgtaatgtatgttgagaagtcagtccaaggaggtatgttcttccacaacagccttctcagcctctgctatttcctttgaggaaggtagaagtgagtttccatgtttgcagagtatttaaatacctcagattttattaatgagaaatacagtacccctccctccactccatctggtaatttatggtaaaattgtggttctgtgaaccagctattagtctcatcttcttaactccctcaggcatcatcaaattctttgatcttctcttccacctctctggctctcatggaagaatcctttacacatgaaaacaatggaactggaaaatcttgtcttttagaaaagaaattaatcacaactatctctcttgcctaaaagataaatataggtaaacccaaggaaaggggaatttagtttctctacatgtcatttcggtctccaaactccctgttggctttttaatgcaattttaattgttggaataaaaaagtcccaagggtgttttgttactgttttctccatgaataaactcacttgattttaaattaaagatctatatctgtctttggggtttagtctatctgggattaaggtttttttttctgtttttctttgctgtattgttcatgctattgaagccctctagctgtttctgccctacaccattctgctgtgccctaagtattctttgtggctgtctcacagaagagagaacatttcttaatattccagtcactgctgttattgtctgagggtaggcagcttggaaaaatgtaggcaacaccaagttttaatctttatacccccaacaatttgactgactatatcatggtccaggttactttacatttctctggacctcggtttcctcatcataaaatgaagatactgtagactaccatcttcctaaagggatattggtatttgaaagagaattaagtgctcctttctacaaacatgatgtgccaaaattgttttattataagggctctttgaaacatcctaacttccttgtgtggaggactggctggaagcccatttggtacctactgtttgcaatgcatgttattaagtttacatgtctcctctgtcctgctctgccccttttttaaattactggcattgaatattgagttcatatggtaatagcagggtttttaaatgaataaaaattatggatttatctctta

SEQ ID NO: 106595 - DNA, 649 bp, Homo sapiens
  Payload ID: 933
  Gene Symbol: ALKBH1
  Gene Name: alkB homolog 1, histone H2A dioxygenase
  ENST ID: ENST00000555100
  CDS Start-End: 1-339
gcagcggccgtgggctctgtggcgactctggcgactgagcccggggaggacgcctttcggaaacttttccgcttctaccgtcagagccggcccgggaccgcagacctggaaggggtcatcgacttctcggcggcccacgcagcccgtggcaagggtcctggtgcccaaaaggtgatcaaatctcagctaaatgtgtcttctgtcagtgagcagaatgcatatagagcaggtcttcagcccgtcagcaagtggcaagcctatggactcaaaggctatcctggtataaagaagcgactaaacggagaccccgaagtttactggagaaactgcgttgggtgaccgtaggctaccattataactgggacagtaagagcaagtagccgctgcctgtggatttgaggatttccgagctgaagcagggatcctgaattactaccgcctggactccacactgggaatccacgtagacagatctgagctagatcactccaaacccttgctgtcattcagctttggacagtccgccatctttctcctgggtggtcttcaaagggatgaggcccccacggccatgtttatgcacagtggtgacatcatgataatgtcgggtttcagccgcctcttgaaccacgcagtccctcgtgtcctt

SEQ ID NO: 106596 - DNA, 1750 bp, Homo sapiens
  Payload ID: 933
  Gene Symbol: ALKBH1
  Gene Name: alkB homolog 1, histone H2A dioxygenase
  ENST ID: ENST00000557057
  CDS Start-End: 7-357
cgcgagatggggaagatggcagcggccgtgggctctgtggcgactctggcgactgagcccggggaggacgcctttcggaaacttttccgcttctaccgtcagagccggcccgggaccgcagacctggaaggggtcatcgacttctcggcggcccacgcagcccgtggcaagggtcctggtgcccaaaaggtgatcaaatctcagctaaatgtgtcttctgtcagtgagcagaatgcatatagagcaggtcttcagcccgtcagcaagtggcaagcctatggactcaaaggctatcctggtataaagaagcgactaaacggagaccccgaagtttactggagaaactgcgttgggtgaccgtaggctaccattataactgggacagtaagaaatactcagcagatcattacacacctttcccttctgacctgggtttcctctcagagcaagtagccgctgcctgtggatttgaggatttccgagctgaagcagggatcctgaattactaccgcctggactccacactgggaatccacgtagacagatctgagctagatcactccaaacccttgctgtcattcagctttggacagtccgccatctttctcctgggtggtcttcaaagggatgaggcccccacggccatgtttatgcacagtggtgacatcatgataatgtcgggtttcagccgcctcttgaaccacgcagtccctcgtgtccttccaaatccagaaggggaaggcctgcctcactgcctagaggcacctctccctgctgtcctcccgagagattcaatggtagagccttgttctatggaggactggcaggtgtgtgccagctacttgaagaccgctcgtgttaacatgactgtccgacaggtcctggccacagaccagaatttccctctagaacccatcgaggatgaaaaaagagacatcagtacagaaggtttctgccatctggatgaccagaatagcgaagtaaaacgggccaggataaaccctgacagctgagacttggagatcccatcctttttactcaggcacctgcttaccgtaaatgatcatgttattgtgtattgccgtggacttcagcacccagacaagccaaaaacagagacagggaagaactcattgttgatcacactgttgccttggaacccacgcagaagtaaactcagccactttgctcagagaagtgtttgacatggtctgttcctagttacatgttggctgtaatgtatgttgagaagtcagtccaaggaggtatgttcttccacaacagccttctcagcctctgctatttcctttgaggaaggtagaagtgagtttccatgtttgcagagtatttaaatacctcagattttattaatgagaaatacagtacccctccctccactccatctggtaatttatggtaaaattgtggttctgtgaaccagctattagtctcatcttcttaactccctcaggcatcatcaaattctttgatcttctcttccacctctctggctctcatggaagaatcctttacacatgaaaacaatggaactggaaaatcttgtcttttagaaaagaaattaatcacaactatctctcttgcctaaaagataaatataggtaaacccaaggaaaggggaatttagtttctctacatgtcatttcggtctccaaactccctgttggctttttaatgcaattttaattgttggaataaaaaagtcccaagggtgttttgttactgttttctc

SEQ ID NO: 106597 - DNA, 1030 bp, Homo sapiens
  Payload ID: 934
  Gene Symbol: ALKBH2
  Gene Name: alkB homolog 2, alpha-ketoglutarate-dependent dioxygenase
  Uniprot ID: Q6NS38
  ENST ID: ENST00000343075
  CDS Start-End: 228-1013
gtctttcccaccacgaggccaccagggtgactgcgggattccgatctgcgccggagctgcgatgctagagcactcttgccacccccaccccacggacgtgttgcagtgatatcagaattttgcgtgcggtttacccgtgtttaacctctttgcgtctcgcttctgaatcgtatccacttgagcatcactagactgatctattttaacactggtggggggcagcgaggatggacagattcctggtgaaaggggctcaagggggccttttgaggaagcaggaggagcaagagccaactggagaagagccagctgtgttgggaggagacaaagaaagcacaaggaagaggcccaggagagaggccccagggaatggaggccactcagcaggccctagctggcggcacattcgggctgagggcctggactgcagttacacagtcctgtttggcaaagctgaggcagatgagattttccaagagttggagaaagaagtagaatattttacaggagcactggccagagtccaggtattcgggaagtggcacagtgtgcccaggaagcaggcaacgtatggcgacgctgggctgacctacacattttcaggcctcacgctgtctccaaagccctggatcccagttctagagcgcatccgggatcacgtctctggggtgactggacagaccttcaactttgtgctcatcaacaggtataaagatggctgtgaccacatcggggagcaccgagatgatgaaagagaactggcccctgggagccccattgcctctgtctccttcggtgcctgcagagactttgtcttccggcataaggattcccgtgggaaaagcccctccaggagggtggcggtggtcaggctgccgctggcccacgggagcttactaatgatgaaccacccgaccaacacgcactggtaccacagtcttcccgtgagaaagaaggttctggctccacgggtgaatctgacttttcgtaaaattttgcttactaaaaaataaaaacatttttaacagtt

SEQ ID NO: 106598 - DNA, 1159 bp, Homo sapiens
  Payload ID: 934
  Gene Symbol: ALKBH2
  Gene Name: alkB homolog 2, alpha-ketoglutarate-dependent dioxygenase
  Uniprot ID: Q6NS38
  ENST ID: ENST00000429722
  CDS Start-End: 365-1150
cgaggccaccagggtgactgcgggattccgatctgcgccggagctgcgatgctagagcactcttgccacccccaccccacggacgtgttgcagtgatatcagaattttgcgtgcggtttacccgtgtttaacctctttgcgtctcgcttctgaatcgtatccacttgagcatcactagactgatctattttaacactggtggggggcagcgaggacatggttttaaactttaaaatgaaaatgtgaaactaggaatgttgctgtgagaccccttggacaaacagatttttgcactggggatagaacttgagcaatttctgtcttggcctcgccactgacgtcccttctttcctgtggggacaggatggacagattcctggtgaaaggggctcaagggggccttttgaggaagcaggaggagcaagagccaactggagaagagccagctgtgttgggaggagacaaagaaagcacaaggaagaggcccaggagagaggccccagggaatggaggccactcagcaggccctagctggcggcacattcgggctgagggcctggactgcagttacacagtcctgtttggcaaagctgaggcagatgagattttccaagagttggagaaagaagtagaatattttacaggagcactggccagagtccaggtattcgggaagtggcacagtgtgcccaggaagcaggcaacgtatggcgacgctgggctgacctacacattttcaggcctcacgctgtctccaaagccctggatcccagttctagagcgcatccgggatcacgtctctggggtgactggacagaccttcaactttgtgctcatcaacaggtataaagatggctgtgaccacatcggggagcaccgagatgatgaaagagaactggcccctgggagccccattgcctctgtctccttcggtgcctgcagagactttgtcttccggcataaggattcccgtgggaaaagcccctccaggagggtggcggtggtcaggctgccgctggcccacgggagcttactaatgatgaaccacccgaccaacacgcactggtaccacagtcttcccgtgagaaagaaggttctggctccacgggtgaatctgacttttcgtaaaattttgcttactaaaaaataaaaacatttt

SEQ ID NO: 106599 - DNA, 574 bp, Homo sapiens
  Payload ID: 934
  Gene Symbol: ALKBH2
  Gene Name: alkB homolog 2, alpha-ketoglutarate-dependent dioxygenase
  Uniprot ID: Q6NS38
  ENST ID: ENST00000440112
  CDS Start-End: 4-477
aggatggacagattcctggtgaaaggggctcaagggggccttttgaggaagcaggaggagcaagagccaactggagaagagccagctgtgttgggaggagacaaagaaagcacaaggaagaggcccaggagagaggccccagggaatggaggccactcagcaggccctagctggcggcacattcgggctgagggcctggactgcagttacacagtcctgtttggcaaagctgaggcagatgagattttccaagagttggagaaagaagtagaatattttacaggtataaagatggctgtgaccacatcggggagcaccgagatgatgaaagagaactggcccctgggagccccattgcctctgtctccttcggtgcctgcagagactttgtcttccggcataaggattcccgtgggaaaagcccctccaggagggtggcggtggtcaggctgccgctggcccacgggagcttactaatgatgaaccacccgaccaacacgcactggtaccacagtcttcccgtgagaaagaaggttctggctccacgggtgaatctgacttttcgtaaaatttt

SEQ ID NO: 106600 - DNA, 572 bp, Homo sapiens
  Payload ID: 934
  Gene Symbol: ALKBH2
  Gene Name: alkB homolog 2, alpha-ketoglutarate-dependent dioxygenase
  ENST ID: ENST00000536242
  CDS Start-End: 122-572
tttcccaccacgaggccaccagggtgactgcgggattccgatctgcgccggagctgcgatgctagagcactcttgccacccccaccccacggacgtgttgcagtgatatcagaattttgcgatggacagattcctggtgaaaggggctcaagggggccttttgaggaagcaggaggagcaagagccaactggagaagagccagctgtgttgggaggagacaaagaaagcacaaggaagaggcccaggagagaggccccagggaatggaggccactcagcaggccctagctggcggcacattcgggctgagggcctggactgcagttacacagtcctgtttggcaaagctgaggcagatgagattttccaagagttggagaaagaagtagaatattttacaggagcactggccagagtccaggtattcgggaagtggcacagtgtgcccaggaagcaggcaacgtatggcgacgctgggctgacctacacattttcaggcctcacgctgtctccaaagccctggatcccagttctagagcgcatccgggatcacgtctctggggtgactggac

SEQ ID NO: 106601 - DNA, 1049 bp, Homo sapiens
  Payload ID: 934
  Gene Symbol: ALKBH2
  Gene Name: alkB homolog 2, alpha-ketoglutarate-dependent dioxygenase
  ENST ID: ENST00000536358
  CDS Start-End: 687-1049
gtctttcccaccacgaggccaccagggtgactgcgggattccgatctgcgccggagctgcgatgctagagcactcttgccacccccaccccacggacgtgttgcagtgatatcagaattttgcgtgcggtttacccgtgtttaacctctttgcgtctcgcttctgaatcgtatccacttgagcatcactagactgatctattttaacactggtggggggcagcgaggtcagttatgggtccttcctccttaaaggggtggacagttgactttgggcaaacctcttcgcctctgtgggcaacagtttccccttctgcaaaatgagggtttggattgtagtttctaagtttagctgtggcgtgcgaattcccaggaggtagttctttaaaaattcaggtgctcaggcgtggagtgcagacctctgggtttttgcaagctagccagctgattctgatgcacaggtggacgtgggagaccctggatcagattgtccctagggtcccttccggctttaacatcttctgtttcctttctaggacatggttttaaactttaaaatgaaaatgtgaaactaggaatgttgctgtgagaccccttggacaaacagatttttgcactggggatagaacttgagcaatttctgtcttggcctcgccactgacgtcccttctttcctgtggggacaggatggacagattcctggtgaaaggggctcaagggggccttttgaggaagcaggaggagcaagagccaactggagaagagccagctgtgttgggaggagacaaagaaagcacaaggaagaggcccaggagagaggccccagggaatggaggccactcagcaggccctagctggcggcacattcgggctgagggcctggactgcagttacacagtcctgtttggcaaagctgaggcagatgagattttccaagagttggagaaagaagtagaatattttacaggagcactggccagagtccaggtattcgggaagtggcacagtgtgcccaggaagcaggcaacgtatggcgacgctgggctgacc

SEQ ID NO: 106602 - DNA, 834 bp, Homo sapiens
  Payload ID: 934
  Gene Symbol: ALKBH2
  Gene Name: alkB homolog 2, alpha-ketoglutarate-dependent dioxygenase
  ENST ID: ENST00000543444
  CDS Start-End: 1-449
gccttttgaggaagcaggaggagcaagagccaactggagaagagccagctgtgttgggaggagacaaagaaagcacaaggaagaggcccaggagagaggccccagggaatggaggccactcagcaggccctagctggcggcacattcgggctgagggcctggactgcagttacacagtcctgtttggcaaagctgaggcagatgagattttccaagagttggagaaagaagtagaatattttacaggagcactggccagagtccaggtattcgggaagtggcacagtgtgcccaggaagcaggcaacgtatggcgacgctgggctgacctacacattttcaggcctcacgctgtctccaaagccctggatcccagttctagagcgcatccgggatcacgtctctggggtgactggacagaccttcaactttgtgctcatcaacaggtgacaccctgtttagtggactcaatgttacaagtcttctgtctcctccaaaaggaagtgtttagggttccaccctatttggttcattggtacaaatcatttcttagtacactggggctctaagagtggaatagcgccagcactcggtcttcctggatcctggagctcatcccggagtaggaagtgagaggtgattaactcctgaacaaacagctgaatgagataatttcttcttctctttttctttcttttttttttttgagacagggtttttctatgttgcccaggcttggtctcaaactgctaggctcaagcgatcctcccacctcagcctcccaaagtgctgggattacaggcgtgaacgactatgcctgaccctagacgatttc

SEQ ID NO: 106603 - DNA, 895 bp, Homo sapiens
  Payload ID: 934
  Gene Symbol: ALKBH2
  Gene Name: alkB homolog 2, alpha-ketoglutarate-dependent dioxygenase
  Uniprot ID: Q6NS38
  ENST ID: ENST00000619381
  CDS Start-End: 291-764
cgattcgctggggcgcgtctttcccaccacgaggccaccagggtgactgcgggattccgatctgcgccggagctgcgatgctagagcactcttgccacccccaccccacggacgtgttgcagtgatatcagaattttgcgacatggttttaaactttaaaatgaaaatgtgaaactaggaatgttgctgtgagaccccttggacaaacagatttttgcactggggatagaacttgagcaatttctgtcttggcctcgccactgacgtcccttctttcctgtggggacaggatggacagattcctggtgaaaggggctcaagggggccttttgaggaagcaggaggagcaagagccaactggagaagagccagctgtgttgggaggagacaaagaaagcacaaggaagaggcccaggagagaggccccagggaatggaggccactcagcaggccctagctggcggcacattcgggctgagggcctggactgcagttacacagtcctgtttggcaaagctgaggcagatgagattttccaagagttggagaaagaagtagaatattttacaggtataaagatggctgtgaccacatcggggagcaccgagatgatgaaagagaactggcccctgggagccccattgcctctgtctccttcggtgcctgcagagactttgtcttccggcataaggattcccgtgggaaaagcccctccaggagggtggcggtggtcaggctgccgctggcccacgggagcttactaatgatgaaccacccgaccaacacgcactggtaccacagtcttcccgtgagaaagaaggttctggctccacgggtgaatctgacttttcgtaaaattttgcttactaaaaaataaaaacatttttaacagttt

SEQ ID NO: 106604 - DNA, 1474 bp, Homo sapiens
  Payload ID: 935
  Gene Symbol: ALKBH3
  Gene Name: alkB homolog 3, alpha-ketoglutarate-dependent dioxygenase
  Uniprot ID: Q96Q83
  ENST ID: ENST00000302708
  CDS Start-End: 412-1272
ggttccgatcacagactgcggagtgggtcaggggctgcgagggctgccccaagtcctaccgggtttgcacgggcgcgcccggctccgcccgcaagtgcgccttcctgacttactgctgggtgcgcggggctgggggtgcgagtaccacccctgaagtctcttcctgggcgacctccggggcctcattctaggcctccttaaagagaaggatctaaattaggaaaaggaagtgcccttatccacgaccaagctcttccacctgcggagctcgcttagtctgcacctcaaccgtgcggaaagtgactgccctgtttactgaggaaaaactggggctcagaaagataccatggagtagtttgaaacaggaacaaaatcttctgaaagctcggagcagaagcctttttggtcaacatggaggaaaaaagacggcgagcccgagttcagggagcctgggctgcccctgttaaaagccaggccattgctcagccagctaccactgctaagagccatctccaccagaagcctggccagacctggaagaacaaagagcatcatctctctgacagagagtttgtgttcaaagaacctcagcaggtagtacgtagagctcctgagccacgagtgattgacagagagggtgtgtatgaaatcagcctgtcacccacaggtgtatctagggtctgtttgtatcctggctttgttgacgtgaaagaagctgactggatattggaacagctttgtcaagatgttccctggaaacagaggactggcatcagagaggatataacttatcagcaaccaagacttacagcatggtatggagaacttccttacacttattcaagaatcactatggaaccaaatcctcactggcaccctgtgctgcgcacactaaagaaccgcattgaagagaacactggccacaccttcaactccttactctgcaatctttatcgcaatgagaaggacagcgtggactggcacagtgatgatgaaccctcactagggaggtgccccattattgcttcactaagttttggtgccacacgcacatttgagatgagaaagaagccaccaccagaagagaatggagactacacatatgtggaaagagtgaagatacccttggatcatgggaccttgttaatcatggaaggagcgacacaagctgactggcagcatcgagtgcccaaagaataccactctagagaaccgagagtgaacctgacctttcggacagtctatccagaccctcgaggggcaccctggtgacgtcagagctttgagagagaagcttcactgaaacggagcaaaccttccactgagaagccacttcaagaggctggtgctgctagatctcatgatgtggctgttgggaagatggtggggtttgtttgccagcttggagtcctattaaatgaaagccagcaactcatgttggtaataggtctactgtgggaacagttatccctaa

SEQ ID NO: 106605 - DNA, 764 bp, Homo sapiens
  Payload ID: 935
  Gene Symbol: ALKBH3
  Gene Name: alkB homolog 3, alpha-ketoglutarate-dependent dioxygenase
  ENST ID: ENST00000534171
  CDS Start-End: 401-601
cagactgcggagtgggtcaggggctgcgagggctgccccaagtcctaccgggtttgcacgggcgcgcccggctccgcccgcaagtgcgccttcctgacttactgctgggtgcgcggggctgggggtgcgagtaccacccctgaagtctcttcctgggcgacctccggggcctcattctaggcctccttaaagagaaggatctaaattaggaaaaggaagtgcccttatccacgaccaagctcttccacctgcggagctcgcttagtctgcacctcaaccgtgcggaaagtgactgccctgtttactgaggaaaaactggggctcagaaagataccatggagtagtttgaaacaggaacaaaatcttctgaaagctcggagcagaagcctttttggtcaacatggaggaaaaaagacggcgagcccgagttcagggagcctgggctgcccctgttaaaagccaggccattgctcagccagctaccactgctaagagccatctccaccagaagcctggccagacctggaagaacaaagagcatcatctctctgacagagagtttgtgttcaaagaacctcagcagcagagagggtgtgtatgaaatcagcctgtcacccacaggtgtatctagggtctgtttgtatcctggctttgttgacgtgaaagaagctgactggatattggaacagctttgtcaagatgttccctggaaacagaggactggcatcagagaggtggcaccctgtgctgcgcacactaaagaa

SEQ ID NO: 106606 - DNA, 725 bp, Homo sapiens
  Payload ID: 935
  Gene Symbol: ALKBH3
  Gene Name: alkB homolog 3, alpha-ketoglutarate-dependent dioxygenase
  ENST ID: ENST00000532129
  CDS Start-End: 1-469
gctgactggatattggaacagctttgtcaagatgttccctggaaacagaggactggcatcagagaggtggcaccctgtgctgcgcacactaaagaaccgcattgaagagaacactggccacaccttcaactccttactctgcaatctttatcgcaatgagaaggacagcgtggactggcacagtgatgatgaaccctcactagggaggtgccccattattgcttcactaagttttggtgccacacgcacatttgagatgagaaagaagccaccaccagaagagaatggagactacacatatgtggaaagagtgaagatacccttggatcatgggaccttgttaatcatggaaggagcgacacaagctgactggcagcatcgagtgcccaaagaataccactctagagaaccgagagtgaacctgacctttcggacagtctatccagaccctcgaggggcaccctggtgacgtcagagctttgagagagaagcttcactgaaacggagcaaaccttccactgagaagccacttcaagaggctggtgctgctagatctcatgatgtggctgttgggaagatggtggggtttgtttgccagcttggagtcctattaaatgaaagccagcaactcatgttggtaataggtctactgtgggaacagttatccctaaccacagctcaaaatcgctatcatctttaggcaaattaaaatctatgtggcagtg

SEQ ID NO: 106607 - DNA, 842 bp, Homo sapiens
  Payload ID: 935
  Gene Symbol: ALKBH3
  Gene Name: alkB homolog 3, alpha-ketoglutarate-dependent dioxygenase
  ENST ID: ENST00000524742
  CDS Start-End: 663-842
tgcggagtgggtcaggggctgcgagggctgccccaagtcctaccgggtttgcacgggcgcgcccggctccgcccgcaagtgcgccttcctgacttactgctgggtgcgcggggctgggggtgcgagtaccacccctgaagtctcttcctgggcgacctccggggcctcattctaggcctccttaaagagaaggatctaaattaggaaaaggaagtgcccttatccacgaccaagctcttccacctgcggagctcgcttagtctgcacctcaaccgtgcggaaagtgactgccctgtttactgaggaaaaactggggctcagaaaggtgaagtcatttgccatgggccatgcagctgggaagtgacagatctggattcaaagcgagttctggctggcgccagagtccttgtattttacagcactggttctcaagctttatgtgcattaagaattcctgggttgagggtggcgttagttaacaaattctgggactctacaaattgagtagatctgggatggggctctggaatctattttcaacaattgttccctggcaaataacatatggctccccagtgaatggagcaagaagataccatggagtagtttgaaacaggaacaaaatcttctgaaagctcggagcagaagcctttttggtcaacatggaggaaaaaagacggcgagcccgagttcagggagcctgggctgcccctgttaaaagccaggccattgctcagccagctaccactgctaagagccatctccaccagaagcctggccagacctggaagaacaaagagcatcatctctctgacagagagtttgtgttcaaagaacctcag

SEQ ID NO: 106608 - DNA, 1371 bp, Homo sapiens
  Payload ID: 935
  Gene Symbol: ALKBH3
  Gene Name: alkB homolog 3, alpha-ketoglutarate-dependent dioxygenase
  ENST ID: ENST00000532962
  CDS Start-End: 440-955
gttgctggagtcggtgcttcactcttaaggttccgatcacagactgcggagtgggtcaggggctgcgagggctgccccaagtcctaccgggtttgcacgggcgcgcccggctccgcccgcaagtgcgccttcctgacttactgctgggtgcgcggggctgggggtgcgagtaccacccctgaagtctcttcctgggcgacctccggggcctcattctaggcctccttaaagagaaggatctaaattaggaaaaggaagtgcccttatccacgaccaagctcttccacctgcggagctcgcttagtctgcacctcaaccgtgcggaaagtgactgccctgtttactgaggaaaaactggggctcagaaagataccatggagtagtttgaaacaggaacaaaatcttctgaaagctcggagcagaagcctttttggtcaacatggaggaaaaaagacggcgagcccgagttcagggagcctgggctgcccctgttaaaagccaggccattgctcagccagctaccactgctaagagccatctccaccagaagcctggccagacctggaagaacaaagagcatcatctctctgacagagagtttgtgttcaaagaacctcagcaggtagtacgtagagctcctgagccacgagtgattgacagagagggtgtgtatgaaatcagcctgtcacccacaggtgtatctagggtctgtttgtatcctggctttgttgacgtgaaagaagctgactggatattggaacagctttgtcaagatgttccctggaaacagaggactggcatcagagaggattccatattgcaactaacctttaagaagtcagcacctgttagtggaaccgcgactgctccgcagagctgctggtatgagcgcccgtcgccaccccacatcccaggcccagccattctgacaagaactagactttgggctccttgagaatattcagtttttggcaccctgtgctgcgcacactaaagaaccgcattgaagagaacactggccacaccttcaactccttactctgcaatctttatcgcaatgagaaggacagcgtggactggcacagtgatgatgaaccctcactagggaggtgccccattattgcttcactaagttttggtgccacacgcacatttgagatgagaaagaagccaccaccagaagagaatggagactacacatatgtggaaagagtgaagatacccttggatcatgggaccttgttaatcatggaaggagcgacacaagctgactggcagcatcgagtgcccaaagaataccactctagagaaccgagagtgaacctgacctttcggacagtctatccagaccctcgaggggcaccctggtga

SEQ ID NO: 106609 - DNA, 747 bp, Homo sapiens
  Payload ID: 935
  Gene Symbol: ALKBH3
  Gene Name: alkB homolog 3, alpha-ketoglutarate-dependent dioxygenase
  ENST ID: ENST00000529366
  CDS Start-End: 77-747
aaacagataccatggagtagtttgaaacaggaacaaaatcttctgaaagctcggagcagaagcctttttggtcaacatggaggaaaaaagacggcgagcccgagttcagggagcctgggctgcccctgttaaaagccaggccattgctcagccagctaccactgctaagagccatctccaccagaagcctggccagacctggaagaacaaagagcatcatctctctgacagagagtttgtgttcaaagaacctcagcaggtagtacgtagagctcctgagccacgagtgattgaagagggtgtgtatgaaatcagcctgtcacccacaggtgtatctagggtctgtttgtatcctggctttgttgacgtgaaagaagctgactggatattggaacagctttgtcaagatgttccctggaaacagaggactggcatcagagaggatataacttatcagcaaccaagacttacagcatggtatggagaacttccttacacttattcaagaatcactatggaaccaaatcctcactggcaccctgtgctgcgcacactaaagaaccgcattgaagagaacactggccacaccttcaactccttactctgcaatctttatcgcaatgagaaggacagcgtggactggcacagtgatgatgaaccctcactagggaggtgccccattattgcttcactaagttttggtgccacacgcacatttgagatgagaaagaagccaccaccagaaga

SEQ ID NO: 106610 - DNA, 1557 bp, Homo sapiens
  Payload ID: 935
  Gene Symbol: ALKBH3
  Gene Name: alkB homolog 3, alpha-ketoglutarate-dependent dioxygenase
  Uniprot ID: Q96Q83
  ENST ID: ENST00000530803
  CDS Start-End: 377-889
tgcgagggctgccccaagtcctaccgggtttgcacgggcgcgcccggctccgcccgcaagtgcgccttcctgacttactgctgggtgcgcggggctgggggtgcgagtaccacccctgaagtctcttcctgggcgacctccggggcctcattctaggcctccttaaagagaaggatctaaattaggaaaaggaagtgcccttatccacgaccaagctcttccacctgcggagctcgcttagtctgcacctcaaccgtgcggaaagtgactgccctgtttactgaggaaaaactggggctcagaaagataccatggagtagtttgaaacaggaacaaaatcttctgaaagctcggagcagaagcctttttggtcaacatggaggaaaaaagacggcgagcccgagttcagggagcctgggctgcccctgttaaaagccaggccattgctcagccagctaccactgctaagagccatctccaccagaagcctggccagacctggaagaacaaagagcatcatctctctgacagagagtttgtgttcaaagaacctcagcaggtagtacgtagagctcctgagccacgagtgattgaagagggtgtgtatgaaatcagcctgtcacccacaggtgtatctagggtctgtttgtatcctggctttgttgacgtgaaagaagctgactggatattggaacagctttgtcaagatgttccctggaaacagaggactggcatcagagaggattccatattgcaactaacctttaagaagtcagcacctgttagtggaaccgcgactgctccgcagagctgctggtatgagcgcccgtcgccaccccacatcccaggcccagccattctgacaagaactagactttgggctccttgagaatattcagtttttggcaccctgtgctgcgcacactaaagaaccgcattgaagagaacactggccacaccttcaactccttactctgcaatctttatcgcaatgagaaggacagcgtggactggcacagtgatgatgaaccctcactagggaggtgccccattattgcttcactaagttttggtgccacacgcacatttgagatgagaaagaagccaccaccaagaatggagactacacatatgtggaaagagtgaagatacccttggatcatgggaccttgttaatcatggaaggagcgacacaagctgactggcagcatcgagtgcccaaagaataccactctagagaaccgagagtgaacctgacctttcggacagtctatccagaccctcgaggggcaccctggtgacgtcagagctttgagagagaagcttcactgaaacggagcaaaccttccactgagaagccacttcaagaggctggtgctgctagatctcatgatgtggctgttgggaagatggtggggtttgtttgccagcttggagtcctattaaatgaaagccagcaactcatgttggtaataggtctactgtgggaacagttatccctaaccacagctcaaaatcgctatcatctttaggcaaattaaaatctatgtggcagtg

SEQ ID NO: 106611 - DNA, 2105 bp, Homo sapiens
  Payload ID: 936
  Gene Symbol: ALKBH4
  Gene Name: alkB homolog 4, lysine demthylase
  Uniprot ID: Q9NXW9
  ENST ID: ENST00000292566
  CDS Start-End: 41-949
cccacggccgcgcctgcgcactggccacgcggacggcgcgatggcggcggctgccgccgagacccccgaagtccttcgggaatgcggttgcaagggcatccggacctgtctgatctgcgagcggcagcgcggcagtgacccgccctgggagctgcccccagcgaaaacataccgtttcatttactgctccgacaccggctgggccgtgggcacagaggagtctgactttgagggctgggccttccccttcccaggagtgatgctgatcgaggactttgtgacccgggaggaagaagccgagttggtgcggctcatggaccgtgacccctggaagctctcccagtctggacggaggaagcaggactatggccccaaagtcaactttcggaaacagaagctaaagaccgagggcttctgcggcctccccagcttcagccgggaggtggtgcggaggatgggcctctacccggggctggagggcttccggcccgtcgagcagtgcaacctggactactgccccgagcggggctctgccattgacccccacctggacgacgcctggctgtggggggagcggctggtcagcctcaacctcctgtcccccaccgtgctgtccatgtgtcgggaggcgcccgggagcctgctcctctgctcggccccgtcggctgccccggaggccttggtggacagcgtgatagcacccagccggtcggtgctatgccaggaggtggaggtggccatccccttacccgcccgctccctgctggtcctcaccggggcggcacggcaccagtggaagcatgccatccaccgcagacacatcgaggcccgccgcgtctgcgtcactttccgggagctgtcggctgagtttggccctggagggaggcagcaagagctgggccaggaactgctgcggatcgccctctccttccagggaagacccgtgtgaaccgcctccttggctccagacttgactgatcccgggattgaaatgaggagcacagaacagggcctcctgcaactcacggggtttcaagagaagatggctgacccctgatgctgtgagcagtgtgagccctgcccaggagcaggttttgatgggaacgtacctccaggcagcccccttccacctggaccgtggccacacttttttggttatttagtttgtcacagtcttggggacatgggatcatttgagcttaaaaaatactgggggccgggcacagtggctcacacctgtaatcctaacactttgggaggctgaggtgggcggatcacttgatgccaggagttcgagaccagcctggccaacacggtgaaaacccgtctctacaaaaactacaaaaattagccgggtgtggtgactcacagccgtaatcccagctactcgggaggctaaggtgggagaattgcttgaacctgggaggcggaggttgcagtgagccaagatcacgccactgcactccagcctcggtgacagagcaagactgttttgaaaaaaaaaaaaaatgggaacattttaaatgattttcacctttattatgcatctattttcatggggtttcccgatatctcactgtccagtcccttcatttggggaatgtgttggattagggaacagggttgaagatttgaagtttagactaaagagctgggaacagcttcagagtcaggctcagcctgactcatgcttgacacccccacgcccagggagggttgggggatgtgaggagggcagggaaatctgagagcctccttccagccccataacgctgttaacaagtaggaaaaattaaagctcccggccaggcgcggtgactcacacctgtaatccgagtactttgcggggctcaggtgggaggattgcttgaggccagcctgggcaacatagtgagacccccatctctacaaaaaatacaaacattagctgggcgtctgggcatggtggcacacacctgtagtcccagctactcgaaaggctgaggcgggaggatggctttaccaccatgtcaaggctgcagtgagctcatgatcataccactgcacttaacttggcaacagagcaagaccctgtccctaaaataaataaaaggaaaacaaaaaaa

SEQ ID NO: 106612 - DNA, 1405 bp, Homo sapiens
  Payload ID: 936
  Gene Symbol: ALKBH4
  Gene Name: alkB homolog 4, lysine demthylase
  Uniprot ID: Q9NXW9
  ENST ID: ENST00000490528
  CDS Start-End: 28-156
ctgcgcactggccacgcggacggcgcgatggcggcggctgccgccgagacccccgaagtccttcgggaatgcggttgcaagggcatccggacctgtctgatctgcgagcggcagcgcggcagtgacccgccctgggagctgcccccagcggagtgatgctgatcgaggactttgtgacccgggaggaagaagccgagttggtgcggctcatggaccgtgacccctggaagctctcccagtctggacggaggaagcaggactatggccccaaagtcaactttcggaaacagaagctaaagaccgagggcttctgcggcctccccagcttcagccgggaggtggtgcggaggatgggcctctacccggggctggagggcttccggcccgtcgagcagtgcaacctggactactgccccgagcggggctctgccattgacccccacctggacgacgcctggctgtggggggagcggctggtcagcctcaacctcctgtcccccaccgtgctgtccatgtgtcgggaggcgcccgggagcctgctcctctgctcggccccgtcggctgccccggaggccttggtggacagcgtgatagcacccagccggtcggtgctatgccaggaggtggaggtggccatccccttacccgcccgctccctgctggtcctcaccggggcggcacggcaccagtggaagcatgccatccaccgcagacacatcgaggcccgccgcgtctgcgtcactttccgggagctgtcggctgagtttggccctggagggaggcagcaagagctgggccaggaactgctgcggatcgccctctccttccagggaagacccgtgtgaaccgcctccttggctccagacttgactgatcccgggattgaaatgaggagcacagaacagggcctcctgcaactcacggggtttcaagagaagatggctgacccctgatgctgtgagcagtgtgagccctgcccaggagcaggttttgatgggaacgtacctccaggcagcccccttccacctggaccgtggccacacttttttggttatttagtttgtcacagtcttggggacatgggatcatttgagcttaaaaaatactgggggccgggcacagtggctcacacctgtaatcctaacactttgggaggctgaggtgggcggatcacttgatgccaggagttcgagaccagcctggccaacacggtgaaaacccgtctctacaaaaactacaaaaattagccgggtgtggtgactcacagccgtaatcccagctactcgggaggctaaggtgggagaattgcttgaacctgggaggcggaggttgcagtgagccaagatcacgccactgcactccagcctcggtgacagagcaagactgttttgaaaaaaaaaaaaaa

SEQ ID NO: 106613 - DNA, 2748 bp, Homo sapiens
  Payload ID: 937
  Gene Symbol: ALKBH5
  Gene Name: alkB homolog 5, RNA demethylase
  Uniprot ID: Q6P6C2
  ENST ID: ENST00000399138
  CDS Start-End: 6-1190
gggccatggcggccgccagcggctacacggacctgcgtgagaagctcaagtccatgacgtcccgggacaactataaggcgggcagccgggaggccgccgccgctgccgcagccgccgtagccgccgcagccgcagccgccgctgccgccgaaccttaccctgtgtccggggccaagcgcaagtatcaggaggactcggaccccgagcgcagcgactatgaggagcagcagctgcagaaggaggaggaggcgcgcaaggtgaagagcggcatccgccagatgcgcctcttcagccaggacgagtgcgccaagatcgaggcccgcattgacgaggtggtgtcccgcgctgagaagggcctgtacaacgagcacacggtggaccgggccccactgcgcaacaagtacttcttcggcgaaggctacacttacggcgcccagctgcagaagcgcgggcccggccaggagcgcctctacccgccgggcgacgtggacgagatccccgagtgggtgcaccagctggtgatccaaaagctggtggagcaccgcgtcatccccgagggcttcgtcaacagcgccgtcatcaacgactaccagcccggcggctgcatcgtgtctcacgtggaccccatccacatcttcgagcgccccatcgtgtccgtgtccttctttagcgactctgcgctgtgcttcggctgcaagttccagttcaagcctattcgggtgtcggaaccagtgctttccctgccggtgcgcaggggaagcgtgactgtgctcagtggatatgctgctgatgaaatcactcactgcatacggcctcaggacatcaaggagcgccgagcagtcatcatcctcaggaagacaagattagatgcaccccggttggaaacaaagtccctgagcagctccgtgttaccacccagctatgcttcagatcgcctgtcaggaaacaacagggaccctgctctgaaacccaagcggtcccaccgcaaggcagaccctgatgctgcccacaggccacggatcctggagatggacaaggaagagaaccggcgctcggtgctgctgcccacacaccggcggaggggtagcttcagctctgagaactactggcgcaagtcatacgagtcctcagaggactgctctgaggcagcaggcagccctgcccgaaaggtgaagatgcggcggcactgagtctacccgccgccctcctgggaactctggctcatccttacgtagttgcccctccttttgttttgagggttttgtttttgttcattggggggtttttgttttttgttttttgttttttttgattctatatatttttccttggttttgttgcctgttagggctgaagaatagaattggccaggacctaggttctcatattcttggtattcctcctggatggaaaggctgttggcatcaataggggacagaggctgatgctggagtggccagtagaggtggtggagcagagcagccatcttttaagtggggctgtatcaggctgggtttatttaaaagcaacaaaatgttttggttaagaaaattattttgctttcagtgtaaatcttcgcagtgttctaaacaaagttcagtcttctgctcgcccctttccctcactgatgtctgcacttggttgaggtctcctggagcctcacaggctctgctgttctccacttctcacctgccatccacgccctgcaagctcatgcaaacaccctttcttcctcctgcggcagagttgttcaggttgcctgggcaggggcttaaacagtgccagcccctgccatcccaaagctattgttaagccccccaggcgtcctccacccacgcccactagcctgccatgtccacagttccttgggctgctgaggggctagtgcagtggtcctgacctctcttatcaagagcacacttctttgctggttgctccttttgagcatatgcgtgtgattatttggaacagttagacttgccacgttgggtcagttttagaaattgtttctagctagagggactggtgtccttccaagtctagcatttggggtatggaaaattgttgtggtgtgtggtagggtttttgttttcttttttgagttttttttccccctttagtctcctggctttttcctttcccttcccttctccactggccagcttgggcctcatcctcatgtcatccttctaggaaggcgcctgccccatcttgtctgccggcagcatgcatccaaggccagagctcaggcctgcagactgggctggtgcctcctccgcttcagggtatgggagttggtgaaggggctttcaaaaaataataaggaaaaaaaggtaaagtctttggtagcttctatccactcagatcctggaaggcagcaaggttttgtggatctagattcattaggaatgtcttcttgtcagccaggccaggacccgggcttgccaagagcagaggccctcccagcaaccaggataccaccactttgggggctttgtgtacagaggtccgggtctgagacctcataggctgcagaaatctggggcagccaccatcaagaagcccctctcaggggccagaactcctttgccagcgtggatttctcaagtcgggactgcataattaaagcagttgcagttttattttttttacagcttttttcccaaaaatgatttgtagttgtgtgtgcagcacttcgccctgatatgtgtgctctacaataaaaaccaaatctaatatattttgaaa

SEQ ID NO: 106614 - DNA, 1605 bp, Homo sapiens
  Payload ID: 937
  Gene Symbol: ALKBH5
  Gene Name: alkB homolog 5, RNA demethylase
  ENST ID: ENST00000541285
  CDS Start-End: 442-603
gaaacgtccgctccgggcggcggcggcagcggcggcaggctggcttgtaccccgacaacgcgcgtctggcttctgccggacgttcctatctgggttcagaactggggccgggtgctgcaggtcccgcagtctgagaagttttcgcgggtttcagaagtttccttaggcgttctaagggctttactcagtggatatgctgctgatgaaatcactcactgcatacggcctcaggacatcaaggagcgccgagcagtcatcatcctcaggaagacaagattagatgcaccccggttggaaacaaagtccctgagcagctccgtgttaccacccagctatgcttcagatcgcctgtcaggaaacaacagggaccctgctctgaaacccaagcggtcccaccgcaaggcagaccctgatgctgcccacaggccacggatcctggagatggacaaggaagagaaccggcgctcggtgctgctgcccacacaccggcggaggggtagcttcagctctgagaactactggcgcaagtcatacgagtcctcagaggactgctctgaggcagcaggcagccctgcccgaaaggtgaagatgcggcggcactgagtctacccgccgccctcctgggaactctggctcatccttacgtagttgcccctccttttgttttgagggttttgtttttgttcattggggggtttttgttttttgttttttgttttttttgattctatatatttttccttggttttgttgcctgttagggctgaagaatagaattggccaggacctaggttctcatattcttggtattcctcctggatggaaaggctgttggcatcaataggggacagaggctgatgctggagtggccagtagaggtggtggagcagagcagccatcttttaagtggggctgtatcaggctgggtttatttaaaagcaacaaaatgttttggttaagaaaattattttgctttcagtgtaaatcttcgcagtgttctaaacaaagttcagtcttctgctcgcccctttccctcactgatgtctgcacttggttgaggtctcctggagcctcacaggctctgctgttctccacttctcacctgccatccacgccctgcaagctcatgcaaacaccctttcttcctcctgcggcagagttgttcaggttgcctgggcaggggcttaaacagtgccagcccctgccatcccaaagctattgttaagccccccaggcgtcctccacccacgcccactagcctgccatgtccacagttccttgggctgctgaggggctagtgcagtggtcctgacctctcttatcaagagcacacttctttgctggttgctccttttgagcatatgcgtgtgattatttggaacagttagacttgccacgttgggtcagttttagaaattgtttctagctagagggactggtgtccttccaagtctagcatttggggtatggaaaattgttgtggtgtgtggtagggtttttgttttcttttttgagttttttttccccctttagtctcctggctttttcctttcccttcccttctccactggccagcttgggcctcatcctcatgtcatccttcta

SEQ ID NO: 106615 - DNA, 955 bp, Homo sapiens
  Payload ID: 938
  Gene Symbol: ALKBH6
  Gene Name: alkB homolog 6
  Uniprot ID: Q3KRA9
  ENST ID: ENST00000252984
  CDS Start-End: 154-870
gggagggggatggggatgttgaatttggaaattggaggggacgctggtggacggggctctctgtgtggcttgtaagatgctgaagactcagattttagagaccaagtgcgtttcagaagagggctgaggattgggtgcaaggagttggtgttgatggaggagcaggacgccagagtcccagccctggaaccgttcagagtggagcaggcaccacctgtaatctactatgtccctgacttcatctccaaagaagaggaggagtatttgcttcgacaggtttttaatgccccaaagccaaagtggacccagctctctgggagaaagttacagaactggggtgggcttcctcatccccgagggatggttcctgagcggctgcccccatggctccagcgctacgtggacaaagtgtcaaacctcagcctctttggaggcctcccagctaaccatgtcctcgtgaaccagtatctgcctggggagggcatcatgccccacgaggacggaccactgtactacccgactgtcagcaccatcagcctgggctcccacaccgtgctggacttctacgagccgcggcggccagaggacgatgaccctacagaacagcctcggcctccgccccggcccaccacctcgctactgctggaaccgcgcagcctgctggtgctccgcggccccgcctacacgcgtcttctccacggcatcgccgccgcccgcgtagacgcgctggacgccgcctcctcgccgcccaatgcggcagcctgcccgtcggcgcggccgggagcctgcctggtgcgcggcacccgggtctcgctgaccatccgccgcgtgccccgcgtgctgcgcgccggcctcctgctgggcaagtgaccgccagggccgggacccctcggattcccaggttcctgcccctttggggctgctgtgactccgcgacctaggaaccgtgggcaaa

SEQ ID NO: 106616 - DNA, 973 bp, Homo sapiens
  Payload ID: 938
  Gene Symbol: ALKBH6
  Gene Name: alkB homolog 6
  Uniprot ID: Q3KRA9
  ENST ID: ENST00000378875
  CDS Start-End: 7-807
gcggaaatggctgggagggggatggggatgttgaatttggaaattggaggggacgctggtggacggattgggtgcaaggagttggtgttgatggaggagcaggacgccagagtcccagccctggaaccgttcagagtggagcaggcaccacctgtaatctactatgtccctgacttcatctccaaagaagaggaggagtatttgcttcgacaggtttttaatgccccaaagccaaagtggacccagctctctgggagaaagttacagaactggggtgggcttcctcatccccgagggatggttcctgagcggctgcccccatggctccagcgctacgtggacaaagtgtcaaacctcagcctctttggaggcctcccagctaaccatgtcctcgtgaaccagtatctgcctggggagggcatcatgccccacgaggacggaccactgtactacccgactgtcagcaccatcagcctgggctcccacaccgtgctggacttctacgagccgcggcggccagaggacgatgaccctacagaacagcctcggcctccgccccggcccaccacctcgctactgctggaaccgcgcagcctgctggtgctccgcggccccgcctacacgcgtcttctccacggcatcgccgccgcccgcgtagacgcgctggacgccgcctcctcgccgcccaatgcggcagcctgcccgtcggcgcggccgggagcctgcctggtgcgcggcacccgggtctcgctgaccatccgccgcgtgccccgcgtgctgcgcgccggcctcctgctgggcaagtgaccgccagggccgggacccctcggattcccaggttcctgcccctttggggctgctgtgactccgcgacctaggaaccgtgggcaaagggggctcccctgggttatttattttcccaataattttgtgtgagctacagaagaccccataccaaataaacaaaaaaatc

SEQ ID NO: 106617 - DNA, 553 bp, Homo sapiens
  Payload ID: 938
  Gene Symbol: ALKBH6
  Gene Name: alkB homolog 6
  ENST ID: ENST00000481257
  CDS Start-End: 1-152
tggaaattggaggggacgctggtggacggattgggtgcaaggagttggtgttgatggaggagcaggacgccagagtcccagccctggaaccgttcagagtggagcaggttgtcagaactcagggcaccacctgtaatctactatgtccctgacttcatctccaaagaagaggaggagtatttgcttcgacaggtttttaatgccccaaagccaaagtggacccagctctctgggagaaagttacagaactggggtgggcttcctcatccccgagggatggttcctgagcggctgcccccatggctccagcgctacgtggacaaagtgtcaaacctcagcctctttggaggcctcccagctaaccatgtcctcgtgaaccagtatctgcctggggagggcatcatggcattcacctccctgtccctggcttgggaagcccccctttgacccagagggtgggggttgtggactcctgccctgcccagccctggtgcccactccctagccccacgaggacggaccactgtactacccgactgtcagcaccatcagc

SEQ ID NO: 106618 - DNA, 861 bp, Homo sapiens
  Payload ID: 938
  Gene Symbol: ALKBH6
  Gene Name: alkB homolog 6
  ENST ID: ENST00000490483
  CDS Start-End: 1-282
tggtggacggcaccacctgtaatctactatgtccctgacttcatctccaaagaagaggaggagtatttgcttcgacaggtttttaatgccccaaagccaaagtggacccagctctctgggagaaagttacagaactggggaccccattgccttccccaggtgggcttcctcatccccgagggatggttcctgagcggctgcccccatggctccagcgctacgtggacaaagtgtcaaacctcagcctctttggaggcctcccagctaaccatgtcctcgtgaaccagtatctgcctggggagggcatcatgccccacgaggacggaccactgtactacccgactgtcagcaccatcagcctgggctcccacaccgtgctggacttctacgagccgcggcggccagaggacgatgaccctacagaacagcctcggcctccgccccggcccaccacctcgctactgctggaaccgcgcagcctgctggtgctccgcggccccgcctacacgcgtcttctccacggcatcgccgccgcccgcgtagacgcgctggacgccgcctcctcgccgcccaatgcggcagcctgcccgtcggcgcggccgggagcctgcctggtgcgcggcacccgggtctcgctgaccatccgccgcgtgccccgcgtgctgcgcgccggcctcctgctgggcaagtgaccgccagggccgggacccctcggattcccaggttcctgcccctttggggctgctgtgactccgcgacctaggaaccgtgggcaaagggggctcccctgggttatttattttcccaataattttgtgtgagctacagaagaccccataccaaataaacaaaaaaatcttt

SEQ ID NO: 106619 - DNA, 793 bp, Homo sapiens
  Payload ID: 938
  Gene Symbol: ALKBH6
  Gene Name: alkB homolog 6
  ENST ID: ENST00000461668
  CDS Start-End: 1-142
gattgggtgcaaggagttggtgttgatggaggagcaggacgccagagtcccagccctggaaccgttcagagtggagcaggttgtcagaactcagggtgcagagggtgaaggaggcaccacctgtaatctactatgtccctgacttcatctccaaagaagaggaggagtatttgcttcgacaggtttttaatgccccaaagccaaagtggacccagctctctgggagaaagttacagaactgggccccacgaggacggaccactgtactacccgactgtcagcaccatcagcctgggctcccacaccgtgctggacttctacgagccgcggcggccagaggacgatgaccctacagaacagcctcggcctccgccccggcccaccacctcgctactgctggaaccgcgcagcctgctggtgctccgcggccccgcctacacgcgtcttctccacggcatcgccgccgcccgcgtagacgcgctggacgccgcctcctcgccgcccaatgcggcagcctgcccgtcggcgcggccgggagcctgcctggtgcgcggcacccgggtctcgctgaccatccgccgcgtgccccgcgtgctgcgcgccggcctcctgctgggcaagtgaccgccagggccgggacccctcggattcccaggttcctgcccctttggggctgctgtgactccgcgacctaggaaccgtgggcaaagggggctcccctgggttatttattttcccaataattttgtgtgagctacagaagaccccataccaaataaacaaaaaaatcttt

SEQ ID NO: 106620 - DNA, 977 bp, Homo sapiens
  Payload ID: 938
  Gene Symbol: ALKBH6
  Gene Name: alkB homolog 6
  ENST ID: ENST00000490986
  CDS Start-End: 1-398
tgaatttggaaattggaggggacgctggtggacggattgggtgcaaggagttggtgttgatggaggagcaggacgccagagtcccagccctggaaccgttcagagtggagcaggcaccacctgtaatctactatgtccctgacttcatctccaaagaagaggaggagtatttgcttcgacaggtttttaatgccccaaagccaaagtggacccagctctctgggagaaagttacagaactggggggggccctcaggaccccattgccttccccaggtgggcttcctcatccccgagggatggttcctgagcggctgcccccatggctccagcgctacgtggacaaagtgtcaaacctcagcctctttggaggcctcccagctaaccatgtcctcgtgaaccagtatctgcctggggagggcatcatgccccacgaggacggaccactgtactacccgactgtcagcaccatcagcctgggctcccacaccgtgctggacttctacgagccgcggcggccagaggacgatgaccctacagaacagcctcggcctccgccccggcccaccacctcgctactgctggaaccgcgcagcctgctggtgctccgcggccccgcctacacgcgtcttctccacggcatcgccgccgcccgcgtagacgcgctggacgccgcctcctcgccgcccaatgcggcagcctgcccgtcggcgcggccgggagcctgcctggtgcgcggcacccgggtctcgctgaccatccgccgcgtgccccgcgtgctgcgcgccggcctcctgctgggcaagtgaccgccagggccgggacccctcggattcccaggttcctgcccctttggggctgctgtgactccgcgacctaggaaccgtgggcaaagggggctcccctgggttatttattttcccaataattttgtgtgagctacagaagaccccataccaaataaacaaaaaaatcttt

SEQ ID NO: 106621 - DNA, 725 bp, Homo sapiens
  Payload ID: 938
  Gene Symbol: ALKBH6
  Gene Name: alkB homolog 6
  ENST ID: ENST00000497999
  CDS Start-End: 1-218
gggacgctggtggacggattgggtgcaaggagttggtgttgatggaggagcaggacgccagagtcccagccctggaaccgttcagagtggagcaggcaccacctgtaatctactatgtccctgacttcatctccaaagaagaggaggagtatttgcttcgacaggtgacctcagtgccctactggtgggcttcctcatccccgagggatggttcctgagcggctgcccccatggctccagcgctacgtggacaaagtgtcaaacctcagcctctttggaggcctcccagctaaccatgtcctcgtgaaccagtatctgcctggggagggcatcatgccccacgaggacggaccactgtactacccgactgtcagcaccatcagcctgggctcccacaccgtgctggacttctacgagccgcggcggccagaggacgatgaccctacagaacagcctcggcctccgccccggcccaccacctcgctactgctggaaccgcgcagcctgctggtgctccgcggccccgcctacacgcgtcttctccacggcatcgccgccgcccgcgtagacgcgctggacgccgcctcctcgccgcccaatgcggcagcctgcccgtcggcgcggccgggagcctgcctggtgcgcggcacccgggtctcgctgaccatccgccgcgtgccccgcgtgctgcgcgccggcctcctgctgggcaagtgaccgccagg

SEQ ID NO: 106622 - DNA, 959 bp, Homo sapiens
  Payload ID: 938
  Gene Symbol: ALKBH6
  Gene Name: alkB homolog 6
  ENST ID: ENST00000485128
  CDS Start-End: 166-567
gcggaaatggctgggagggggatggggatgttgaatttggaaattggaggggacgctggtggacggggctctctgtgtggcttgtaagatgctgaagactcagattttagagaccaagtgcgtttcagaagagggctgaggattgggtgcaaggagttggtgttgatggaggagcaggacgccagagtcccagccctggaaccgttcagagtggagcaggcaccacctgtaatctactatgtccctgacttcatctccaaagaagaggaggagtatttgcttcgacaggtttttaatgccccaaagccaaagtggacccagctctctgggagaaagttacagaactggggtgggcttcctcatccccgagggatggttcctgagcggctgcccccatggctccagcgctacgtggacaaagtgtcaaacctcagcctctttggaggcctcccagctaaccatgtcctcgtgaaccagtatctgcctggggagggcatcatgcaccatcagcctgggctcccacaccgtgctggacttctacgagccgcggcggccagaggacgatgaccctacagaacagcctcggcctccgccccggcccaccacctcgctactgctggaaccgcgcagcctgctggtgctccgcggccccgcctacacgcgtcttctccacggcatcgccgccgcccgcgtagacgcgctggacgccgcctcctcgccgcccaatgcggcagcctgcccgtcggcgcggccgggagcctgcctggtgcgcggcacccgggtctcgctgaccatccgccgcgtgccccgcgtgctgcgcgccggcctcctgctgggcaagtgaccgccagggccgggacccctcggattcccaggttcctgcccctttggggctgctgtgactccgcgacctaggaaccgtgggcaaagggggctcccctgggttatttattttccca

SEQ ID NO: 106623 - DNA, 1525 bp, Homo sapiens
  Payload ID: 938
  Gene Symbol: ALKBH6
  Gene Name: alkB homolog 6
  ENST ID: ENST00000486389
  CDS Start-End: 750-1082
ggaaatggctgggagggggatggggatgttgaatttggaaattggaggggacgctggtggacggtcagttttggggagtgctgggggtagagatggatgtcaatagggctgaaagtggggatccgggggagcccagagtaggagtccgaggaggctcagagcttggagtcctaaaaggctcggagtcggggatctgaatggttcagggagggaagaagatttgggagtcagcctcagagctaaagatctcagggtgctggagtgaaggggcgctcaggaggggaaatccgaggggcgtccaaatggggggatccgaggaggctgagggtggacatgtctgaggaggctcagattggggtcacaggagtgcacagaatgggattcggtggggggcgggggtcgctgagtgttgatagccgggctcacagttgcaggtctgaagcggggtctcaaggtgtttaaaggggctctggagtgcagccctgggggctatgtgtagagcttttgagaaaggctccctgtgtgtggggccagagaatgttctctgtgggaggattgagaaggcatatgtgtagttggatgggcccttagtggacagagtaatgggggattattcttggggctcattgtgtccgggcatggaacgtaggggctctctgtgtggcttgtaagatgctgaagactcagattttagagaccaagtgcgtttcagaagagggctgaggattgggtgcaaggagttggtgttgatggaggagcaggacgccagagtcccagccctggaaccgttcagagtggagcaggtttttaatgccccaaagccaaagtggacccagctctctgggagaaagttacagaactggggtgggcttcctcatccccgagggatggttcctgagcggctgcccccatggctccagcgctacgtggacaaagtgtcaaacctcagcctctttggaggcctcccagctaaccatgtcctcgtgaaccagtatctgcctggggagggcatcatgcaccatcagcctgggctcccacaccgtgctggacttctacgagccgcggcggccagaggacgatgaccctacagaacagcctcggcctccgccccggcccaccacctcgctactgctggaaccgcgcagcctgctggtgctccgcggccccgcctacacgcgtcttctccacggcatcgccgccgcccgcgtagacgcgctggacgccgcctcctcgccgcccaatgcggcagcctgcccgtcggcgcggccgggagcctgcctggtgcgcggcacccgggtctcgctgaccatccgccgcgtgccccgcgtgctgcgcgccggcctcctgctgggcaagtgaccgccagggccgggacccctcggattcccaggttcctgcccctttggggctgctgtgactccgcgacctaggaaccgtgggcaaagggggctcccctgggttatttattttcccaataattttgtgtgagctacagaagaccccataccaaataaacaaaaaaatc

SEQ ID NO: 106624 - DNA, 1332 bp, Homo sapiens
  Payload ID: 939
  Gene Symbol: ALKBH7
  Gene Name: alkB homolog 7
  Uniprot ID: Q9BT30
  ENST ID: ENST00000245812
  CDS Start-End: 389-1054
gactccataaccgtggccttggccccagtccccctgacttccggacttcagaccagatactgcccatatccccttatgaagtcttggccaggcaacccctagggtgtacgttttctaatgattaaagaggcggtgctaagctgcagacggacttgcgactcagccactggtgtaagtcaggcgggaggtggcgcccaataagctcaagagaggaggcgggttctggaaaaaggccaatagcctgtgaaggcgagtctagcagcaaccaatagctatgagcgagaggcgggactctgagggaagtcaatcgctgccgcaggtaccgccaatggcttttggcgggggcgttccccaaccctgccctctctcatgaccccgctccgggattatggccgggactgggctgctggcgctgcggacgctgccagggcccagctgggtgcgaggctcgggcccttccgtgctgagccgcctgcaggacgcggccgtggtgcggcctggcttcctgagcacggcagaggaggagacgctgagccgagaactggagcccgagctgcgccgccgccgctacgaatacgatcactgggacgcggccatccacggcttccgagagacagagaagtcgcgctggtcagaagccagccgggccatcctgcagcgcgtgcaggcggccgcctttggccccggccagaccctgctctcctccgtgcacgtgctggacctggaagcccgcggctacatcaagccccacgtggacagcatcaagttctgcggggccaccatcgccggcctgtctctcctgtctcccagcgttatgcggctggtgcacacccaggagccgggggagtggctggaactcttgctggagccgggctccctctacatccttaggggctcagcccgttatgacttctcccatgagatccttcgggatgaagagtccttctttggggaacgccggattccccggggccggcgcatctccgtgatctgccgctccctccctgagggcatggggccaggggagtctggacagccgcccccagcctgctgacccccagctttctacagacaccagatttgtgaataaagttggggaatggacagcctaactgggacattgcagtggctgcttgctggggccgggatttgcaggggaacccaggatggcactggcccatagggagctccaggtgtggctggctggacacatggtcaaagtcacaaggccgggagagtggtgtcctttattgcactcactgctggtcgccccagcccactcccctcctcgttgtctctgcatccaggtctccaataaataagtcagccgag

SEQ ID NO: 106625 - DNA, 603 bp, Homo sapiens
  Payload ID: 939
  Gene Symbol: ALKBH7
  Gene Name: alkB homolog 7
  ENST ID: ENST00000596657
  CDS Start-End: 310-549
ggagtcgggtgtagggttggggtgcgattacgctgctagcagttacagtgcagaagaacgtggcggctgggattggggcgtggtcaggccatccacggcttccgagagacagagaagtcgcgctggtcagaagccagccgggccatcctgcagcgcgtgcaggcggccgcctttggccccggccagaccctgctctcctccgtgcacgtgctggacctggaagcccgcggctacatcaagccccacgtggacagcatcaagttctgcggggccaccatcgccggcctgtctctcctgtctcccagcgttatgcggctggtgcacacccaggagccgggggagtggctggaactcttgctggagccgggctccctctacatccttaggggctcagcccgttatgacttctcccatgagatccttcgggatgaagagtccttctttggggaacgccggattccccggggccggcgcatctccgtgatctgccgctccctccctgagggcatggggccaggggagtctggacagccgcccccagcctgctgacccccagctttctacagacaccagatttgtgaataaagttggggaatggacagc

SEQ ID NO: 106626 - DNA, 556 bp, Homo sapiens
  Payload ID: 939
  Gene Symbol: ALKBH7
  Gene Name: alkB homolog 7
  ENST ID: ENST00000599849
  CDS Start-End: 16-498
gagacacatgctgggatggggcagggcctttttggggccatccacggcttccgagagacagagaagtcgcgctggtcagaagccagccgggccatcctgcagcgcgtgcaggcggccgcctttggccccggccagaccctgctctcctccgtgcacgtgctggacctggaagcccgcggctacatcaagccccacgtggacagcatcaagttctgcggggccaccatcgccggcctgtctctcctgtctcccagcgttatgcggctggtgcacacccaggagccgggggagtggctggaactcttgctggagccgggctccctctacatccttaggggctcagcccgttatgacttctcccatgagatccttcgggatgaagagtccttctttggggaacgccggattccccggggccggcgcatctccgtgatctgccgctccctccctgagggcatggggccaggggagtctggacagccgcccccagcctgctgacccccagctttctacagacaccagatttgtgaataaagttggggaatggacagcctaa

SEQ ID NO: 106627 - DNA, 1684 bp, Homo sapiens
  Payload ID: 940
  Gene Symbol: ALKBH8
  Gene Name: alkB homolog 8, tRNA methyltransferase
  Uniprot ID: Q96BT7
  ENST ID: ENST00000260318
  CDS Start-End: 108-824
ggcgtgcaagtatccgctgcggtgttctggtgctagagtggagaggctggcaaagaagaaggcacacgcatggtgagaatccggcctgagccgaagcggagtttgctatggacagcaaccatcaaagtaattacaaactcagtaaaactgagaagaagttcttaaggaaacagattaaagccaagcatactttgctgagacatgaaggcattgagacagtatcctatgccactcagagcctggttgttgccaatggtggtttgggtaatggtgtgagtcggaaccagctgctcccggttttagagaaatgtggactggtggatgctctcttaatgccacctaacaagccgtactcatttgcaagatacagaactacagaagaatctaagagagcctatgttaccctcaatggaaaagaagtagtggatgatttaggacaaaagatcactctgtatttgaattttgtggaaaaagtgcagtggaaggagttgaggcctcaagccttaccaccaggactcatggtagtagaagaaataatttcttctgaggaggagaaaatgcttttggaaagtgttgattggacagaagatacagacaatcaaaactctcaaaaatccttaaaacacagaagagtaaagcattttggttatgagttccactatgagaacaacaatgtagataaagataagccattatctgggggtcttcctgacatttgtgaaagctttttggagaaatggttgaggaaaggttacattaaacataaacctgatcaaatgaccataaatcagtatgaacctgggcaagattgtcatggattttaagcacccagatggcattgcagtgccagttatgttgcctcgtcggagtttgctggtgatgacaggagaatctagatacctttggacccatggaatcacgtgcagaaaatttgatactgttcaagcatctgagagtcttaaaagtggaattatcaccagtgatgttggagacttaactttaagcaagaggggactacgaacatcatttacatttaggaaagtgaggcaaacaccttgtaactgtagagcgtagagtggcagctctccaagaaattgttcgactcctgagaccaggtgggaaggcactcatttatgtctgggcaatggaacaagaatataataagcagaagtccaagtatcttagaggaaacagaaatagccaaggaaagaaagaggagatgaacagtgatacctcagtgcagaggtcacttgtggagcaaatgcgtgacatgggcagtcgagactcggcatcttctgtcccccgcattaatgactctcaggaaggaggatgtaattcaaggcaagtttctaattccaagctgcctgttcatgttaacaggacttctttttattctcaagatgtactggttccctggcaccttaagggaaatcctgataaaggcaaacctgttgagccatttggtcccataggatcccaggacccaagtcctgtgtttcatcgttactaccatgtgttccgtgagggagaactggaaggtgcctgcaggactgtgagtgatgtcagaattctgcaaagctactacgatcaaggaaactggtgtgtgattcttcaaaaggcctgattatttacctgaacacatcatatataaagaagaaatgctcacttaaaaaaaaagagagaa

SEQ ID NO: 106628 - DNA, 2491 bp, Homo sapiens
  Payload ID: 940
  Gene Symbol: ALKBH8
  Gene Name: alkB homolog 8, tRNA methyltransferase
  Uniprot ID: Q96BT7
  ENST ID: ENST00000389568
  CDS Start-End: 434-2428
gccttgccagctagggctgagaacctagggaaaggggatggatcccagaggcgcccttggtgcagtctgagtcttcctgtgctcttatttgagcaatccctgcgactcctggacctctgtgtttgctcatgtgaaatattaaaaattctgtagtgcagtcatcccttgttctccatgacatactgcaaagttgctgttccacagatgaagatcttgaaatggaatggctctaaaatagctcctttgaagggcctcagatattctttgttttgttaagccattttgatctgctgcttctgaaaatcaacacctagatcaggccagcatttctaattaacaagctggattattattattattttttttacctctcatctctctgctatgctgccagccagcctgcctgcctcactggccttacatcctatttgctatggacagcaaccatcaaagtaattacaaactcagtaaaactgagaagaagttcttaaggaaacagattaaagccaagcatactttgctgagacatgaaggcattgagacagtatcctatgccactcagagcctggttgttgccaatggtggtttgggtaatggtgtgagtcggaaccagctgctcccggttttagagaaatgtggactggtggatgctctcttaatgccacctaacaagccgtactcatttgcaagatacagaactacagaagaatctaagagagcctatgttaccctcaatggaaaagaagtagtggatgatttaggacaaaagatcactctgtatttgaattttgtggaaaaagtgcagtggaaggagttgaggcctcaagccttaccaccaggactcatggtagtagaagaaataatttcttctgaggaggagaaaatgcttttggaaagtgttgattggacagaagatacagacaatcaaaactctcaaaaatccttaaaacacagaagagtaaagcattttggttatgagttccactatgagaacaacaatgtagataaagataagccattatctgggggtcttcctgacatttgtgaaagctttttggagaaatggttgaggaaaggttacattaaacataaacctgatcaaatgaccataaatcagtatgaacctgggcaaggaattcccgctcatattgatacacattccgcttttgaggatgagatcgtttctctcagtttggggtcagagattgtcatggattttaagcacccagatggcattgcagtgccagttatgttgcctcgtcggagtttgctggtgatgacaggagaatctagatacctttggacccatggaatcacgtgcagaaaatttgatactgttcaagcatctgagagtcttaaaagtggaattatcaccagtgatgttggagacttaactttaagcaagaggggactacgaacatcatttacatttaggaaagtgaggcaaacaccttgtaactgtagttacccgttggtctgtgatagccagaggaaagagactcccccctcatttccagagagtgataaagaagcctcacggctggagcaagagtacgtccatcaggtttatgaagagattgctgggcacttcagcagcacaagacataccccttggccgcacattgtggagtttttgaaggctttgccaagtggttcaatagtggctgatattggatgtggtaatggaaagtatcttggcatcaataaggagttatatatgattggttgtgatcgtagccaaaaccttgtggacatttgtagagagaggcaatttcaggcttttgtctgtgatgcattggcagtaccagtccgcagtgggtcttgtgatgcctgcatctccattgctgttattcatcattttgcaacagcagagcgtagagtggcagctctccaagaaattgttcgactcctgagaccaggtgggaaggcactcatttatgtctgggcaatggaacaagaatataataagcagaagtccaagtatcttagaggaaacagaaatagccaaggaaagaaagaggagatgaacagtgatacctcagtgcagaggtcacttgtggagcaaatgcgtgacatgggcagtcgagactcggcatcttctgtcccccgcattaatgactctcaggaaggaggatgtaattcaaggcaagtttctaattccaagctgcctgttcatgttaacaggacttctttttattctcaagatgtactggttccctggcaccttaagggaaatcctgataaaggcaaacctgttgagccatttggtcccataggatcccaggacccaagtcctgtgtttcatcgttactaccatgtgttccgtgagggagaactggaaggtgcctgcaggactgtgagtgatgtcagaattctgcaaagctactacgatcaaggaaactggtgtgtgattcttcaaaaggcctgattatttacctgaacacatcatatataaagaagaaatgctcacttaaaaaaaaagagagaataa

SEQ ID NO: 106629 - DNA, 999 bp, Homo sapiens
  Payload ID: 940
  Gene Symbol: ALKBH8
  Gene Name: alkB homolog 8, tRNA methyltransferase
  ENST ID: ENST00000393100
  CDS Start-End: 141-575
gttttctccaacatggccgcgcccaggggagatggcgtgcaagtatccgctgcggtgttctggtgctagagtggagaggctggcaaagaagaaggcacacgcatggtgagaatccggcctgagccgaagcggagtttgctatggacagcaaccatcaaagtaattacaaactcagtaaaactgagaagaagttcttaaggaaacagattaaagccaagcatactttgctgagacatgaaggcattgagacagtatcctatgccactcagagcctggttgttgccaatggtggtttgggtaatggtgtgagtcggaaccagctgctcccggttttagagaaatgtggactggtggatgctctcttaatgccacctaacaagccgtactcatttgcaagatacagaactacagaagaatctaagagagcctatgttaccctcaatggaaaagaagtagtggatgatttaggacaaaagatcactctgtatttgaattttgtggaaaaagtggaaggagttgaggcctcaagccttaccaccaggactcatggtagtagaagaaataatttcttctgaggaggagaaaatgcttttggaaagtgttgattggacagaagatacagacaatcaaaactctcaaaaatccttaaaacacagaagagtaaagcattttggttatgagttccactatgagaacaacaatgtagataaagataagccattatctgggggtcttcctgacatttgtgaaagctttttggagaaatggttgaggaaaggttacattaaacataaacctgatcaaatgaccataaatcagtatgaacctgggcaaggaattcccgctcatattgatacacattccgcttttgaggatgagatcgtttctctcagtttggggtcagagattgtcatggattttaagcacccagatggcattgcagtgccagttatgttgcctcgtcggagtttgctggtgatgacaggagaatctagatac

SEQ ID NO: 106630 - DNA, 2296 bp, Homo sapiens
  Payload ID: 940
  Gene Symbol: ALKBH8
  Gene Name: alkB homolog 8, tRNA methyltransferase
  Uniprot ID: Q96BT7
  ENST ID: ENST00000429370
  CDS Start-End: 142-816
agttttctccaacatggccgcgcccaggggagatggcgtgcaagtatccgctgcggtgttctggtgctagagtggagaggctggcaaagaagaaggcacacgcatggtgagaatccggcctgagccgaagcggagtttgctatggacagcaaccatcaaagtaattacaaactcagtaaaactgagaagaagttcttaaggaaacagattaaagccaagcatactttgctgagacatgaaggcattgagacagtatcctatgccactcagagcctggttgttgccaatggtggtttgggtaatggtgtgagtcggaaccagctgctcccggttttagagaaatgtggactggtggatgctctcttaatgccacctaacaagccgtactcatttgcaagatacagaactacagaagaatctaagagagcctatgttaccctcaatggaaaagaagtagtggatgatttaggacaaaagatcactctgtatttgaattttgtggaaaaagtgcagtggaaggagttgaggcctcaagccttaccaccaggactcatggtagtagaagaaataatttcttctgaggaggagaaaatgcttttggaaagtgttgattggacagaagatacagacaatcaaaactctcaaaaatccttaaaacacagaagagtaaagcattttggttatgagttccactatgagaacaacaatgtagataaagataagccattatctgggggtcttcctgacatttgtgaaagctttttggagaaatggttgaggaaagctgagaaaaatttggaagtagggattcattaggagacattcaaatgtctcctgttggctgacatcacagatgtggtgttggctcctcctacttccctaggagaggtggtttctaaaagtgattgaagcagtttgtgcagtgtttgtaattcttgggtaagagcccaggattttgaagataatagttttttagtaaagtgctactaaatgtagtaaatcatgtaggattttagggatgtaattatatgttaatacagaaaatagtcctggtcaatagaaaattgtctgaagttttacctatgatttttagctctgtaaaatcatagacaataaccattctatttccatgcctgactagcccagggctggacgtatagcgggtgtccaataacgtttagtcaatcagataatacccagaacttagtaggagtttcattcaaaaactattttttgaacccaaccatgtaccagttactattttaagtactgataatgaagcagtgaataagaaagagcaaagctcttgcccttatggtgcttacattctagacggggagacagacagcaggcaaatcaataaatagatactatgtgccagatagtgataaatgccatgaaaaacataaaatgagagacgattcaccttggagcaaaagattacttttaagtgactgaaataactactaatcctgactaatttattatcaagagttaattggtattccaaattcattgagcagggtgctaaaaacaacccaaatgtgctcctttaactcctttgtttaaatgacaaaagttagaatgtggtcactcagacctaactgtgcccttagagccaaagctgtggtgtcattattggttatttctagttgattcatagtttgtcccaatccaggttcaatcgggttatttttaagatctgtacaatattgcataatagtaacccagttaacttaccacttaggttagatttcctggaggaacaaaggtagaaattcaaccataggtcaaattatcacatagaaggaaaaggctttttttcaaagaaaaaattttttgaacactttactcccagtatgcattacttttgtagtagtaatgcttaagactgttttaaagaaaaattgctttctgtttaattaatgtttactgttattaatgctagtgatacttaatcttgaagcatcaagttttcagaaacctatagtgatcaataatgggtctcagatgagaggatgattatttttttcatggaatttcagtccaacatcctggtgtactggtccctctgggatgaatttataaggctcatgatataggaaaaggaatatagggctaaaaatagttttatttctgatataaattctggtacttgacaccaaagtttgaagtcaagtcatgccaataaattttaacatccaaatgaaatagatgattttctatgaagatgaaaaataccaaaattgactcaagaagggagagaaaatggaagatgttgaaaaatagcatagga

SEQ ID NO: 106631 - DNA, 2114 bp, Homo sapiens
  Payload ID: 940
  Gene Symbol: ALKBH8
  Gene Name: alkB homolog 8, tRNA methyltransferase
  Uniprot ID: Q96BT7
  ENST ID: ENST00000417449
  CDS Start-End: 111-2114
gtagtgcagttttctccaacatggccgcgcccaggggagatggcgtgcaagtatccgctgcggtgttctggtgctagagtggagaggctggcaaagaagaaggcacacgcatgtttgctatggacagcaaccatcaaagtaattacaaactcagtaaaactgagaagaagttcttaaggaaacagattaaagccaagcatactttgctgagacatgaaggcattgagacagtatcctatgccactcagagcctggttgttgccaatggtggtttgggtaatggtgtgagtcggaaccagctgctcccggttttagagaaatgtggactggtggatgctctcttaatgccacctaacaagccgtactcatttgcaagatacagaactacagaagaatctaagagagcctatgttaccctcaatggaaaagaagtagtggatgatttaggacaaaagatcactctgtatttgaattttgtggaaaaagtgcagtggaaggagttgaggcctcaagccttaccaccaggactcatggtagtagaagaaataatttcttctgaggaggagaaaatgcttttggaaagtgttgattggacagaagatacagacaatcaaaactctcaaaaatccttaaaacacagaagagtaaagcattttggttatgagttccactatgagaacaacaatgtagataaagataagccattatctgggggtcttcctgacatttgtgaaagctttttggagaaatggttgaggaaaggttacattaaacataaacctgatcaaatgaccataaatcagtatgaacctgggcaaggaattcccgctcatattgatacacattccgcttttgaggatgagatcgtttctctcagtttggggtcagagattgtcatggattttaagcacccagatggcattgcagtgccagttatgttgcctcgtcggagtttgctggtgatgacaggagaatctagatacctttggacccatggaatcacgtgcagaaaatttgatactgttcaagcatctgagagtcttaaaagtggaattatcaccagtgatgttggagacttaactttaagcaagaggggactacgaacatcatttacatttaggaaagtgaggcaaacaccttgtaactgtagttacccgttggtctgtgatagccagaggaaagagactcccccctcatttccagagagtgataaagaagcctcacggctggagcaagagtacgtccatcaggtttatgaagagattgctgggcacttcagcagcacaagacataccccttggccgcacattgtggagtttttgaaggctttgccaagtggttcaatagtggctgatattggatgtggtaatggaaagtatcttggcatcaataaggagttatatatgattggttgtgatcgtagccaaaaccttgtggacatttgtagagagaggcaatttcaggcttttgtctgtgatgcattggcagtaccagtccgcagtgggtcttgtgatgcctgcatctccattgctgttattcatcattttgcaacagcagagcgtagagtggcagctctccaagaaattgttcgactcctgagaccaggtgggaaggcactcatttatgtctgggcaatggaacaagaatataataagcagaagtccaagtatcttagaggaaacagaaatagccaaggaaagaaagaggagatgaacagtgatacctcagtgcagaggtcacttgtggagcaaatgcgtgacatgggcagtcgagactcggcatcttctgtcccccgcattaatgactctcaggaaggaggatgtaattcaaggcaagtttctaattccaagctgcctgttcatgttaacaggacttctttttattctcaagatgtactggttccctggcaccttaagggaaatcctgataaaggcaaacctgttgagccatttggtcccataggatcccaggacccaagtcctgtgtttcatcgttactaccatgtgttccgtgagggagaactggaaggtgcctgcaggactgtgagtgatgtcagaattctgcaaagctactacgatcaaggaaactggtgtgtgattcttcaaaaggcctga

SEQ ID NO: 106632 - DNA, 4079 bp, Homo sapiens
  Payload ID: 940
  Gene Symbol: ALKBH8
  Gene Name: alkB homolog 8, tRNA methyltransferase
  Uniprot ID: Q96BT7
  ENST ID: ENST00000428149
  CDS Start-End: 153-2147
aaatgtagtgcagttttctccaacatggccgcgcccaggggagatggcgtgcaagtatccgctgcggtgttctggtgctagagtggagaggctggcaaagaagaaggcacacgcatggtgagaatccggcctgagccgaagcggagtttgctatggacagcaaccatcaaagtaattacaaactcagtaaaactgagaagaagttcttaaggaaacagattaaagccaagcatactttgctgagacatgaaggcattgagacagtatcctatgccactcagagcctggttgttgccaatggtggtttgggtaatggtgtgagtcggaaccagctgctcccggttttagagaaatgtggactggtggatgctctcttaatgccacctaacaagccgtactcatttgcaagatacagaactacagaagaatctaagagagcctatgttaccctcaatggaaaagaagtagtggatgatttaggacaaaagatcactctgtatttgaattttgtggaaaaagtgcagtggaaggagttgaggcctcaagccttaccaccaggactcatggtagtagaagaaataatttcttctgaggaggagaaaatgcttttggaaagtgttgattggacagaagatacagacaatcaaaactctcaaaaatccttaaaacacagaagagtaaagcattttggttatgagttccactatgagaacaacaatgtagataaagataagccattatctgggggtcttcctgacatttgtgaaagctttttggagaaatggttgaggaaaggttacattaaacataaacctgatcaaatgaccataaatcagtatgaacctgggcaaggaattcccgctcatattgatacacattccgcttttgaggatgagatcgtttctctcagtttggggtcagagattgtcatggattttaagcacccagatggcattgcagtgccagttatgttgcctcgtcggagtttgctggtgatgacaggagaatctagatacctttggacccatggaatcacgtgcagaaaatttgatactgttcaagcatctgagagtcttaaaagtggaattatcaccagtgatgttggagacttaactttaagcaagaggggactacgaacatcatttacatttaggaaagtgaggcaaacaccttgtaactgtagttacccgttggtctgtgatagccagaggaaagagactcccccctcatttccagagagtgataaagaagcctcacggctggagcaagagtacgtccatcaggtttatgaagagattgctgggcacttcagcagcacaagacataccccttggccgcacattgtggagtttttgaaggctttgccaagtggttcaatagtggctgatattggatgtggtaatggaaagtatcttggcatcaataaggagttatatatgattggttgtgatcgtagccaaaaccttgtggacatttgtagagagaggcaatttcaggcttttgtctgtgatgcattggcagtaccagtccgcagtgggtcttgtgatgcctgcatctccattgctgttattcatcattttgcaacagcagagcgtagagtggcagctctccaagaaattgttcgactcctgagaccaggtgggaaggcactcatttatgtctgggcaatggaacaagaatataataagcagaagtccaagtatcttagaggaaacagaaatagccaaggaaagaaagaggagatgaacagtgatacctcagtgcagaggtcacttgtggagcaaatgcgtgacatgggcagtcgagactcggcatcttctgtcccccgcattaatgactctcaggaaggaggatgtaattcaaggcaagtttctaattccaagctgcctgttcatgttaacaggacttctttttattctcaagatgtactggttccctggcaccttaagggaaatcctgataaaggcaaacctgttgagccatttggtcccataggatcccaggacccaagtcctgtgtttcatcgttactaccatgtgttccgtgagggagaactggaaggtgcctgcaggactgtgagtgatgtcagaattctgcaaagctactacgatcaaggaaactggtgtgtgattcttcaaaaggcctgattatttacctgaacacatcatatataaagaagaaatgctcacttaaaaaaaaagagagaataaattaattacccttttaattaaagagaaaacttgtgggaaagtaccaaaggaaagctgagaaaaatttggaagtagggattcattaggagacattcaaatgtctcctgttggctgacatcacagatgtggtgttggctcctcctacttccctaggagaggtggtttctaaaagtgattgaagcagtttgtgcagtgtttgtaattcttgggtaagagcccaggattttgaagataatagttttttagtaaagtgctactaaatgtagtaaatcatgtaggattttagggatgtaattatatgttaatacagaaaatagtcctggtcaatagaaaattgtctgaagttttacctatgatttttagctctgtaaaatcatagacaataaccattctatttccatgcctgactagcccagggctggacgtatagcgggtgtccaataacgtttagtcaatcagataatacccagaacttagtaggagtttcattcaaaaactattttttgaacccaaccatgtaccagttactattttaagtactgataatgaagcagtgaataagaaagagcaaagctcttgcccttatggtgcttacattctagacggggagacagacagcaggcaaatcaataaatagatactatgtgccagatagtgataaatgccatgaaaaacataaaatgagagacgattcaccttggagcaaaagattacttttaagtgactgaaataactactaatcctgactaatttattatcaagagttaattggtattccaaattcattgagcagggtgctaaaaacaacccaaatgtgctcctttaactcctttgtttaaatgacaaaagttagaatgtggtcactcagacctaactgtgcccttagagccaaagctgtggtgtcattattggttatttctagttgattcatagtttgtcccaatccaggttcaatcgggttatttttaagatctgtacaatattgcataatagtaacccagttaacttaccacttaggttagatttcctggaggaacaaaggtagaaattcaaccataggtcaaattatcacatagaaggaaaaggctttttttcaaagaaaaaattttttgaacactttactcccagtatgcattacttttgtagtagtaatgcttaagactgttttaaagaaaaattgctttctgtttaattaatgtttactgttattaatgctagtgatacttaatcttgaagcatcaagttttcagaaacctatagtgatcaataatgggtctcagatgagaggatgattatttttttcatggaatttcagtccaacatcctggtgtactggtccctctgggatgaatttataaggctcatgatataggaaaaggaatatagggctaaaaatagttttatttctgatataaattctggtacttgacaccaaagtttgaagtcaagtcatgccaataaattttaacatccaaatgaaatagatgattttctatgaagatgaaaaataccaaaattgactcaagaagggagagaaaatggaagatgttgaaaaatagcataggaattcagaactgggctctagaatcagatttcctgagagttgaattctagatctgccatttattagctgtgggattttgggcaaatttcttgactttctgtgcttcagttttcttagctgtaaaattggaagagttgttatgaaaattcactgaaagtatatttgtatacatcataggatagtgtaagaatatagtatggctttgagaaatgttcattattattactcccagaggagttttaggtattaagtgatgccaaatataatttgttaattgtataataaaaatctatattcttactgac

SEQ ID NO: 106633 - DNA, 2475 bp, Homo sapiens
  Payload ID: 941
  Gene Symbol: AGMO
  Gene Name: alkylglycerol monooxygenase
  Uniprot ID: Q6ZNB7
  ENST ID: ENST00000342526
  CDS Start-End: 171-1508
ctctctacacagaatcggctgttgagtgtgctctcagtggagctttggttttagctgttctctgacaaagagcttgttctgagctgcacatctcgtcctctttgttcagcctcaggcttcaagcattgaatcctaaatattctccagctgggaatcagacaagggcagaaatgaagaacccagaagcccagcaggatgtttcagtttcccagggatttcgcatgttgttttacacgatgaaacccagtgaaacttcattccaaacattagaagaggtgcctgattatgtaaaaaaggcaactccatttttcatttctttgatgctgcttgaacttgttgtcagctggattctcaaaggaaagccaccaggtcgcctggatgatgctttaacgtcaatctcagctggtgttctgtctcgacttccaagtctatttttcaggagcattgaactgaccagttatatttatatctgggagaactacaggctgttcaatttgccttgggattctccatggacttggtattcagccttcttaggagttgactttggctactactggttccatcgtatggctcatgaagttaatattatgtgggccggacaccaaacacatcatagttctgaagactataacttatccacagcactgagacagtctgtcctccagatatatacttcctggattttctactctcccctggccctcttcatacccccttcagtatatgctgttcatcttcaattcaatcttctttaccaattttggatccatacagaggtcatcaataaccttggtcctttggaactgattcttaatactcctagccatcatagggttcatcatggcagaaatcgttattgcatagacaaaaattatgctggtgttcttattatttgggataaaatttttgggacatttgaagcagaaaatgaaaaagttgtatatggcttaacacatcccattaatacatttgaaccaatcaaagtgcagttccatcacttattttccatatggactacattctgggccacacctggattcttcaataagttttctgtcatatttaagggaccgggatggggtccaggtaaaccaagacttggtctcagtgaagaaattccagaggtcaccggcaaagaagttcccttctcatcatcttcatctcagctattaaagatatatacagttgtacagtttgctctgatgttggcattttatgaagagacctttgcagatacagctgcactgtcgcaagttactctccttctgagggtttgcttcattatcctgaccttgacttccattggatttcttctggatcaaagacccaaggcagctattatggaaactctccgttgcttgatgttcttaatgctgtaccgatttggtcacctgaagcctcttgtcccttcattgtcatctgcttttgagattgttttttccatttgcattgctttctggggagttagaagcatgaaacaactcacctctcacccttggaaataacctgaatttgtacataattctcttcttttaatgagttgtccacacgcatattatgactgcatattaaaatgtaattattttatgtaatgcttatatgaactatttcttcaatgaaaagtaaaattacttatttactattgtttgcctttcacatttgttattttctattaaaaattaaagtcagttttggttacttcccccctttactacaattaaaaaaagatttcaaatataatgatgttatattaactgatagccttatatgacaagtataaaaagaagggatgaaacttaaaaacagtaaaaacaagaaggaatattgcctttacatcaatttgaaaacaatgtttcctttgatgtttgctaaaattatgcatagatacatgtttgtagtcataaaaatgtattacattggttgtcttcctaaggccacagttacctttgcaatccatataacctaagaagctgcattccagaaaaagacatcactgaggccaggcgcggtggctcacccctgtaatcccagcactttgtggggctgaggtgggcggatcatgaggtccagagatagagaccatcctggccaacatggtgaagtcctgtctctactaaaaatataaaaatttagctggacatggtggtgtgcgcctgtagtcccagctactctggaggctgaggcaggagaatcgcttgaacctgggaggcagaagttggagtgagtggagattgcaccactgcactccagcctgggcgacagagcgagactccgtctcaaagaaaaaagacatcactgaaagaaaaatgaacagaatttgtcagaattagttttttcaacaggttactttgtcatacatttctctaatatgcttggtcaatttgttttggcagactgggcagcatgcagcaattctgcattatttaaagttatcagaacaatgttaattctctaaataaaattacccaaggt

SEQ ID NO: 106634 - DNA, 485 bp, Homo sapiens
  Payload ID: 941
  Gene Symbol: AGMO
  Gene Name: alkylglycerol monooxygenase
  ENST ID: ENST00000407277
  CDS Start-End: 1-262
cttcattatcctgaccttgacttccattggatttcttctggatcaaagacccaaggcagctattatggaaactctccgttgcttgatgttcttaatgctgtaccgatttggtcacctgaagcctcttgtcccttcattgtcatctgcttttgagtcatattctgttataagtgaaattgggctccaggccaaggagaactttggagaacttttaagtttgagtgactgtctcacagctggaaaccaccccaaagtgcattgattgcagaagaatatgtttcctattatccagttctctaccaaactatttttttgtagcttgaaaataataaagattttgtaagccccaaggggtctttttgatccatgaatgaagttaccctggattcatataactaaaatctgacttcctttcagccattgaaattcaaaaccctttccatttattagtatgaaataaaaaaagaccttcaaaaatgtcaaaa

SEQ ID NO: 106635 - DNA, 421 bp, Homo sapiens
  Payload ID: 941
  Gene Symbol: AGMO
  Gene Name: alkylglycerol monooxygenase
  ENST ID: ENST00000418075
  CDS Start-End: 1-225
gcactgtcgcaagttactctccttctgagggtttgcttcattatcctgaccttgacttccattggatttcttctggatcaaagacccaaggcagctattatggaaactctccgttgcttgatgttcttaatgctgtaccgatttggtcacctgaagcctcttgtcccttcattgtcatctgcttttgaggaaacaccctacttgtcttccaactctgcaatctaattattatgccttcttattatcctttccacgttatcatctcgtctgggcagctcttttgaaaaagcattaacccaaggttaacaatttgctgcctcagccattttatgtgcagaagaaaccaatactcaaagcagcaaccttaagactcttcaatttttattgatctattcaataaatattaaatgtgcactgacaa

SEQ ID NO: 106636 - DNA, 7764 bp, Homo sapiens
  Payload ID: 942
  Gene Symbol: AGPS
  Gene Name: alkylglycerone phosphate synthase
  Uniprot ID: O00116
  ENST ID: ENST00000264167
  CDS Start-End: 147-2123
gtgaagctccagacgcatggcacccgccgccaagtcgccgcggtggctgccgggatgcgccgcagcgaatggtcgcgccgggcgccgctctgagtgacctttcacccgcgcccagcggttccgggcggcagcacaaggcggtagccatggcggaggcggcggctgcagcgggtgggactggcttgggcgcgggcgcgagctacgggtctgcagcggaccgggaccgggacccggacccggaccgcgccgggcggaggctgcgggttctctctggccatctgctgggccggccccgggaggctctgagtaccaatgagtgcaaagcgcggagagccgcgtcggcggccacggcagcgcccacggccactcccgccgcgcaggagtcgggcaccatcccaaagaagcggcaagaagttatgaaatggaatggatggggatataatgattctaaattcatcttcaataagaagggccaaattgaattgactgggaaaaggtaccctcttagtggcatgggtttaccaacatttaaagaatggatccaaaatacccttggagtaaatgtggagcataaaactacctctaaagcatccttaaatcctagtgatacacctccttctgttgtaaatgaagattttcttcatgaccttaaagaaactaatatttcatattcacaagaggcagatgatcgagtatttagagctcatggtcattgtcttcatgagatatttttgctcagggaaggaatgtttgagcgaattcctgatatagttttatggccaacatgccatgatgatgtagttaagattgtgaatctagcttgcaaatataatctttgtatcataccaattggtggaggaacaagtgtttcatatggcctgatgtgtcctgcagatgagacaagaacaattatttctttggacacttcacaaatgaatcgaattctctgggttgatgagaacaatttgacagctcatgtagaggctggcataacaggacaagagttggaaagacagcttaaagaaagtggttattgtacaggtcatgaaccagattccctggagttcagtactgtaggaggatgggtatctactcgcgcatcaggcatgaagaagaatatctatggcaatatcgaggacctggtggttcatataaaaatggtaacacctagaggtataatagaaaaaagctgtcaaggacctcgtatgtcaacaggccctgatatccatcacttcatcatgggatctgaaggaactcttggtgtaataacagaagctacaataaaaatcagaccagtccctgaataccaaaagtatggctcagtagctttccctaattttgaacaaggagtagcctgtttaagagaaattgcaaaacagagatgtgctccggcatctattcgcctcatggacaacaagcagtttcagtttggtcatgctcttaaacctcaggtttcctctatttttacatcatttttggacggattaaaaaagttttatattacaaagtttaaaggatttgacccaaatcagctaagtgtagccacattactgtttgagggggatcgtgagaaggttcttcaacatgaaaaacaagtgtatgatattgctgcaaaatttggtgggttggcagctggagaagataatggacagagaggttatttgctgacctatgttattgcatacattcgagacttggctttggaatactatgtattaggagaatcttttgagacttctgctccttgggacagggtggtagatctctgtagaaatgtaaaagaaagaataacaagggaatgcaaagagaagggtgttcagtttgctcctttttctacatgcagggtgacgcagacttacgatgcaggtgcttgtatctacttctattttgcctttaactacaggggaattagtgacccactgaccgtatttgaacaaactgaggcagctgctagagaagaaatccttgctaatggagggagcctgtcacatcaccatggagtgggcaagttacggaagcaatggctaaaggaaagtatctctgatgtcggctttgggatgctgaagtctgtcaaggaatatgtggaccccaataacatctttggaaacagaaaccttttataaatccattagtaccattacaaaaaaatgtcaattttttttttaagttttcaactgtggttatactagtaatcaaatatatcatggactatattttggatacatttgtttctttggtttaaaataagtttgttttcattctgtagtttgttttgtttctacatctatggattgacagatagtattcctaaatctctctcattgtaggtacatcattttacattcagcggttgtcatttcaaattttagtcaggcagcacaaagctgtcaattattccagaggaagctgctgccagctgttttgtattgttgcttcctcttggggaacaaagacagatttggtatcattgattgctcagctagcctctttttaaaagaacgtttctgggaatcagatgtctagggaaggattccactgaggagtgatacacgtgtacattgtttaagagcatagtctagtgtgagtaggccattaaggggaaggatattcatgaaagaatttaggcaacctgttatttagaaagccttcacgtctgtaaggtgcttggcctacttttttttttaaattagtatacatgcataaaaccttgtatcatcaatatacaaattattctgttaggggacatgtttttgttctccatgtttctgtttctattgtggtatgagttgtatttgtatcactgagataacctattgttatattctaattcattgataatatgttttgtaagaaaagctgacatccttcattgcaagtgaagaacaggtttaccatgaaatgaatgcctttattcaacttagagtcctaatgtttctgatttcacattcttgttgctgaaatgcagaagaaacagctacagcaagagcagaaggaaaactcttagacttaatgtctccaattgcaagaattgtttcactaaagaaacagtcatcattcaactactgaatttgaaagcctcagcagtttcaatgacaaaaatcatttttgattttttaaaattaatcccaatggcatgataaattttcatataaaaagtaaagtttcaatttagtttttaataatggtttaatgccttttttgaataactggtttaacctaattttttttaaatgtaatgtattaatgcatataccataatcaaaagtttgaaatatcctgtttcttaaataatgagaacattaatcacatttagcaagcatttgtacattcaaacctggatattaaagtgaaatgattactttgaatcactgtctgccaaggttcatgattcacattttgagatggattcttttcttaatgcaatacctaacttttgataattttttaaaactaatatttgatcagataatgtaagtcaaaatgcagacgatcctttaaaaggatgcattgtctgtgtatgtagcaacagctccaaagtatttttgggcagtttgataccttttatatctgaagtagccttaaccagaaaaatggtaatttaaaattgacaaaatgatatttttaagacttcaaaatgataaataatttttaactattaaaattggcctcaaactaataaatctgtaattaaattagaattaaatatcagtttaacaacaaaatgaaatatttattttttagaagctgcctctcttcattggtcatttatttttaattataaaatttccaacagatctttgctttaagcccttgatatttgacctagttggacacttgatgaggaagttgcctctagaattataaaaatctcagctttataaaatgcatctgttcacgaaggtaatttctttaattggtgatcaaaatataaaattaaggtactaatgtctcactggaagtatatatatatatatatatatatgtatgcatgtgtgtgtgtgtatatatatatatatatatatgtatatgtttctgagtaatttttaaaaaataaaacaggttaataagaagatccattcctttgcatgtgattgttataacattctttcccagggagttcaatttcagcaacctcagaaatccatacttgatattaggaaactgtaaatgtaacacctgaaattattatgttcactattctacatgaaccttatggaaattcatgatttatgtctttgtttttctttttccaagtatatgcaggactccccaaccttgattttataatggtgactgcattttgtaggtggaatcatttctaccgaaatcattttgaaacacaagaatattgatcagtactgtttcactctgatttagtaaatcagaaagcctccccctacccccagcccccactttcacataccttctgggaggtgcctcagtatagacttggtatctgtgaaggactgagttcatgaatatgcacagaagcacttaaaccatgcctcttatttctataatatctgaaaatggcttcataaaagttaagtcaggagaacactgtttacatgacacttcttaactcatttttaatgtttatttttaatttcaaaaacttgttgcctatttggttttcagtactgcataacactgactttcttaaattagtcatagttgcaataatttacttaaatttggtaatgtcacatttgggttggggtttcagtgggaatagtaacttgccgctagtgagaaatggcattgaatactaaagactcaatatgaacaggctttatagacccttagagaaactgttgccttaatgtttggtgcaatttctagtagtgcataagtgaatttagtcttatgataagtaactttgagctgtttttagcttagtaagaattgtggaaaccacatgtttattgtgcccatcattttacacaaagaaaagaggattatattatttcttctaaggaagtaggagttttcttcctaaaagtgcttacatattgtagtactattacttaaaagttatttatgaagttgggagccttctagtttgcctgtgttgatgtattttgaaaacaaaattgcaataaaggatgagcttccatcggtgtgtatggtataccagatacagatggttgcaaggaaaccttttcccccactagaatagtctattagtaactgctaagtcctagcttgcatttttgaaaatgcctttctgcatgttagcacccagactttcctttgtcatattcctttatagctacaacttaactgtagcttatcagagaagctctgtagtcctacactgaagtgtgttcccttggctgttcatatggggctgggtttggttgaacttccattctgtataaatgctagaacacagttactacagattgattcacaaactgcatgtgctggtgcttgaggcagccaaaatggaatgctgtggaaagcatatctatatcttaaaaaacactcagacaggagttaaggacagctttaataatttttttgtttaccacttaatctttatcaactttgattttagttagggcttagctcatggttgaagaaaagtggaaaataacaagtgcccatttaggtttgaagaatccagaatgttttacctttgactttatgagttatagaagcttggctttgctctaggcttcatgttcccaaatgagccatctgtcagtatattcacttaattcttactaatttcagtttcctgtaaaggaaacaacttacatattgatgcttaaatccagaaagtgtaaaaggttttcttaaactgttaaaatatagtgtctgatataaaggatgtaagttactcagctttctgctccctaagccaaacagtgtttgtcttcagtgtgaaatttaactgtaaaaactacttgtaatgtcaagagattatagatcatattattaataaaatggacctgggtctaatattttttttcttcaaagggagtgtgaagctgtttattcttttatttgcatatgagtttttcttttagttttagtttttcatgttcatatttccactgatttgaaaacacaaaatttatttttataattttgttgcttgtagcataatcaagtgcaaaatcaagtgcaacctacttgtgactaaatctctttggatttatagctgaggatattgttagctaggttttgtcaatccctaatcattttttaaaatcaatgctgtattcccaggaggctttgagactcctatgaacctgaagcactcccttttgaaccttggaagatcctcaaagagtgagcactcttgtgctcttctaatcataattaattccttaacaaatcagagtaaggaccactgacatatagaaccctcaagccaaagaaccatcacagaatttagtaactttagttctgtgaacatgaaaagatttcttttttggtttccaaaggagattatttatttttccacaaggaaaaacatcttgcagagactctgaattccaaatctgagtgagaaagaaaaggaaaaaaatctgtttcatggtggatttctaagcaacatatatacatgtttttaagacaaccttttgttggcagtgtttttcctgaacaccatatgcaccctaggaaacatgtttttcctttaatcttgttcacatatcagaaaaggacatgaaatgctcatactggcatacaagtttctataagtagttattttttgagctacttatactatatccccaaaagctcacagtgccttgttgggattttttttttccatgaactagccattattttaaatgagtgggagagggtaagtctttagacagaggtcattcagcagttcaagactattcctcttcaagaacatgtcaggaattaagcagttatatgtggaaacactggtaattctttccacagtgttgttttggataatctgttctagtatatttaactaattgtatggtggacctgtactctgatacacatcgaatcagtcaatgggatttgtatgtgcttttccttcctacattttcattcctactgccccaacctagtagccctaagttgtggcttggtgggtttggcattgagcctcaagacactcactacattctttctggatgtttgctcacaggctccctgaggagcagaacctgtggagctggggagtgcgggtggtttctattcctaatattgtgtgtcagtcctttttcgtgtgatggtgccttcagaataacgaatatttctgttctggacaatgattaaatcttatgagaaatatatgtaggttatattaattcttgtccatttttgctaagcctgtgaaatactttggctctgatacaacttaacttgaataatatcttatcctgagtcttcctccaaggcagtacatattcctgccaggactgtagtaatcctttgggaactacatgtgagtaagcacttgtatgtaagccattatactgctgtaactaatgcatacaaacaattcttctctttacatttatagtctaaaaggggatatgcagtgggaaggaaaattcctgagagattccagcatagctttgtcaattccgactgagccatactgttttccacaagggctcaacacatagtcagtattccgtgctttcagtgtgtgttcagattctcctcttactggttttcttagactgtattgttctataagcaaatgcccatgtgtgatttttaagatgtgctggggaaaaataaatcaataccacaaccacc

SEQ ID NO: 106637 - DNA, 815 bp, Homo sapiens
  Payload ID: 942
  Gene Symbol: AGPS
  Gene Name: alkylglycerone phosphate synthase
  ENST ID: ENST00000409888
  CDS Start-End: 23-592
gcggcagcacaaggcggtagccatggcggaggcggcggctgcagcgggtgggactggcttgggcgcgggcgcgagctacgggtctgcagcggaccgggaccgggacccggacccggaccgcgccgggcggaggctgcgggttctctctggccatctgctgggccggccccgggaggctctgagtaccaatgagtgcaaagcgcggagagccgcgtcggcggccacggcagcgcccacggccactcccgccgcgcaggagtcgggcaccatcccaaagaagcggcaagaagttatgaaatggaatggatggggatataatgattctaaattcatcttcaataagaagggccaaattgaattgactgggaaaaggggaattagtgacccactgaccgtatttgaacaaactgaggcagctgctagagaagaaatccttgctaatggagggagcctgtcacatcaccatggagtgggcaagttacggaagcaatggctaaaggaaagtatctctgatgtcggctttgggatgctgaagtctgtcaaggaatatgtggaccccaataacatctttggaaacagaaaccttttataaatccattagtaccattacaaaaaaatgtcaattttttttttaagttttcaactgtggttatactagtaatcaaatatatcatggactatattttggatacatttgtttctttggtttaaaataagtttgttttcattctgtagtttgttttgtttctacatctatggattgacagatagtattcctaaatctctctcattgtaggtacatcattttacattca

SEQ ID NO: 106638 - DNA, 1446 bp, Homo sapiens
  Payload ID: 943
  Gene Symbol: ALLC
  Gene Name: allantoicase
  ENST ID: ENST00000252505
  CDS Start-End: 163-1338
tatacattctctctgagctggcactcaagcaccgtgggaccttggctggcttctggggagcaagagatccatttatgaatacttgatttctgactgctgggaagcacggctgatgctccgaaggagggaagactgacccggtttctggacttcacccagctgatggacatggcatctgaatccgtaggaggaaaaattttatttgcaacagatgacttttttgctcctgcagaaaacctcataaagagtgacagcccgtgcttcaaagagcatgaatatacggagtttgggaaatggatggatggctgggagaccaggaggaaaaggattccaggtcacgactggtgtgtcctcaggctggggatccaaggagtcatccggggcttcgacgtggacgtttcttacttcacgggagattacgctcctcgagtgtccattcaagcagcaaacttggaagaagataaactaccagaaatcccagaaagaggaaccaggacaggagctgcagccactcctgaggagtttgaagccattgctgagctaaaatccgacgactggagttacttggttcccatgactgagcttaagccaggaaaccctgcttccggccacaactattttcttgtcaattcccagcagagatggactcatatcagactcaacattttcccagatggtggaattgcacgacttagagtattcggtactggacaaaaagactggactgcaactgaccccaaagaacctgcagacctagtggccatcgcttttgggggtgtctgtgtaggatttagtaatgctaagtttgggcacccaaacaatataataggagttggcggggcaaagtctatggcggatggttgggaaactgcaagaaggctggaccggccaccaatattagaaaatgatgagaatggcattctcttggttccgggttgtgaatgggcagttttccgattggcacatcctggagtaataactcgaattgaaattgacacaaaatattttgaaggcaatgctcctgacagctgtaaagtggatgggtgcatcctgacaactcaggaagaagaagccgtgatcaggcaaaagtggattctcccggcccacaagtggaaaccactgcttccagtgaccaagttgtctcccaaccaaagtcatctgttcgatagcctgaccctagagctccaagatgtcatcactcacgccaggctcaccatcgtccccgacgggggagtgagccgccttcggctccggggcttccccagctccatctgcctcctgaggccccgggagaagcccatgttgaagttctcggtgagcttcaaagcaaacccttaacacacacaaagccccggtgtcggacacacagcagtaatttcccagtcatagtcttcttttcaaatgttttgaacacctggtgatttaataaagtggtcgtctcacaaa

SEQ ID NO: 106639 - DNA, 607 bp, Homo sapiens
  Payload ID: 944
  Gene Symbol: AIF1
  Gene Name: allograft inflammatory factor 1
  ENST ID: ENST00000337917
  CDS Start-End: 1-486
gggaggaaggcttctgagaagactggtgggagagaaggagagcctgcagacagaggcctccagcttggaggaaaagctttcggactgctgaaggcccagcaggaagagaggctggatgagatcaacaagcaattcctagacgatcccaaatatagcagtgatgaggatctgccctccaaactggaaggcttcaaagagaaatacatggagtttgaccttaatggaaatggcgatattgatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaaggaaaagccaacaggccccccagccaagaaagctatctctgagttgccctgatttgaagggaaaagggatgatgggattgaaggggcttctaatgacccagatatggaaacagaagacaaaattgtaagccagagtcaacaaattaaataaattaccccctcctccagatcaa

SEQ ID NO: 106640 - DNA, 524 bp, Homo sapiens
  Payload ID: 944
  Gene Symbol: AIF1
  Gene Name: allograft inflammatory factor 1
  Uniprot ID: P55008
  ENST ID: ENST00000376049
  CDS Start-End: 122-403
ctccttccacgttgtctcctccacctagcagttggttggcaaccccttcctcagtcccctgctgaaaaccctccagtcagcgcttatcccttctgctctctcccctcacccagagaaatacatggagtttgaccttaatggaaatggcgatattgatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaaggaaaagccaacaggccccccagccaagaaagctatctctgagttgccctgatttgaagggaaaagggatgatgggattgaaggggcttctaatgacccagatatggaaacagaagacaaaattgtaagccagagtcaacaaattaaataaattaccccctcctccagatcaa

SEQ ID NO: 106641 - DNA, 711 bp, Homo sapiens
  Payload ID: 944
  Gene Symbol: AIF1
  Gene Name: allograft inflammatory factor 1
  Uniprot ID: P55008
  ENST ID: ENST00000376059
  CDS Start-End: 147-590
ctgggaggcagaggaggaaggaatgaggggaaaggggaagtttgggaggaaggcttctgagaagactggtgggagagaaggagagcctgcagacagaggcctccagcttggtctgtctccccacctctaccagcatctgctgagctatgagccaaaccagggatttacagggaggaaaagctttcggactgctgaaggcccagcaggaagagaggctggatgagatcaacaagcaattcctagacgatcccaaatatagcagtgatgaggatctgccctccaaactggaaggcttcaaagagaaatacatggagtttgaccttaatggaaatggcgatattgatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaaggaaaagccaacaggccccccagccaagaaagctatctctgagttgccctgatttgaagggaaaagggatgatgggattgaaggggcttctaatgacccagatatggaaacagaagacaaaattgtaagccagagtcaacaaattaaataaattaccccctcctccagatcaa

SEQ ID NO: 106642 - DNA, 524 bp, Homo sapiens; identical to SEQ ID NO: 106640
  Payload ID: 944
  Gene Symbol: AIF1
  Gene Name: allograft inflammatory factor 1
  Uniprot ID: P55008
  ENST ID: ENST00000383473
  CDS Start-End: 122-403

SEQ ID NO: 106643 - DNA, 711 bp, Homo sapiens; identical to SEQ ID NO: 106641
  Payload ID: 944
  Gene Symbol: AIF1
  Gene Name: allograft inflammatory factor 1
  Uniprot ID: P55008
  ENST ID: ENST00000383474
  CDS Start-End: 147-590

SEQ ID NO: 106644 - DNA, 711 bp, Homo sapiens; identical to SEQ ID NO: 106641
  Payload ID: 944
  Gene Symbol: AIF1
  Gene Name: allograft inflammatory factor 1
  Uniprot ID: P55008
  ENST ID: ENST00000414149
  CDS Start-End: 147-590

SEQ ID NO: 106645 - DNA, 607 bp, Homo sapiens; identical to SEQ ID NO: 106639
  Payload ID: 944
  Gene Symbol: AIF1
  Gene Name: allograft inflammatory factor 1
  ENST ID: ENST00000454372
  CDS Start-End: 1-486

SEQ ID NO: 106646 - DNA, 607 bp, Homo sapiens; identical to SEQ ID NO: 106639
  Payload ID: 944
  Gene Symbol: AIF1
  Gene Name: allograft inflammatory factor 1
  ENST ID: ENST00000454573
  CDS Start-End: 1-486

SEQ ID NO: 106647 - DNA, 607 bp, Homo sapiens; identical to SEQ ID NO: 106639
  Payload ID: 944
  Gene Symbol: AIF1
  Gene Name: allograft inflammatory factor 1
  ENST ID: ENST00000417200
  CDS Start-End: 1-486

SEQ ID NO: 106648 - DNA, 711 bp, Homo sapiens; identical to SEQ ID NO: 106641
  Payload ID: 944
  Gene Symbol: AIF1
  Gene Name: allograft inflammatory factor 1
  Uniprot ID: P55008
  ENST ID: ENST00000440907
  CDS Start-End: 147-590

SEQ ID NO: 106649 - DNA, 711 bp, Homo sapiens; identical to SEQ ID NO: 106641
  Payload ID: 944
  Gene Symbol: AIF1
  Gene Name: allograft inflammatory factor 1
  Uniprot ID: P55008
  ENST ID: ENST00000425748
  CDS Start-End: 147-590

SEQ ID NO: 106650 - DNA, 524 bp, Homo sapiens; identical to SEQ ID NO: 106640
  Payload ID: 944
  Gene Symbol: AIF1
  Gene Name: allograft inflammatory factor 1
  Uniprot ID: P55008
  ENST ID: ENST00000424944
  CDS Start-End: 122-403

SEQ ID NO: 106651 - DNA, 524 bp, Homo sapiens
  Payload ID: 944
  Gene Symbol: AIF1
  Gene Name: allograft inflammatory factor 1
  Uniprot ID: P55008
  ENST ID: ENST00000416422
  CDS Start-End: 122-403
ctccttccacgttgtctcctccacctagcagttggttggcaaccccttcctcagtccccggctgaaaaccctccagtcagcgcttatcccttctgctctctcccctcacccagagaaatacatggagtttgaccttaatggaaatggcgatattgatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaaggaaaagccaacaggccccccagccaagaaagctatctctgagttgccctgatttgaagggaaaagggatgatgggattgaaggggcttctaatgacccagatatggaaacagaagacaaaattgtaagccagagtcaacaaattaaataaattaccccctcctccagatcaa

SEQ ID NO: 106652 - DNA, 607 bp, Homo sapiens; identical to SEQ ID NO: 106639
  Payload ID: 944
  Gene Symbol: AIF1
  Gene Name: allograft inflammatory factor 1
  ENST ID: ENST00000437985
  CDS Start-End: 1-486

SEQ ID NO: 106653 - DNA, 524 bp, Homo sapiens; identical to SEQ ID NO: 106640
  Payload ID: 944
  Gene Symbol: AIF1
  Gene Name: allograft inflammatory factor 1
  Uniprot ID: P55008
  ENST ID: ENST00000419376
  CDS Start-End: 122-403

SEQ ID NO: 106654 - DNA, 524 bp, Homo sapiens
  Payload ID: 944
  Gene Symbol: AIF1
  Gene Name: allograft inflammatory factor 1
  Uniprot ID: P55008
  ENST ID: ENST00000415830
  CDS Start-End: 122-403
ctccttccacgttgtctcctccacctagcagttggttggcaaccccttcctcagtccccggctgaaaaccctcgagtcagcgcttatcccttctgctctctcccctcacccagagaaatacatggagtttgaccttaatggaaatggcgatattgatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaaggaaaagccaacaggccccccagccaagaaagctatctctgagttgccctgatttgaagggaaaagggatgatgggattgaaggggcttctaatgacccagatatggaaacagaagacaaaattgtaagccagagtcaacaaattaaataaattaccccctcctccagatcaa

SEQ ID NO: 106655 - DNA, 607 bp, Homo sapiens; identical to SEQ ID NO: 106639
  Payload ID: 944
  Gene Symbol: AIF1
  Gene Name: allograft inflammatory factor 1
  ENST ID: ENST00000412407
  CDS Start-End: 1-486

SEQ ID NO: 106656 - DNA, 711 bp, Homo sapiens; identical to SEQ ID NO: 106641
  Payload ID: 944
  Gene Symbol: AIF1
  Gene Name: allograft inflammatory factor 1
  Uniprot ID: P55008
  ENST ID: ENST00000413349
  CDS Start-End: 147-590

SEQ ID NO: 106657 - DNA, 3364 bp, Homo sapiens
  Payload ID: 945
  Gene Symbol: AIF1L
  Gene Name: allograft inflammatory factor 1-like
  Uniprot ID: Q9BQI0
  ENST ID: ENST00000247291
  CDS Start-End: 89-541
gccggagcccggaccaggcgcctgtgcctcctcctcgtccctcgccgcgtccgcgaagcctggagccggcgggagccccgcgctcgccatgtcgggcgagctcagcaacaggttccaaggagggaaggcgttcggcttgctcaaagcccggcaggagaggaggctggccgagatcaaccgggagtttctgtgtgaccagaagtacagtgatgaagagaaccttccagaaaagctcacagccttcaaagagaagtacatggagtttgacctgaacaatgaaggcgagattgacctgatgtctttaaagaggatgatggagaagcttggtgtccccaagacccacctggagatgaagaagatgatctcagaggtgacaggaggggtcagtgacactatatcctaccgagactttgtgaacatgatgctggggaaacggtcggctgtcctcaagttagtcatgatgtttgaaggaaaagccaacgagagcagccccaagccagttggcccccctccagagagagacattgctagcctgccctgaggaccccgcctggactccccagccttcccaccccatacctccctcccgatcttgctgcccttcttgacacactgtgatctctctctctctcatttgtttggtcattgagggtttgtttgtgttttcatcaatgtctttgtaaagcacaaattatctgccttaaaggggctctgggtcggggaatcctgagccttgggtcccctccctctcttcttccctccttccccgctccctgtgcagaagggctgacatcaaaccaaaaactagagggggcagggccagggcagggaggcttccagcctgtgttcccctcacttggaggaaccagcactctccatcctttcagaaagtctccaagccaagttcaggctcactgacctggctctgacgaggaccccaggccactctgagaagaccttggagtagggacaaggctgcagggcctctttcgggtttccttggacagtgccatggctccagtgctctggtgtcacccaggacacagccactcggggccccgctgccccagctgatccccactcattccacacctcttctcatcctcagtgatgtgaaggtgggaaggaaaggagcttggcattgggagcccttcaagaaggtaccagaaggaaccctccagtcctgctctctggccacacctgtgcaggcagctgagaggcagcgtgcagccctactgtcccttactggggcagcagagggcttcggaggcagaagtgaggcctggggttttgggggaaaggtcagctcagtgctgttccaccttttagggaggttactgaggggaccaggatgggagaatgaggagtaaaatgctcacggcaaagtcagcagcactggtaagccaagactgagaaatacaaggttgcttgtctgaccccaatctgcttgaaacctgactctgcttctctcatttgtcttcctaccctactcacataattcactcattgactcactcattcaccagatatttattgacctgctattataagctttacatcctcccatgttgtcctggcatgtgcagtatacacggtctaactcatctctccccagatctctcagaaccttgagcttgggaattgaactggggtcacctgtgtcctttcttatggactcgcaggattttagaaccctaatgcaccctggagggtagctgggccagacttctcatttcacaggtgaggagactggtgccccacagggattaagtgccttgcccaaggtcaggcttatctccagagggaggtgccctggactggggcccagatgttcagggaccctgcctacacctcatttccagtgtgggctgccttagttagttatgagaacagggaagggctgggaagagacagcctccaaggtcaacacttggagagggtttcacttgctctgaagaccctggtccaggattcgccctctcccatgccttcaagtcagcatcaggcttagggcaaagaccaggcctctgaagctgcctcttgtaattcatgcaggaagatgtcaaagtcagccccatcttggctgatcagggtgttcagccttaaccccacctgtgttctgaagtctcttaccctacctgctcaggactgagacagttattcactgaacatatttattaagcacttgctgtaggccaacagttaagaatccaataatgaaatggacagattcatggaacttagagtccaataggaaagtgagacccagacaatgacaatgagataaatgttaggaagggggaggtatggggtgacttccctgcagtcctgggggcctagatgggcccaagactgggtgagagtcttggcagagcctttgcaacaccttaagtggacaggactgggaggtcttggtggttggagccaacgtgggttccctgcggctccttagtcacctctgatagcagattgagggaggaaaacaggtaaggcatgaggaaatggccaggttgggttaacccactggtttcaaccagttcaggaatgaggttatttggccatgactggctgatcttgagctcaaggatctgcttcaaatgcacacaggcctagttgaagtttaaaccccagcaaaacattcctccctgtaaatggaaaatcctacttctacccccaccctgccctgttttttgttttttttttccccaagatcattagatgtcctcacccctcctcactgcctctcctctctgggacaggctgggacctttgaggaagataaagccttccttcactacccatcatattcagtgtccctgttcctcactcagagaggaaggcagaaccagtcaggcttatttcagtaagttccacagttctacaagactgcaggaattctccttaagggaggagagcaagcaggtgtggccccagcttctggaaatggcagaagagagggttttctcattgaatgggggtgggggctcgtgtgtcctgggaaaccccatcagtcccttcatttcttgagactcaactcctgggaggagagggtctcaagagttgtccctggaaggagggcgggggcagtctgcatctatttcaggttgtggctcttggttctaggactcttacttctctggctaagggctcagcttcttgggacttcaaccatcttctttctgaaagaccaaatctaatgtaaccagtaacgtgaggactgccaagtatggctttgtccctatgactcagaggagggtttgtcgggcaaattcaggtggatgaagtatgtgtgtgcgtgtgcatgggagtgtgcgtggactgggatatcatctctacagcctgcaaataaaccagacaaacttac

SEQ ID NO: 106658 - DNA, 418 bp, Homo sapiens
  Payload ID: 945
  Gene Symbol: AIF1L
  Gene Name: allograft inflammatory factor 1-like
  ENST ID: ENST00000372297
  CDS Start-End: 184-324
tggactgcttggatgtaggcagcctgtctgttttccatccgctggctacaggactcccattcggtccccagctacagggctctggggacctcagggttccccctccaggagtttctgtgtgaccagaagtacagtgatgaagagaaccttccagaaaagctcacagccttcaaagagaagtacatggagtttgacctgaacaatgaaggcgagattgacctgatgtctttaaagaggatgatggagaagcttggtgtccccaagacccacctggagatgaagaagatgatctcagaggtgacaggagggagtcatgatgtttgaaggaaaagccaacgagagcagccccaagccagttggcccccctccagagagagacattgctagcctgccctgaggaccccgcctggactcccca

SEQ ID NO: 106659 - DNA, 849 bp, Homo sapiens
  Payload ID: 945
  Gene Symbol: AIF1L
  Gene Name: allograft inflammatory factor 1-like
  ENST ID: ENST00000372298
  CDS Start-End: 75-368
caggcgcctgtgcctcctcctcgtccctcgccgcgtccgcgaagcctggagccggcgggagccccgcgctcgccatgtcgggcgagctcagcaacaggttccaaggagggaaggcgttcggcttgctcaaagcccggcaggagaggaggctggccgagatcaaccgggagtttctgtgtgaccagaagtacagtgatgaagagaaccttccagaaaagctcacagccttcaaagagaagtacatggagtttgacctgaacaatgaaggcgagattgacctgatgtctttaaagaggatgatggagaagcttggtgtccccaagacccacctggagatgaagaagatgatctcagagggaggttactgaggggaccaggatgggagaatgaggagtaaaatgctcacggcaaagtcagcagcactggtaagccaagactgagaaatacaaggttgcttgtctgaccccaatctgcttgaaacctgactctgcttctctcatttgtcttcctaccctactcacataattcactcattgactcactcattcaccagatatttattgacctgctattataagctttacatcctcccatgttgtcctggcatgtgcagtatacacggtctaactcatctctccccagatctctcagaaccttgagcttgggaattgaactggggtcacctgtgtcctttcttatggactcgcaggattttagaaccctaatgcaccctggagggtagctgggccagacttctcatttcacaggtgaggagactggtgccccacagggattaagtgccttgcccaaggtcaggcttatctccagagggaggtgccctggactggg

SEQ ID NO: 106660 - DNA, 3284 bp, Homo sapiens
  Payload ID: 945
  Gene Symbol: AIF1L
  Gene Name: allograft inflammatory factor 1-like
  Uniprot ID: Q9BQI0
  ENST ID: ENST00000372300
  CDS Start-End: 80-388
cggaccaggcgcctgtgcctcctcctcgtccctcgccgcgtccgcgaagcctggagccggcgggagccccgcgctcgccatgtcgggcgagctcagcaacaggttccaaggagggaaggcgttcggcttgctcaaagcccggcaggagaggaggctggccgagatcaaccgggagtttctgtgtgaccagaagtacagtgatgaagagaaccttccagaaaagctcacagccttcaaagagaagtacatggagtttgacctgaacaatgaaggcgagattgacctgatgtctttaaagaggatgatggagaagcttggtgtccccaagacccacctggagatgaagaagatgatctcagaggtgacaggagggagtcatgatgtttgaaggaaaagccaacgagagcagccccaagccagttggcccccctccagagagagacattgctagcctgccctgaggaccccgcctggactccccagccttcccaccccatacctccctcccgatcttgctgcccttcttgacacactgtgatctctctctctctcatttgtttggtcattgagggtttgtttgtgttttcatcaatgtctttgtaaagcacaaattatctgccttaaaggggctctgggtcggggaatcctgagccttgggtcccctccctctcttcttccctccttccccgctccctgtgcagaagggctgacatcaaaccaaaaactagagggggcagggccagggcagggaggcttccagcctgtgttcccctcacttggaggaaccagcactctccatcctttcagaaagtctccaagccaagttcaggctcactgacctggctctgacgaggaccccaggccactctgagaagaccttggagtagggacaaggctgcagggcctctttcgggtttccttggacagtgccatggctccagtgctctggtgtcacccaggacacagccactcggggccccgctgccccagctgatccccactcattccacacctcttctcatcctcagtgatgtgaaggtgggaaggaaaggagcttggcattgggagcccttcaagaaggtaccagaaggaaccctccagtcctgctctctggccacacctgtgcaggcagctgagaggcagcgtgcagccctactgtcccttactggggcagcagagggcttcggaggcagaagtgaggcctggggttttgggggaaaggtcagctcagtgctgttccaccttttagggaggttactgaggggaccaggatgggagaatgaggagtaaaatgctcacggcaaagtcagcagcactggtaagccaagactgagaaatacaaggttgcttgtctgaccccaatctgcttgaaacctgactctgcttctctcatttgtcttcctaccctactcacataattcactcattgactcactcattcaccagatatttattgacctgctattataagctttacatcctcccatgttgtcctggcatgtgcagtatacacggtctaactcatctctccccagatctctcagaaccttgagcttgggaattgaactggggtcacctgtgtcctttcttatggactcgcaggattttagaaccctaatgcaccctggagggtagctgggccagacttctcatttcacaggtgaggagactggtgccccacagggattaagtgccttgcccaaggtcaggcttatctccagagggaggtgccctggactggggcccagatgttcagggaccctgcctacacctcatttccagtgtgggctgccttagttagttatgagaacagggaagggctgggaagagacagcctccaaggtcaacacttggagagggtttcacttgctctgaagaccctggtccaggattcgccctctcccatgccttcaagtcagcatcaggcttagggcaaagaccaggcctctgaagctgcctcttgtaattcatgcaggaagatgtcaaagtcagccccatcttggctgatcagggtgttcagccttaaccccacctgtgttctgaagtctcttaccctacctgctcaggactgagacagttattcactgaacatatttattaagcacttgctgtaggccaacagttaagaatccaataatgaaatggacagattcatggaacttagagtccaataggaaagtgagacccagacaatgacaatgagataaatgttaggaagggggaggtatggggtgacttccctgcagtcctgggggcctagatgggcccaagactgggtgagagtcttggcagagcctttgcaacaccttaagtggacaggactgggaggtcttggtggttggagccaacgtgggttccctgcggctccttagtcacctctgatagcagattgagggaggaaaacaggtaaggcatgaggaaatggccaggttgggttaacccactggtttcaaccagttcaggaatgaggttatttggccatgactggctgatcttgagctcaaggatctgcttcaaatgcacacaggcctagttgaagtttaaaccccagcaaaacattcctccctgtaaatggaaaatcctacttctacccccaccctgccctgttttttgttttttttttccccaagatcattagatgtcctcacccctcctcactgcctctcctctctgggacaggctgggacctttgaggaagataaagccttccttcactacccatcatattcagtgtccctgttcctcactcagagaggaaggcagaaccagtcaggcttatttcagtaagttccacagttctacaagactgcaggaattctccttaagggaggagagcaagcaggtgtggccccagcttctggaaatggcagaagagagggttttctcattgaatgggggtgggggctcgtgtgtcctgggaaaccccatcagtcccttcatttcttgagactcaactcctgggaggagagggtctcaagagttgtccctggaaggagggcgggggcagtctgcatctatttcaggttgtggctcttggttctaggactcttacttctctggctaagggctcagcttcttgggacttcaaccatcttctttctgaaagaccaaatctaatgtaaccagtaacgtgaggactgccaagtatggctttgtccctatgactcagaggagggtttgtcgggcaaattcaggtggatgaagtatgtgtgtgcgtgtgcatgggagtgtgcgtggactgggatatcatctctacagcctgcaaataaaccagacaaacttac

SEQ ID NO: 106661 - DNA, 671 bp, Homo sapiens
  Payload ID: 945
  Gene Symbol: AIF1L
  Gene Name: allograft inflammatory factor 1-like
  ENST ID: ENST00000372301
  CDS Start-End: 271-555
aaacttcctacccacagggtggccagtgcagatctgcctccaaggggcgacaggaagccggggtgaacaagggacaaactgggtctggtcgcacctggttacccgataggagggaaggcccccggacagtgggcccatgtgtgggtgacttctgtccccagtcccttgctcagcactgtcctctcacctctgtaggagtttctgtgtgaccagaagtacagtgatgaagagaaccttccagaaaagctcacagccttcaaagagaagtacatggagtttgacctgaacaatgaaggcgagattgacctgatgtctttaaagaggatgatggagaagcttggtgtccccaagacccacctggagatgaagaagatgatctcagaggtgacaggaggggtcagtgacactatatcctaccgagactttgtgaacatgatgctggggaaacggtcggctgtcctcaagttagtcatgatgtttgaaggaaaagccaacgagagcagccccaagccagttggcccccctccagagagagacattgctagcctgccctgaggaccccgcctggactccccagccttcccaccccatacctccctcccgatcttgctgcccttcttgacacactgtgatctctctctctctcatttgtttggtcattgagggtttgt

SEQ ID NO: 106662 - DNA, 3340 bp, Homo sapiens
  Payload ID: 945
  Gene Symbol: AIF1L
  Gene Name: allograft inflammatory factor 1-like
  Uniprot ID: Q9BQI0
  ENST ID: ENST00000372302
  CDS Start-End: 89-517
gccggagcccggaccaggcgcctgtgcctcctcctcgtccctcgccgcgtccgcgaagcctggagccggcgggagccccgcgctcgccatgtcgggcgagctcagcaacaggttccaaggagggaaggcgttcggcttgctcaaagcccggcaggagaggaggctggccgagatcaaccgggagtttctgtgtgaccagaagtacagtgatgaagagaaccttccagaaaagctcacagccttcaaagagaagtacatggagtttgacctgatgtctttaaagaggatgatggagaagcttggtgtccccaagacccacctggagatgaagaagatgatctcagaggtgacaggaggggtcagtgacactatatcctaccgagactttgtgaacatgatgctggggaaacggtcggctgtcctcaagttagtcatgatgtttgaaggaaaagccaacgagagcagccccaagccagttggcccccctccagagagagacattgctagcctgccctgaggaccccgcctggactccccagccttcccaccccatacctccctcccgatcttgctgcccttcttgacacactgtgatctctctctctctcatttgtttggtcattgagggtttgtttgtgttttcatcaatgtctttgtaaagcacaaattatctgccttaaaggggctctgggtcggggaatcctgagccttgggtcccctccctctcttcttccctccttccccgctccctgtgcagaagggctgacatcaaaccaaaaactagagggggcagggccagggcagggaggcttccagcctgtgttcccctcacttggaggaaccagcactctccatcctttcagaaagtctccaagccaagttcaggctcactgacctggctctgacgaggaccccaggccactctgagaagaccttggagtagggacaaggctgcagggcctctttcgggtttccttggacagtgccatggctccagtgctctggtgtcacccaggacacagccactcggggccccgctgccccagctgatccccactcattccacacctcttctcatcctcagtgatgtgaaggtgggaaggaaaggagcttggcattgggagcccttcaagaaggtaccagaaggaaccctccagtcctgctctctggccacacctgtgcaggcagctgagaggcagcgtgcagccctactgtcccttactggggcagcagagggcttcggaggcagaagtgaggcctggggttttgggggaaaggtcagctcagtgctgttccaccttttagggaggttactgaggggaccaggatgggagaatgaggagtaaaatgctcacggcaaagtcagcagcactggtaagccaagactgagaaatacaaggttgcttgtctgaccccaatctgcttgaaacctgactctgcttctctcatttgtcttcctaccctactcacataattcactcattgactcactcattcaccagatatttattgacctgctattataagctttacatcctcccatgttgtcctggcatgtgcagtatacacggtctaactcatctctccccagatctctcagaaccttgagcttgggaattgaactggggtcacctgtgtcctttcttatggactcgcaggattttagaaccctaatgcaccctggagggtagctgggccagacttctcatttcacaggtgaggagactggtgccccacagggattaagtgccttgcccaaggtcaggcttatctccagagggaggtgccctggactggggcccagatgttcagggaccctgcctacacctcatttccagtgtgggctgccttagttagttatgagaacagggaagggctgggaagagacagcctccaaggtcaacacttggagagggtttcacttgctctgaagaccctggtccaggattcgccctctcccatgccttcaagtcagcatcaggcttagggcaaagaccaggcctctgaagctgcctcttgtaattcatgcaggaagatgtcaaagtcagccccatcttggctgatcagggtgttcagccttaaccccacctgtgttctgaagtctcttaccctacctgctcaggactgagacagttattcactgaacatatttattaagcacttgctgtaggccaacagttaagaatccaataatgaaatggacagattcatggaacttagagtccaataggaaagtgagacccagacaatgacaatgagataaatgttaggaagggggaggtatggggtgacttccctgcagtcctgggggcctagatgggcccaagactgggtgagagtcttggcagagcctttgcaacaccttaagtggacaggactgggaggtcttggtggttggagccaacgtgggttccctgcggctccttagtcacctctgatagcagattgagggaggaaaacaggtaaggcatgaggaaatggccaggttgggttaacccactggtttcaaccagttcaggaatgaggttatttggccatgactggctgatcttgagctcaaggatctgcttcaaatgcacacaggcctagttgaagtttaaaccccagcaaaacattcctccctgtaaatggaaaatcctacttctacccccaccctgccctgttttttgttttttttttccccaagatcattagatgtcctcacccctcctcactgcctctcctctctgggacaggctgggacctttgaggaagataaagccttccttcactacccatcatattcagtgtccctgttcctcactcagagaggaaggcagaaccagtcaggcttatttcagtaagttccacagttctacaagactgcaggaattctccttaagggaggagagcaagcaggtgtggccccagcttctggaaatggcagaagagagggttttctcattgaatgggggtgggggctcgtgtgtcctgggaaaccccatcagtcccttcatttcttgagactcaactcctgggaggagagggtctcaagagttgtccctggaaggagggcgggggcagtctgcatctatttcaggttgtggctcttggttctaggactcttacttctctggctaagggctcagcttcttgggacttcaaccatcttctttctgaaagaccaaatctaatgtaaccagtaacgtgaggactgccaagtatggctttgtccctatgactcagaggagggtttgtcgggcaaattcaggtggatgaagtatgtgtgtgcgtgtgcatgggagtgtgcgtggactgggatatcatctctacagcctgcaaataaaccagacaaacttac

SEQ ID NO: 106663 - DNA, 3515 bp, Homo sapiens
  Payload ID: 945
  Gene Symbol: AIF1L
  Gene Name: allograft inflammatory factor 1-like
  Uniprot ID: Q9BQI0
  ENST ID: ENST00000372309
  CDS Start-End: 155-685
agggaggggtgtgtcggccgcccgcgccgttcctccgcccctcggtcccgcggccacacgcagctagccggagcccggaccaggcgcctgtgcctcctcctcgtccctcgccgcgtccgcgaagcctggagccggcgggagccccgcgctcgccatgtcgggcgagctcagcaacaggttccaaggagggaaggcgttcggcttgctcaaagcccggcaggagaggaggctggccgagatcaaccggtactgtgcagggagggagccgcagctacagaggatttcatgttcccagcacagctgcttgctggctctgctgtttcaggagtttctgtgtgaccagaagtacagtgatgaagagaaccttccagaaaagctcacagccttcaaagagaagtacatggagtttgacctgaacaatgaaggcgagattgacctgatgtctttaaagaggatgatggagaagcttggtgtccccaagacccacctggagatgaagaagatgatctcagaggtgacaggaggggtcagtgacactatatcctaccgagactttgtgaacatgatgctggggaaacggtcggctgtcctcaagttagtcatgatgtttgaaggaaaagccaacgagagcagccccaagccagttggcccccctccagagagagacattgctagcctgccctgaggaccccgcctggactccccagccttcccaccccatacctccctcccgatcttgctgcccttcttgacacactgtgatctctctctctctcatttgtttggtcattgagggtttgtttgtgttttcatcaatgtctttgtaaagcacaaattatctgccttaaaggggctctgggtcggggaatcctgagccttgggtcccctccctctcttcttccctccttccccgctccctgtgcagaagggctgacatcaaaccaaaaactagagggggcagggccagggcagggaggcttccagcctgtgttcccctcacttggaggaaccagcactctccatcctttcagaaagtctccaagccaagttcaggctcactgacctggctctgacgaggaccccaggccactctgagaagaccttggagtagggacaaggctgcagggcctctttcgggtttccttggacagtgccatggctccagtgctctggtgtcacccaggacacagccactcggggccccgctgccccagctgatccccactcattccacacctcttctcatcctcagtgatgtgaaggtgggaaggaaaggagcttggcattgggagcccttcaagaaggtaccagaaggaaccctccagtcctgctctctggccacacctgtgcaggcagctgagaggcagcgtgcagccctactgtcccttactggggcagcagagggcttcggaggcagaagtgaggcctggggttttgggggaaaggtcagctcagtgctgttccaccttttagggaggttactgaggggaccaggatgggagaatgaggagtaaaatgctcacggcaaagtcagcagcactggtaagccaagactgagaaatacaaggttgcttgtctgaccccaatctgcttgaaacctgactctgcttctctcatttgtcttcctaccctactcacataattcactcattgactcactcattcaccagatatttattgacctgctattataagctttacatcctcccatgttgtcctggcatgtgcagtatacacggtctaactcatctctccccagatctctcagaaccttgagcttgggaattgaactggggtcacctgtgtcctttcttatggactcgcaggattttagaaccctaatgcaccctggagggtagctgggccagacttctcatttcacaggtgaggagactggtgccccacagggattaagtgccttgcccaaggtcaggcttatctccagagggaggtgccctggactggggcccagatgttcagggaccctgcctacacctcatttccagtgtgggctgccttagttagttatgagaacagggaagggctgggaagagacagcctccaaggtcaacacttggagagggtttcacttgctctgaagaccctggtccaggattcgccctctcccatgccttcaagtcagcatcaggcttagggcaaagaccaggcctctgaagctgcctcttgtaattcatgcaggaagatgtcaaagtcagccccatcttggctgatcagggtgttcagccttaaccccacctgtgttctgaagtctcttaccctacctgctcaggactgagacagttattcactgaacatatttattaagcacttgctgtaggccaacagttaagaatccaataatgaaatggacagattcatggaacttagagtccaataggaaagtgagacccagacaatgacaatgagataaatgttaggaagggggaggtatggggtgacttccctgcagtcctgggggcctagatgggcccaagactgggtgagagtcttggcagagcctttgcaacaccttaagtggacaggactgggaggtcttggtggttggagccaacgtgggttccctgcggctccttagtcacctctgatagcagattgagggaggaaaacaggtaaggcatgaggaaatggccaggttgggttaacccactggtttcaaccagttcaggaatgaggttatttggccatgactggctgatcttgagctcaaggatctgcttcaaatgcacacaggcctagttgaagtttaaaccccagcaaaacattcctccctgtaaatggaaaatcctacttctacccccaccctgccctgttttttgttttttttttccccaagatcattagatgtcctcacccctcctcactgcctctcctctctgggacaggctgggacctttgaggaagataaagccttccttcactacccatcatattcagtgtccctgttcctcactcagagaggaaggcagaaccagtcaggcttatttcagtaagttccacagttctacaagactgcaggaattctccttaagggaggagagcaagcaggtgtggccccagcttctggaaatggcagaagagagggttttctcattgaatgggggtgggggctcgtgtgtcctgggaaaccccatcagtcccttcatttcttgagactcaactcctgggaggagagggtctcaagagttgtccctggaaggagggcgggggcagtctgcatctatttcaggttgtggctcttggttctaggactcttacttctctggctaagggctcagcttcttgggacttcaaccatcttctttctgaaagaccaaatctaatgtaaccagtaacgtgaggactgccaagtatggctttgtccctatgactcagaggagggtttgtcgggcaaattcaggtggatgaagtatgtgtgtgcgtgtgcatgggagtgtgcgtggactgggatatcatctctacagcctgcaaataaaccagacaaacttaccaacgtc

SEQ ID NO: 106664 - DNA, 3398 bp, Homo sapiens
  Payload ID: 945
  Gene Symbol: AIF1L
  Gene Name: allograft inflammatory factor 1-like
  ENST ID: ENST00000372314
  CDS Start-End: 101-229
cacacgcagctagccggagcccggaccaggcgcctgtgcctcctcctcgtccctcgccgcgtccgcgaagcctggagccggcgggagccccgcgctcgccatgtcgggcgagctcagcaacaggttccaaggccgcctctttgtctcctccaggagggaaggcgttcggcttgctcaaagcccggcaggagaggaggctggccgagatcaaccgggagtttctgtgtgaccagaagtacagtgatgaagagaaccttccagaaaagctcacagccttcaaagagaagtacatggagtttgacctgaacaatgaaggcgagattgacctgatgtctttaaagaggatgatggagaagcttggtgtccccaagacccacctggagatgaagaagatgatctcagaggtgacaggaggggtcagtgacactatatcctaccgagactttgtgaacatgatgctggggaaacggtcggctgtcctcaagttagtcatgatgtttgaaggaaaagccaacgagagcagccccaagccagttggcccccctccagagagagacattgctagcctgccctgaggaccccgcctggactccccagccttcccaccccatacctccctcccgatcttgctgcccttcttgacacactgtgatctctctctctctcatttgtttggtcattgagggtttgtttgtgttttcatcaatgtctttgtaaagcacaaattatctgccttaaaggggctctgggtcggggaatcctgagccttgggtcccctccctctcttcttccctccttccccgctccctgtgcagaagggctgacatcaaaccaaaaactagagggggcagggccagggcagggaggcttccagcctgtgttcccctcacttggaggaaccagcactctccatcctttcagaaagtctccaagccaagttcaggctcactgacctggctctgacgaggaccccaggccactctgagaagaccttggagtagggacaaggctgcagggcctctttcgggtttccttggacagtgccatggctccagtgctctggtgtcacccaggacacagccactcggggccccgctgccccagctgatccccactcattccacacctcttctcatcctcagtgatgtgaaggtgggaaggaaaggagcttggcattgggagcccttcaagaaggtaccagaaggaaccctccagtcctgctctctggccacacctgtgcaggcagctgagaggcagcgtgcagccctactgtcccttactggggcagcagagggcttcggaggcagaagtgaggcctggggttttgggggaaaggtcagctcagtgctgttccaccttttagggaggttactgaggggaccaggatgggagaatgaggagtaaaatgctcacggcaaagtcagcagcactggtaagccaagactgagaaatacaaggttgcttgtctgaccccaatctgcttgaaacctgactctgcttctctcatttgtcttcctaccctactcacataattcactcattgactcactcattcaccagatatttattgacctgctattataagctttacatcctcccatgttgtcctggcatgtgcagtatacacggtctaactcatctctccccagatctctcagaaccttgagcttgggaattgaactggggtcacctgtgtcctttcttatggactcgcaggattttagaaccctaatgcaccctggagggtagctgggccagacttctcatttcacaggtgaggagactggtgccccacagggattaagtgccttgcccaaggtcaggcttatctccagagggaggtgccctggactggggcccagatgttcagggaccctgcctacacctcatttccagtgtgggctgccttagttagttatgagaacagggaagggctgggaagagacagcctccaaggtcaacacttggagagggtttcacttgctctgaagaccctggtccaggattcgccctctcccatgccttcaagtcagcatcaggcttagggcaaagaccaggcctctgaagctgcctcttgtaattcatgcaggaagatgtcaaagtcagccccatcttggctgatcagggtgttcagccttaaccccacctgtgttctgaagtctcttaccctacctgctcaggactgagacagttattcactgaacatatttattaagcacttgctgtaggccaacagttaagaatccaataatgaaatggacagattcatggaacttagagtccaataggaaagtgagacccagacaatgacaatgagataaatgttaggaagggggaggtatggggtgacttccctgcagtcctgggggcctagatgggcccaagactgggtgagagtcttggcagagcctttgcaacaccttaagtggacaggactgggaggtcttggtggttggagccaacgtgggttccctgcggctccttagtcacctctgatagcagattgagggaggaaaacaggtaaggcatgaggaaatggccaggttgggttaacccactggtttcaaccagttcaggaatgaggttatttggccatgactggctgatcttgagctcaaggatctgcttcaaatgcacacaggcctagttgaagtttaaaccccagcaaaacattcctccctgtaaatggaaaatcctacttctacccccaccctgccctgttttttgttttttttttccccaagatcattagatgtcctcacccctcctcactgcctctcctctctgggacaggctgggacctttgaggaagataaagccttccttcactacccatcatattcagtgtccctgttcctcactcagagaggaaggcagaaccagtcaggcttatttcagtaagttccacagttctacaagactgcaggaattctccttaagggaggagagcaagcaggtgtggccccagcttctggaaatggcagaagagagggttttctcattgaatgggggtgggggctcgtgtgtcctgggaaaccccatcagtcccttcatttcttgagactcaactcctgggaggagagggtctcaagagttgtccctggaaggagggcgggggcagtctgcatctatttcaggttgtggctcttggttctaggactcttacttctctggctaagggctcagcttcttgggacttcaaccatcttctttctgaaagaccaaatctaatgtaaccagtaacgtgaggactgccaagtatggctttgtccctatgactcagaggagggtttgtcgggcaaattcaggtggatgaagtatgtgtgtgcgtgtgcatgggagtgtgcgtggactgggatatcatctctacagcctgcaaataaaccagacaaacttac

SEQ ID NO: 106665 - DNA, 1240 bp, Homo sapiens
  Payload ID: 946
  Gene Symbol: ATRAID
  Gene Name: all-trans retinoic acid-induced differentiation factor
  Uniprot ID: Q6UW56
  ENST ID: ENST00000380171
  CDS Start-End: 178-1032
ggatggaggggcccgagtttctgcgaagccgcgacctcggcgtccggacgcggggaacaccgggctgagggagtctgcagtcggctccgggaagccgcgcggcgacgggggaggccttcactaaaggggaaaaggaagagggggtcggccagtatccccgaaagagggctagggcgcatgaagaccagcgcagagctccacgagcaggaaaagcccccaagcagccccagggcgactggaccgggccgcttaggccacgcccggggaagagggcctgacgcgctgcggggcggggccgcggggccgggtcgcgcgagcagcggagcaccaagggaacggaaaatggcgcctcacgacccgggtagtcttacgaccctggtgccctgggctgccgccctgctcctcgctctgggcgtggaaagggctctggcgctacccgagatatgcacccaatgtccagggagcgtgcaaaatttgtcaaaagtggccttttattgtaaaacgacacgagagctaatgctgcatgcccgttgctgcctgaatcagaagggcaccatcttggggctggatctccagaactgttctctggaggaccctggtccaaactttcatcaggcacataccactgtcatcatagacctgcaagcaaaccccctcaaaggtgacttggccaacaccttccgtggctttactcagctccagactctgatactgccacaacatgtcaactgtcctggaggaattaatgcctggaatactatcacctcttatatagacaaccaaatctgtcaagggcaaaagaacctttgcaataacactggggacccagaaatgtgtcctgagaatggatcttgtgtacctgatggtccaggtcttttgcagtgtgtttgtgctgatggtttccatggatacaagtgtatgcgccagggctcgttctcactgcttatgttcttcgggattctgggagccaccactctatccgtctccattctgctttgggcgacccagcgccgaaaagccaagacttcatgaactacataggtcttaccattgacctaagatcaatctgaactatcttagcccagtcagggagctctgcttcctagaaaggcatctttcgccagtggattcgcctcaaggttgaggccgccattggaagatgaaaaattgcactcccttggtgtagacaaataccagttcccattggtgttgttgcctataataaacacttttttctttt

SEQ ID NO: 106666 - DNA, 1059 bp, Homo sapiens
  Payload ID: 946
  Gene Symbol: ATRAID
  Gene Name: all-trans retinoic acid-induced differentiation factor
  Uniprot ID: Q6UW56
  ENST ID: ENST00000405489
  CDS Start-End: 314-829
tggcgcctcacgacccgggtagtcttacgaccctggtgccctgggctgccgccctgctcctcgctctgggcgtggaaagggctctggcgctacccgaggtacagaagcaagtttgaggtcgggctgaagcagggtcgctggccagccgtgcgtcgcgctcgccagcggctcccccttctcctcggcgggcctgcggttctgatttcgtccctgacgcttcccgaccctgcccagccagatatgcacccaatgtccagggagcgtgcaaaatttgtcaaaagtggccttttattgtaaaacgacacgagagctaatgctgcatgcccgttgctgcctgaatcagaagggcaccatcttggggctggatctccagaactgttctctggaggaccctggtccaaactttcatcaggcacataccactgtcatcatagacctgcaagcaaaccccctcaaaggtgacttggccaacaccttccgtggctttactcagctccagactctgatactgccacaacatgtcaactgtcctggaggaattaatgcctggaatactatcacctcttatatagacaaccaaatctgtcaagggcaaaagaacctttgcaataacactggggacccagaaatgtgtcctgagaatggatcttgtgtacctgatggtccaggtcttttgcagtgtgtttgtgctgatggtttccatggatacaagtgtatgcgccagggctcgttctcactgcttatgttcttcgggattctgggagccaccactctatccgtctccattctgctttgggcgacccagcgccgaaaagccaagacttcatgaactacataggtcttaccattgacctaagatcaatctgaactatcttagcccagtcagggagctctgcttcctagaaaggcatctttcgccagtggattcgcctcaaggttgaggccgccattggaagatgaaaaattgcactcccttggtgtagacaaataccagttcccattggtgttgttgcctataataaacacttttttctttttttttcctctctttctttttaa

SEQ ID NO: 106667 - DNA, 612 bp, Homo sapiens
  Payload ID: 946
  Gene Symbol: ATRAID
  Gene Name: all-trans retinoic acid-induced differentiation factor
  ENST ID: ENST00000419744
  CDS Start-End: 387-612
gtcagattgagaagtctctgcagaaagcataataaataagttcgaatagtgatcttcagagatgaggaccttccctgtgcgatatctggtactgaaagtgtcgggagctgattcggcgcaggactctggaggaagagatggcatctcctagcctagcctgttacaagggtgggacacgagccgtttatccatttatcggccccgtgttagaggaattctggaaacgtgtactggcagttaattcttgatcgccgtttgttcttttcttggcttttctttctggagttctaatgtttctttctcttctgcagatatgcacccaatgtccagggagcgtgcaaaatttgtcaaaagtggccttttattgtaaaacgacacgagagctaatgctgcatgcccgttgctgcctgaatcagaagggcaccatcttggggctggatctccagaactgttctctggaggaccctggtccaaactttcatcaggcacataccactgtcatcatagacctgcaagcaaaccccctcaaaggtgacttggccaacaccttccgtggctttactcagctccagactctgatactgccacaacatgtcaactgtcctggaggaa

SEQ ID NO: 106668 - DNA, 956 bp, Homo sapiens
  Payload ID: 946
  Gene Symbol: ATRAID
  Gene Name: all-trans retinoic acid-induced differentiation factor
  Uniprot ID: Q6UW56
  ENST ID: ENST00000606999
  CDS Start-End: 59-748
gcggggcggggccgcggggccgggtcgcgcgagcagcggagcaccaagggaacggaaaatggcgcctcacgacccgggtagtcttacgaccctggtgccctgggctgccgccctgctcctcgctctgggcgtggaaagggctctggcgctacccgagatatgcacccaatgtccagggagcgtgcaaaatttgtcaaaagtggccttttattgtaaaacgacacgagagctaatgctgcatgcccgttgctgcctgaatcagaagggcaccatcttggggctggatctccagaactgttctctggaggaccctggtccaaactttcatcaggcacataccactgtcatcatagacctgcaagcaaaccccctcaaaggtgacttggccaacaccttccgtggctttactcagctccagactctgatactgccacaacatgtcaactgtcctggaggaattaatgcctggaatactatcacctcttatatagacaaccaaatctgtcaagggcaaaagaacctttgcaataacactggggacccagaaatgtgtcctgagaatggatcttgtgtacctgatggtccaggtcttttgcagtgtgtttgtgctgatggtttccatggatacaagtgtatgcgccagggctcgttctcactgcttatgttcttcgggattctgggagccaccactctatccgtctccattctgctttgggcgacccagcgccgaaaagccaagacttcatgaactacataggtcttaccattgacctaagatcaatctgaactatcttagcccagtcagggagctctgcttcctagaaaggcatctttcgccagtggattcgcctcaaggttgaggccgccattggaagatgaaaaattgcactcccttggtgtagacaaataccagttcccattggtgttgttgcctataataaacacttttttctttt

SEQ ID NO: 106669 - DNA, 1256 bp, Homo sapiens
  Payload ID: 946
  Gene Symbol: ATRAID
  Gene Name: all-trans retinoic acid-induced differentiation factor
  Uniprot ID: Q6UW56
  ENST ID: ENST00000611786
  CDS Start-End: 174-1028
ggaggggcccgagtttctgcgaagccgcgacctcggcgtccggacgcggggaacaccgggctgagggagtctgcagtcggctccgggaagccgcgcggcgacgggggaggccttcactaaaggggaaaaggaagagggggtcggccagtatccccgaaagagggctagggcgcatgaagaccagcgcagagctccacgagcaggaaaagcccccaagcagccccagggcgactggaccgggccgcttaggccacgcccggggaagagggcctgacgcgctgcggggcggggccgcggggccgggtcgcgcgagcagcggagcaccaagggaacggaaaatggcgcctcacgacccgggtagtcttacgaccctggtgccctgggctgccgccctgctcctcgctctgggcgtggaaagggctctggcgctacccgagatatgcacccaatgtccagggagcgtgcaaaatttgtcaaaagtggccttttattgtaaaacgacacgagagctaatgctgcatgcccgttgctgcctgaatcagaagggcaccatcttggggctggatctccagaactgttctctggaggaccctggtccaaactttcatcaggcacataccactgtcatcatagacctgcaagcaaaccccctcaaaggtgacttggccaacaccttccgtggctttactcagctccagactctgatactgccacaacatgtcaactgtcctggaggaattaatgcctggaatactatcacctcttatatagacaaccaaatctgtcaagggcaaaagaacctttgcaataacactggggacccagaaatgtgtcctgagaatggatcttgtgtacctgatggtccaggtcttttgcagtgtgtttgtgctgatggtttccatggatacaagtgtatgcgccagggctcgttctcactgcttatgttcttcgggattctgggagccaccactctatccgtctccattctgctttgggcgacccagcgccgaaaagccaagacttcatgaactacataggtcttaccattgacctaagatcaatctgaactatcttagcccagtcagggagctctgcttcctagaaaggcatctttcgccagtggattcgcctcaaggttgaggccgccattggaagatgaaaaattgcactcccttggtgtagacaaataccagttcccattggtgttgttgcctataataaacacttttttctttttttttcctctctttcttttt

SEQ ID NO: 106670 - DNA, 1023 bp, Homo sapiens
  Payload ID: 947
  Gene Symbol: A3GALT2
  Gene Name: alpha 1,3-galactosyltransferase 2
  ENST ID: ENST00000442999
  CDS Start-End: 1-1023
atggctctcaaggagggactcagggcctggaagagaatcttctggcggcagatcctacttacacttggcctcttaggcctgtttctgtatggcctccctaaattcaggcatctggaagccctcatccccatgggcgtctgcccttcggccacaatgtcccagctgagagacaacttcacaggtgccctgcgtccctgggcccggcctgaagttctgacctgtaccccctggggggctcccattatttgggatggctctttcgacccagatgtggccaagcaagaggctagacagcagaacctcaccattgggctgactatctttgctgtaggcagatacctggagaagtacctggagcgcttcctggagacggcggagcagcacttcatggcgggccagagcgtgatgtactacgtgttcaccgagcttccgggagcggtgccccgcgtggcgctgggcccgggacgccggctgcccgtggagcgcgtggcgcgcgagcggcgctggcaagacgtgtcgatggcgcgcatgcgcacgttgcacgcggcgctgggcgggctgccgggccgcgaggcgcacttcatgttctgcatggacgtggaccagcacttcagcggcacttttgggcccgaggcgctggccgagtcggtggcgcagctgcactcctggcactaccactggccgtcgtggctgctgcccttcgaacgcgacgcgcattcggccgccgcgatggcgtggggccagggcgacttctataaccacgcggcggtgttcgggggcagcgtggcggcgctgcgcgggctgacggcgcactgtgcggggggcctggactgggaccgcgcgcgcggcctggaggcgcgctggcacgacgagagccacctcaacaagttcttctggctgcacaagcccgccaaggtgctgtcgcccgagttctgctggagcccggacatcggcccgcgggccgagatccgccgcccgcgactgctgtgggcgcccaaggggtaccggctgctgcggaactag

SEQ ID NO: 106671 - DNA, 2020 bp, Homo sapiens
  Payload ID: 948
  Gene Symbol: A4GALT
  Gene Name: alpha 1,4-galactosyltransferase
  Uniprot ID: Q9NPC4
  ENST ID: ENST00000249005
  CDS Start-End: 190-1251
agatggatttgcagccgctgcaagtgtgtggaagggccgtgttcgtgttggcaaagaaggtcggctgctgagccagggcgtgtctcccggaggcctgtgggctgccaggatccccacctctctgcaatgggctgcccaggctgaccagccggttcctgctggaagctcctggtctgatctggggataccatgtccaagccccccgacctcctgctgcggctgctccggggcgccccaaggcagcgggtctgcaccctgttcatcatcggcttcaagttcacgtttttcgtctccatcatgatctactggcacgttgtgggagagcccaaggagaaagggcagctctataacctgccagcagagatcccctgccccaccttgacaccccccaccccaccctcccacggccccactccaggcaacatcttcttcctggagacttcagaccggaccaaccccaacttcctgttcatgtgctcggtggagtcggccgccagaactcaccccgaatcccacgtgctggtcctgatgaaagggcttccgggtggcaacgcctctctgccccggcacctgggcatctcacttctgagctgcttcccgaatgtccagatgctcccgctggacctgcgggagctgttccgggacacacccctggccgactggtacgcggccgtgcaggggcgctgggagccctacctgctgcccgtgctctccgacgcctccaggatcgcactcatgtggaagttcggcggcatctacctggacacggacttcattgttctcaagaacctgcggaacctgaccaacgtgctgggcacccagtcccgctacgtcctcaacggcgcgttcctggccttcgagcgccggcacgagttcatggcgctgtgcatgcgggacttcgtggaccactacaacggctggatctggggtcaccagggcccgcagctgctcacgcgggtcttcaagaagtggtgttccatccgcagcctggccgagagccgcgcctgccgcggcgtcaccaccctgccccctgaggccttctaccccatcccctggcaggactggaagaagtactttgaggacatcaaccccgaggagctgccgcggctgctcagtgccacctatgctgtccacgtgtggaacaagaagagccagggcacgcggttcgaggccacgtccagggcactgctggcccagctgcatgcccgctactgccccacgacgcacgaggccatgaaaatgtacttgtgaggggcccgccaggtcacctccccaacctgctcctgatggggcactgggccgcccttcccggggaggcaagattgagggcccgggagagggaggcccgagctgccaccgggcttaggcaggctgttgaggagctgtgggagcaggcccagtgggaggctgtggacaccccgaggacagtgtcctgtctcgaggcagggctgacacatggtgccatagccagcggagggcgctcagtgagtgccccgggccttctagacaacaggcaggaaggatgaacctcagggcacccccaggtggtgcggaaagccaggcagttgggacagaggtgcccacgagggcagaggccggtgctaaggggatggggaagaagggacaagattcccagagaggagaggaggctgttggtaggaaagtggcagggctgggggagacccagccccaagggtccggggcggaggatgctttgttcttttctggttttggttcctctttcgcggggggtgggggaggtcaacagggactgagtggggcagaggcccagaagtgccagcctggggagccgtttgggggcagccccttctgcccaccccatccttcttcctctccagagatgccaggggggcgtgtatgctctgccccttccctcagacaggggctgggtggggaggctctttaggctcaggagaagcattttaaagaaacccccaccctgccgcccgcattataaacacaggagaataatcaatagaataaaagtgaccgactgtca

SEQ ID NO: 106672 - DNA, 1935 bp, Homo sapiens
  Payload ID: 948
  Gene Symbol: A4GALT
  Gene Name: alpha 1,4-galactosyltransferase
  Uniprot ID: Q9NPC4
  ENST ID: ENST00000381278
  CDS Start-End: 106-1167
agatggatttgcagccgctgcaagtgtgtggaagggccgtgttcgtgttggcaaagaagaccagccggttcctgctggaagctcctggtctgatctggggataccatgtccaagccccccgacctcctgctgcggctgctccggggcgccccaaggcagcgggtctgcaccctgttcatcatcggcttcaagttcacgtttttcgtctccatcatgatctactggcacgttgtgggagagcccaaggagaaagggcagctctataacctgccagcagagatcccctgccccaccttgacaccccccaccccaccctcccacggccccactccaggcaacatcttcttcctggagacttcagaccggaccaaccccaacttcctgttcatgtgctcggtggagtcggccgccagaactcaccccgaatcccacgtgctggtcctgatgaaagggcttccgggtggcaacgcctctctgccccggcacctgggcatctcacttctgagctgcttcccgaatgtccagatgctcccgctggacctgcgggagctgttccgggacacacccctggccgactggtacgcggccgtgcaggggcgctgggagccctacctgctgcccgtgctctccgacgcctccaggatcgcactcatgtggaagttcggcggcatctacctggacacggacttcattgttctcaagaacctgcggaacctgaccaacgtgctgggcacccagtcccgctacgtcctcaacggcgcgttcctggccttcgagcgccggcacgagttcatggcgctgtgcatgcgggacttcgtggaccactacaacggctggatctggggtcaccagggcccgcagctgctcacgcgggtcttcaagaagtggtgttccatccgcagcctggccgagagccgcgcctgccgcggcgtcaccaccctgccccctgaggccttctaccccatcccctggcaggactggaagaagtactttgaggacatcaaccccgaggagctgccgcggctgctcagtgccacctatgctgtccacgtgtggaacaagaagagccagggcacgcggttcgaggccacgtccagggcactgctggcccagctgcatgcccgctactgccccacgacgcacgaggccatgaaaatgtacttgtgaggggcccgccaggtcacctccccaacctgctcctgatggggcactgggccgcccttcccggggaggcaagattgagggcccgggagagggaggcccgagctgccaccgggcttaggcaggctgttgaggagctgtgggagcaggcccagtgggaggctgtggacaccccgaggacagtgtcctgtctcgaggcagggctgacacatggtgccatagccagcggagggcgctcagtgagtgccccgggccttctagacaacaggcaggaaggatgaacctcagggcacccccaggtggtgcggaaagccaggcagttgggacagaggtgcccacgagggcagaggccggtgctaaggggatggggaagaagggacaagattcccagagaggagaggaggctgttggtaggaaagtggcagggctgggggagacccagccccaagggtccggggcggaggatgctttgttcttttctggttttggttcctctttcgcggggggtgggggaggtcaacagggactgagtggggcagaggcccagaagtgccagcctggggagccgtttgggggcagccccttctgcccaccccatccttcttcctctccagagatgccaggggggcgtgtatgctctgccccttccctcagacaggggctgggtggggaggctctttaggctcaggagaagcattttaaagaaacccccaccctgccgcccgcattataaacacaggagaataatcaatagaataaaagtgaccgactgtc

SEQ ID NO: 106673 - DNA, 2321 bp, Homo sapiens
  Payload ID: 948
  Gene Symbol: A4GALT
  Gene Name: alpha 1,4-galactosyltransferase
  Uniprot ID: Q9NPC4
  ENST ID: ENST00000401850
  CDS Start-End: 491-1552
tgcacttctgtgcctcaatttcctcatctgtagggtgggggtggtgattgccaccccatagggtggttataaggggccacacatgttcctatgtgtgagatgctgagaaagtcacctggcatggacaggatggacagccagtatttatcgaactatgaatgaatgaatgttaccctttagtgggttccagcgtcctatcctgtcggtgggaagactgaggctcagagagctccgtaacttgccccaggtcacacagccggttcaggcagagttggggtctcatgcctcccaggtgttcccacagtcttttccccaggagcagggtccaagcctgctgctcctccaaccacctgcgaggcacctgggcatgttcctggccaccaggaaagagaggtctaatggcagtagtaccagtcagcgtcatgtgcctggagcgagtgccctaccagccggttcctgctggaagctcctggtctgatctggggataccatgtccaagccccccgacctcctgctgcggctgctccggggcgccccaaggcagcgggtctgcaccctgttcatcatcggcttcaagttcacgtttttcgtctccatcatgatctactggcacgttgtgggagagcccaaggagaaagggcagctctataacctgccagcagagatcccctgccccaccttgacaccccccaccccaccctcccacggccccactccaggcaacatcttcttcctggagacttcagaccggaccaaccccaacttcctgttcatgtgctcggtggagtcggccgccagaactcaccccgaatcccacgtgctggtcctgatgaaagggcttccgggtggcaacgcctctctgccccggcacctgggcatctcacttctgagctgcttcccgaatgtccagatgctcccgctggacctgcgggagctgttccgggacacacccctggccgactggtacgcggccgtgcaggggcgctgggagccctacctgctgcccgtgctctccgacgcctccaggatcgcactcatgtggaagttcggcggcatctacctggacacggacttcattgttctcaagaacctgcggaacctgaccaacgtgctgggcacccagtcccgctacgtcctcaacggcgcgttcctggccttcgagcgccggcacgagttcatggcgctgtgcatgcgggacttcgtggaccactacaacggctggatctggggtcaccagggcccgcagctgctcacgcgggtcttcaagaagtggtgttccatccgcagcctggccgagagccgcgcctgccgcggcgtcaccaccctgccccctgaggccttctaccccatcccctggcaggactggaagaagtactttgaggacatcaaccccgaggagctgccgcggctgctcagtgccacctatgctgtccacgtgtggaacaagaagagccagggcacgcggttcgaggccacgtccagggcactgctggcccagctgcatgcccgctactgccccacgacgcacgaggccatgaaaatgtacttgtgaggggcccgccaggtcacctccccaacctgctcctgatggggcactgggccgcccttcccggggaggcaagattgagggcccgggagagggaggcccgagctgccaccgggcttaggcaggctgttgaggagctgtgggagcaggcccagtgggaggctgtggacaccccgaggacagtgtcctgtctcgaggcagggctgacacatggtgccatagccagcggagggcgctcagtgagtgccccgggccttctagacaacaggcaggaaggatgaacctcagggcacccccaggtggtgcggaaagccaggcagttgggacagaggtgcccacgagggcagaggccggtgctaaggggatggggaagaagggacaagattcccagagaggagaggaggctgttggtaggaaagtggcagggctgggggagacccagccccaagggtccggggcggaggatgctttgttcttttctggttttggttcctctttcgcggggggtgggggaggtcaacagggactgagtggggcagaggcccagaagtgccagcctggggagccgtttgggggcagccccttctgcccaccccatccttcttcctctccagagatgccaggggggcgtgtatgctctgccccttccctcagacaggggctgggtggggaggctctttaggctcaggagaagcattttaaagaaacccccaccctgccgcccgcattataaacacaggagaataatcaatagaataaaagtgaccgactgtca

SEQ ID NO: 106674 - DNA, 2841 bp, Homo sapiens
  Payload ID: 949
  Gene Symbol: AAGAB
  Gene Name: alpha- and gamma-adaptin binding protein
  Uniprot ID: Q6PD74
  ENST ID: ENST00000261880
  CDS Start-End: 106-1053
attccgagaacgccctctccggcctgtctccccctcgcgccggcggccgtggtgcagcccaaggcggaagcggctgcctgacggaaccggctcgcgagcgcagctatggctgctggcgtaccctgtgcgttagtcaccagctgctcctccgtcttctcaggagaccagctggtccaacatatccttggaacagaagatcttattgtggaagtgacttccaatgatgctgtgagattttatccctggaccattgataataaatactattcagcagacatcaatctatgtgtggtgccaaacaaatttcttgttactgcagagattgcagaatctgtccaagcatttgtggtttactttgacagcacacaaaaatcgggccttgatagtgtctcctcatggcttccactggcaaaagcatggttacctgaggtgatgatcttggtctgcgatagagtgtctgaagatggtataaaccgacaaaaagctcaagaatggtgcatcaaacatggctttgaattggtagaacttagtccagaggagttgcctgaggaggatgatgacttcccagaatctacaggagtaaagcgaattgtccaagccctgaatgccaatgtgtggtccaatgtagtgatgaagaatgataggaaccaaggctttagccttctcaactcattgactggaacaaaccatagcattgggtcagcagatccctgtcacccagagcaaccccatttgccagcagcagatagtactgaatccctctctgatcatcggggtggtgcatctaacacaacagatgcccaggttgatagcattgtggatcccatgttagatctggatattcaagaattagccagtcttaccactggaggaggagatgtggagaattttgaaagactcttttcaaagttaaaggaaatgaaagacaaggctgcgacgcttcctcatgagcaaagaaaagtgcatgcagaaaaggtggccaaagcattctggatggcaatcgggggagacagagatgaaattgaaggcctttcatctgatgaagagcactgaattattcatactagggtttgaccaacaaagatgctagctgtctctgagatacctctctactcagcccagtcatattttgccaaaattgcccttatcatgttggctgcctgacttgtttatagggtccccttaattttagtttttagtaggaggttaaggagaaatcttttttttcctcagtatattgtaagagagtgaggaatacagtgatagtaatgagtgaggatttcttaaatatactttttttttgttctaggaatgagggtaggataaatctcagaggtctgtgtgatttactcaagttgaagacaacctccaggccattcctggtcaaccttttaagtagcatttccagcattcacacttgatactgcacatcaggagttgtgtcacctttcctgggtgatttgggttttctccattcaaggagcttgtagctctgagctatgatgcttttattgggaggaaaggaggcagctgcagaattgatgtgagctatgtggggccgaagtctcagcccgcagctaagtctctacctaagaaaatgcctctgggcattcttttgaagtatagtgtctgagctcatgctagaaagaatcaaaaagccagtgtggatttttagactgtaataaatgaggcaaaggatttctattccagtgggaagaaaacctctctactgagttgtgggggatatgttgtatgttagagagaaccttaaggagtccttgtatgggccatggagacagtatgtgataacataccgtgattttcatgaagaaattcttctgtcttagagttctcccctgctgcttgagatgccagagctgtgttgttgcacacctgcaaaacaaggcacatttccccctttctctttaaagccaaagagagatcactgccaaagtgggagcactaaggggtgggtggggaagtgaaatgttaggcgatgaattcctgagcaccttgtttttcttccaaggttcgtagctcctctctgcccttccaagcctgtaacctcggaggactatcttttgttctttatcctttgtcttgtttgagtgggtcagccccagaggaactgataagcaaatggcaagtttttaaaggaagagtggaaagtactgcaaataaaaatccttatttgtttttgtagactttgtaatgcatatcattagccctcactgtgatcattactgctgtggctctgaactggcacatagtacagtggatggaaggtgcccgcacaccagctgagaactggttctggcctaggtgggctctagaaccatttacacagcatgaaagaaacaggttgggttaggagcagaaagaaataaggctcacacccctccagacactaccttataagcactgcagaacctgaaacagatggcagaaggaatggaatgctacaggggccagcaggagtgaccacagggaggggacagctcagtgactggagcattcaggaagaggctttccagggaacactggacattgcttagtgaccttttgttcctttttttttttttttcttttactgttctgaaagactttgagtctgtggttcaccaccagcccatcagtgtttctttgaggtgattgcattagggaagttggctctgggattgcaaaaaaaaaaaaaaggtggaacatgttttccttaaaagatggaaggttttagaaaatatactaggccatctggttagaaaaaacagaccagactagaaaaagctgtgaatttgattttgtagattaaacaaagccagatgattaaaatgtgatttattt

SEQ ID NO: 106675 - DNA, 1015 bp, Homo sapiens
  Payload ID: 949
  Gene Symbol: AAGAB
  Gene Name: alpha- and gamma-adaptin binding protein
  Uniprot ID: Q6PD74
  ENST ID: ENST00000542650
  CDS Start-End: 314-934
aacggttttagagttttcccagaggcagaaagtcctgcttctggggcgtaacctacaggatatccttggaacagaagatcttattgtggaagtgacttccaatgatgctgtgagattttatccctggaccattgataataaatactattcagcagacatcaatctatgtgtggtgccaaacaaatttcttgttactgcagagattgcagaatctgtccaagcatttgtggtttactttgacagcacacaaaaatcgggccttgatagtgtctcctcatggcttccactggcaaaagcatggttacctgaggtgatgatcttggtctgcgatagagtgtctgaagatggtataaaccgacaaaaagctcaagaatggtgcatcaaacatggctttgaattggtagaacttagtccagaggagttgcctgaggaggatgatgacttcccagaatctacaggagtaaagcgaattgtccaagccctgaatgccaatgtgtggtccaatgtagtgatgaagaatgataggaaccaaggctttagccttctcaactcattgactggaacaaaccatagcattgggtcagcagatccctgtcacccagagcaaccccatttgccagcagcagatagtactgaatccctctctgatcatcggggtggtgcatctaacacaacagatgcccaggttgatagcattgtggatcccatgttagatctggatattcaagaattagccagtcttaccactggaggaggagatgtggagaattttgaaagactcttttcaaagttaaaggaaatgaaagacaaggctgcgacgcttcctcatgagcaaagaaaagtgcatgcagaaaaggtggccaaagcattctggatggcaatcgggggagacagagatgaaattgaaggcctttcatctgatgaagagcactgaattattcatactagggtttgaccaacaaagatgctagctgtctctgagatacctctctactcagcccagtcatattttgcc

SEQ ID NO: 106676 - DNA, 563 bp, Homo sapiens
  Payload ID: 949
  Gene Symbol: AAGAB
  Gene Name: alpha- and gamma-adaptin binding protein
  ENST ID: ENST00000560362
  CDS Start-End: 390-563
aatccagttactcttccctcagcaagtctatgctactccagtgactcttacctcagcaagtccatactactccagtgatcgacctgtcatataaactgcaacaaatactgcataaacttgcaccagaagactgggatatccttggaacagaagatcttattgtggaagtgacttccaatgatgctgtgagattttatccctggaccattgataataaatactattcagcagacatcaatctatgtgtggtgccaaacaaatttcttgttactgcagagattgcagaatctgtccaagcatttgtggtttactttgacagcacacaaaaatcgggccttgatagtgtctcctcatggcttccactggcaaaagcatggttacctgaggtgatgatcttggtctgcgatagagtgtctgaagatggtataaaccgacaaaaagctcaagaatggtgcatcaaacatggctttgaattggtagaacttagtccagaggagttgcctgaggaggatgatgacttcccagaatctacaggagtaaagcgaattgtccaagccctgaat

SEQ ID NO: 106677 - DNA, 2251 bp, Homo sapiens
  Payload ID: 949
  Gene Symbol: AAGAB
  Gene Name: alpha- and gamma-adaptin binding protein
  Uniprot ID: Q6PD74
  ENST ID: ENST00000561452
  CDS Start-End: 517-1137
aggcggaagcggctgcctgacggaaccggctcgcgagcgcagctatggctgctggcgtaccctgtgcgttagtcaccagctgctcctccgtcttctcaggagaccagctggtccaacgtgagtagataggcgcctgggccgacctccaaggcccctgagcctcagcgggcgacggacccagcaccacggcctctctgggccttgtccccgcagcgggccctgcgttcttcctccagtcagtggaggcgcccagtctccccagatatccttggaacagaagatcttattgtggaagtgacttccaatgatgctgtgagattttatccctggaccattgataataaatactattcagcagacatcaatctatgtgtggtgccaaacaaatttcttgttactgcagagattgcagaatctgtccaagcatttgtggtttactttgacagcacacaaaaatcgggccttgatagtgtctcctcatggcttccactggcaaaagcatggttacctgaggtgatgatcttggtctgcgatagagtgtctgaagatggtataaaccgacaaaaagctcaagaatggtgcatcaaacatggctttgaattggtagaacttagtccagaggagttgcctgaggaggatgatgacttcccagaatctacaggagtaaagcgaattgtccaagccctgaatgccaatgtgtggtccaatgtagtgatgaagaatgataggaaccaaggctttagccttctcaactcattgactggaacaaaccatagcattgggtcagcagatccctgtcacccagagcaaccccatttgccagcagcagatagtactgaatccctctctgatcatcggggtggtgcatctaacacaacagatgcccaggttgatagcattgtggatcccatgttagatctggatattcaagaattagccagtcttaccactggaggaggagatgtggagaattttgaaagactcttttcaaagttaaaggaaatgaaagacaaggctgcgacgcttcctcatgagcaaagaaaagtgcatgcagaaaaggtggccaaagcattctggatggcaatcgggggagacagagatgaaattgaaggcctttcatctgatgaagagcactgaattattcatactagggtttgaccaacaaagatgctagctgtctctgagatacctctctactcagcccagtcatattttgccaaaattgcccttatcatgttggctgcctgacttgtttatagggtccccttaattttagtttttagtaggaggttaaggagaaatcttttttttcctcagtatattgtaagagagtgaggaatacagtgatagtaatgagtgaggatttcttaaatatactttttttttgttctaggaatgagggtaggataaatctcagaggtctgtgtgatttactcaagttgaagacaacctccaggccattcctggtcaaccttttaagtagcatttccagcattcacacttgatactgcacatcaggagttgtgtcacctttcctgggtgatttgggttttctccattcaaggagcttgtagctctgagctatgatgcttttattgggaggaaaggaggcagctgcagaattgatgtgagctatgtggggccgaagtctcagcccgcagctaagtctctacctaagaaaatgcctctgggcattcttttgaagtatagtgtctgagctcatgctagaaagaatcaaaaagccagtgtggatttttagactgtaataaatgaggcaaaggatttctattccagtgggaagaaaacctctctactgagttgtgggggatatgttgtatgttagagagaaccttaaggagtccttgtatgggccatggagacagtatgtgataacataccgtgattttcatgaagaaattcttctgtcttagagttctcccctgctgcttgagatgccagagctgtgttgttgcacacctgcaaaacaaggcacatttccccctttctctttaaagccaaagagagatcactgccaaagtgggagcactaaggggtgggtggggaagtgaaatgttaggcgatgaattcctgagcaccttgtttttcttccaaggttcgtagctcctctctgcccttccaagcctgtaacctcggaggactatcttttgttctttatcctttgtcttgtttgagtgggtcagccccagaggaactgataagcaaatggcaagtttttaaaggaagagtggaa

SEQ ID NO: 106678 - DNA, 524 bp, Homo sapiens
  Payload ID: 950
  Gene Symbol: AHSP
  Gene Name: alpha hemoglobin stabilizing protein
  Uniprot ID: Q9NZD4
  ENST ID: ENST00000302312
  CDS Start-End: 104-412
tgacacttgactccttgcctacatctatagcttggcacagagagattcacgcaccctcaagagtgtgggtgagacatatacagcctgttagacctgaaggcagatggctcttcttaaggccaataaggatctcatttccgcaggattgaaggagttcagcgttctgctgaatcagcaggtcttcaatgatcctctcgtctctgaagaagacatggtgactgtggtggaggactggatgaacttctacatcaactattacaggcagcaggtgacaggggagccccaagagcgagacaaggctctgcaggagcttcggcaagagctgaacactctggccaaccctttcctggccaagtacagggacttcctgaagtctcatgagctcccgagtcacccaccgccctcctcctagctcagggacccagcccctcctctctgagaaactctgaccttcatgtccttaggctgtgctcctgccactctaccctgacacctcaataaagaccagtgctggttttgttgga

SEQ ID NO: 106679 - DNA, 213 bp, Homo sapiens
  Payload ID: 950
  Gene Symbol: AHSP
  Gene Name: alpha hemoglobin stabilizing protein
  ENST ID: ENST00000564707
  CDS Start-End: 43-213
ggaaaatcgtgacctcagagcagggcaggatgtgaaaggcagatggctcttcttaaggccaataaggatctcatttccgcaggattgaaggagttcagcgttctgctgaatcagcaggtcttcaatgatcctctcgtctctgaagaagacatggtgactgtggtggaggactggatgaacttctacatcaactattacaggcagcaggtgaca

SEQ ID NO: 106680 - DNA, 11220 bp, Homo sapiens
  Payload ID: 951
  Gene Symbol: ATRX
  Gene Name: alpha thalassemia/mental retardation syndrome X-linked
  Uniprot ID: P46100
  ENST ID: ENST00000373344
  CDS Start-End: 269-7747
aatggctgacggaaagagaaagagggaggacgcgccaattctcctgcctgagcctcggcccaacaaaatggcggcggcagcggtgtcgctttgtttccgcggctcctgcggcggtggcagtggtagcggcctttgagctgtggggaggttccagcagcagctacagtgacgactaagactccagtgcatttctatcgtaaccgggcgcgggggagcgcagatcggcgcccagcaatcacagaagccgacaaggcgttcaagcgaaaacatgaccgctgagcccatgagtgaaagcaagttgaatacattggtgcagaagcttcatgacttccttgcacactcatcagaagaatctgaagaaacaagttctcctccacgacttgcaatgaatcaaaacacagataaaatcagtggttctggaagtaactctgatatgatggaaaacagcaaggaagagggaactagctcttcagaaaaatccaagtcttcaggatcgtcacgatcaaagaggaaaccttcaattgtaacaaagtatgtagaatcagatgatgaaaaacctttggatgatgaaactgtaaatgaagatgcgtctaatgaaaattcagaaaatgatattactatgcagagcttgccaaaaggtacagtgattgtacagccagagccagtgctgaatgaagacaaagatgattttaaagggcctgaatttagaagcagaagtaaaatgaaaactgaaaatctcaaaaaacgcggagaagatgggcttcatgggattgtgagctgcactgcttgtggacaacaggtcaatcattttcaaaaagattccatttatagacacccttcattgcaagttcttatttgtaagaattgctttaagtattacatgagtgatgatattagccgtgactcagatggaatggatgaacaatgtaggtggtgtgcggaaggtggaaacttgatttgttgtgacttttgccataatgctttctgcaagaaatgcattctacgcaaccttggtcgaaaggagttgtccacaataatggatgaaaacaaccaatggtattgctacatttgtcacccagagcctttgttggacttggtcactgcatgtaacagcgtatttgagaatttagaacagttgttgcagcaaaataagaagaagataaaagttgacagtgaaaagagtaataaagtatatgaacatacatccagattttctccaaagaagactagttcaaattgtaatggagaagaaaagaaattagatgattcctgttctggctctgtaacctactcttattccgcactaattgtgcccaaagagatgattaagaaggcaaaaaaactgattgagaccacagccaacatgaactccagttatgttaaatttttaaagcaggcaacagataattcagaaatcagttctgctacaaaattacgtcagcttaaggcttttaagtctgtgttggctgatattaagaaggctcatcttgcattggaagaagacttaaattccgagtttcgagcgatggatgctgtaaacaaagagaaaaataccaaagagcataaagtcatagatgctaagtttgaaacaaaagcacgaaaaggagaaaaaccttgtgctttggaaaagaaggatatttcaaagtcagaagctaaactttcaagaaaacaggtagatagtgagcacatgcatcagaatgttccaacagaggaacaaagaacaaataaaagtaccggtggtgaacataagaaatctgatagaaaagaagaacctcaatatgaacctgccaacacttctgaagatttagacatggatattgtgtctgttccttcctcagttccagaagacatttttgagaatcttgagactgctatggaagttcagagttcagttgatcatcaaggggatggcagcagtggaactgaacaagaagtggagagttcatctgtaaaattaaatatttcttcaaaagacaacagaggaggtattaaatcaaaaactacagctaaagtaacaaaagaattatatgttaaactcactcctgtttccctttctaattccccaattaaaggtgctgattgtcaggaagttccacaagataaagatggctataaaagttgtggtctgaaccccaagttagagaaatgtggacttggacaggaaaacagtgataatgagcatttggttgaaaatgaagtttcattacttttagaggaatctgatcttcgaagatccccacgtgtaaagactacacccttgaggcgaccgacagaaactaaccctgtaacatctaattcagatgaagaatgtaatgaaacagttaaggagaaacaaaaactatcagttccagtgagaaaaaaggataagcgtaattcttctgacagtgctatagataatcctaagcctaataaattgccaaaatctaagcaatcagagactgtggatcaaaattcagattctgatgaaatgctagcaatcctcaaagaggtgagcaggatgagtcacagttcttcttcagatactgatattaatgaaattcatacaaaccataagactttgtatgatttaaagactcaggcggggaaagatgataaaggaaaaaggaaacgaaaaagttctacatctggctcagattttgatactaaaaagggcaaatcagctaagagctctataatttctaaaaagaaacgacaaacccagtctgagtcttctaattatgactcagaattagaaaaagagataaagagcatgagtaaaattggtgctgccagaaccaccaaaaaaagaattccaaatacaaaagattttgactcttctgaagatgagaaacacagcaaaaaaggaatggataatcaagggcacaaaaatttgaagacctcacaagaaggatcatctgatgatgctgaaagaaaacaagagagagagactttctcttcagcagaaggcacagttgataaagacacgaccatcatggaattaagagatcgacttcctaagaagcagcaagcaagtgcttccactgatggtgtcgataagctttctgggaaagaggagagttttacttctttggaagttagaaaagttgctgaaactaaagaaaagagcaagcatctcaaaaccaaaacatgtaaaaaagtacaggatggcttatctgatattgcagagaaattcctaaagaaagaccagagcgatgaaacttctgaagatgataaaaagcagagcaaaaagggaactgaagaaaaaaagaaaccttcagactttaagaaaaaagtaattaaaatggaacaacagtatgaatcttcatctgatggcactgaaaagttacctgagcgagaagaaatttgtcattttcctaagggcataaaacaaattaagaatggaacaactgatggagaaaagaaaagtaaaaaaataagagataaaacttctaaaaagaaggatgaattatctgattatgctgagaagtcaacagggaaaggagatagttgtgactcttcagaggataaaaagagtaagaatggagcatatggtagagagaagaaaaggtgcaagttgcttggaaagagttcaaggaagagacaagattgttcatcatctgatactgagaaatattccatgaaagaagatggttgtaactcttctgataagagactgaaaagaatagaattgagggaaagaagaaatttaagttcaaagagaaatactaaggaaatacaaagtggctcatcatcatctgatgctgaggaaagttctgaagataataaaaagaagaagcaaagaacttcatctaaaaagaaggcagtcattgtcaaggagaaaaagagaaactccctaagaacaagcactaaaaggaagcaagctgacattacatcctcatcttcttctgatatagaagatgatgatcagaattctataggtgagggaagcagcgatgaacagaaaattaagcctgtgactgaaaatttagtgctgtcttcacatactggattttgccaatcttcaggagatgaagccttatctaaatcagtgcctgtcacagtggatgatgatgatgacgacaatgatcctgagaatagaattgccaagaagatgcttttagaagaaattaaagccaatctttcctctgatgaggatggatcttcagatgatgagccagaagaagggaaaaaaagaactggaaaacaaaatgaagaaaacccaggagatgaggaagcaaaaaatcaagtcaattctgaatcagattcagattctgaagaatctaagaagccaagatacagacataggcttttgcggcacaaattgactgtgagtgacggagaatctggagaagaaaaaaagacaaagcctaaagagcataaagaagtcaaaggcagaaacagaagaaaggtgagcagtgaagattcagaagattctgattttcaggaatcaggagttagtgaagaagttagtgaatccgaagatgaacagcggcccagaacaaggtctgcaaagaaagcagagttggaagaaaatcagcggagctataaacagaaaaagaaaaggcgacgtattaaggttcaagaagattcatccagtgaaaacaagagtaattctgaggaagaagaggaggaaaaagaagaggaggaggaagaggaggaggaggaggaagaggaggaggaagatgaaaatgatgattccaagtctcctggaaaaggcagaaagaaaattcggaagattcttaaagatgataaactgagaacagaaacacaaaatgctcttaaggaagaggaagagagacgaaaacgtattgctgagagggagcgtgagcgagaaaaattgagagaggtgatagaaattgaagatgcttcacccaccaagtgtccaataacaaccaagttggttttagatgaagatgaagaaaccaaagaacctttagtgcaggttcatagaaatatggttatcaaattgaaaccccatcaagtagatggtgttcagtttatgtgggattgctgctgtgagtctgtgaaaaaaacaaagaaatctccaggttcaggatgcattcttgcccactgtatgggccttggtaagactttacaggtggtaagttttcttcatacagttcttttgtgtgacaaactggatttcagcacggcgttagtggtttgtcctcttaatactgctttgaattggatgaatgaatttgagaagtggcaagagggattaaaagatgatgagaagcttgaggtttctgaattagcaactgtgaaacgtcctcaggagagaagctacatgctgcagaggtggcaagaagatggtggtgttatgatcataggctatgagatgtatagaaatcttgctcaaggaaggaatgtgaagagtcggaaacttaaagaaatatttaacaaagctttggttgatccaggccctgattttgttgtttgtgatgaaggccatattctaaaaaatgaagcatctgctgtttctaaagctatgaattctatacgatcaaggaggaggattattttaacaggaacaccacttcaaaataacctaattgagtatcattgtatggttaattttatcaaggaaaatttacttggatccattaaggagttcaggaatagatttataaatccaattcaaaatggtcagtgtgcagattctaccatggtagatgtcagagtgatgaaaaaacgtgctcacattctctatgagatgttagctggatgtgttcagaggaaagattatacagcattaacaaaattcttgcctccaaaacacgaatatgtgttagctgtgagaatgacttctattcagtgcaagctctatcagtactacttagatcacttaacaggtgtgggcaataatagtgaaggtggaagaggaaaggcaggtgcaaagcttttccaagattttcagatgttaagtagaatatggactcatccttggtgtttgcagctagactacattagcaaagaaaataagggttattttgatgaagacagtatggatgaatttatagcctcagattctgatgaaacctccatgagtttaagctccgatgattatacaaaaaagaagaaaaaagggaaaaaggggaaaaaagatagtagctcaagtggaagtggcagtgacaatgatgttgaagtgattaaggtctggaattcaagatctcggggaggtggtgaaggaaatgtggatgaaacaggaaacaatccttctgtttctttaaaactggaagaaagtaaagctacttcttcttctaatccaagcagcccagctccagactggtacaaagattttgttacagatgctgatgctgaggttttagagcattctgggaaaatggtacttctctttgaaattcttcgaatggcagaggaaattggggataaagtccttgttttcagccagtccctcatatctctggacttgattgaagattttcttgaattagctagtagggagaagacagaagataaagataaaccccttatttataaaggtgaggggaagtggcttcgaaacattgactattaccgtttagatggttccactactgcacagtcaaggaagaagtgggctgaagaatttaatgatgaaactaatgtgagaggacgattatttatcatttctactaaagcaggatctctaggaattaatctggtagctgctaatcgagtaattatattcgacgcttcttggaatccatcttatgacatccagagtatattcagagtttatcgctttggacaaactaagcctgtttatgtatataggttcttagctcagggaaccatggaagataagatttatgatcggcaagtaactaagcagtcactgtcttttcgagttgttgatcagcagcaggtggagcgtcattttactatgaatgagcttactgaactttatacttttgagccagacttattagatgaccctaattcagaaaagaagaagaagagggatactcccatgctgccaaaggataccatacttgcagagctccttcagatacataaagaacacattgtaggataccatgaacatgattctcttttggaccacaaagaagaagaagagttgactgaagaagaaagaaaagcagcttgggctgagtatgaagcagagaagaagggactgaccatgcgtttcaacataccaactgggaccaatttaccccctgtcagtttcaactctcaaactccttatattcctttcaatttgggagccctgtcagcaatgagtaatcaacagctggaggacctcattaatcaaggaagagaaaaagttgtagaagcaacaaacagtgtgacagcagtgaggattcaacctcttgaggatataatttcagctgtatggaaggagaacatgaatctctcagaggcccaagtacaggcgttagcattaagtagacaagccagccaggagcttgatgttaaacgaagagaagcaatctacaatgatgtattgacaaaacaacagatgttaatcagctgtgttcagcgaatacttatgaacagaaggctccagcagcagtacaatcagcagcaacagcaacaaatgacttatcaacaagcaacactgggtcacctcatgatgccaaagcccccaaatttgatcatgaatccttctaactaccagcagattgatatgagaggaatgtatcagccagtggctggtggtatgcagccaccaccattacagcgtgcaccacccccaatgagaagcaaaaatccaggaccttcccaagggaaatcaatgtgattttgcactaaaagcttaatggattgttaaaatcatagaaagatcttttatttttttaggaatcaatgacttaacagaactcaactgtataaatagtttggtccccttaaatgccaatcttccatattagttttactttttttttttttaaatagggcataccatttcttcctgacatttgtcagtgatgttgcctagaatcttcttacacacgctgagtacagaagatatttcaaattgttttcagtgaaaacaagtccttccataatagtaacaactccacagatttcctctctaaatttttatgcctgcttttagcaaccataaaattgtcataaaattaataaatttaggaaagaataaagatttatatattcattctttacatataaaaacacacagctgagttcttagagttgattcctcaagttatgaaatacttttgtacttaatccatttcttgattaaagtgattgaaatggttttaatgttcttttgactgaagtctgaaactgggctcctgctttattgtctctgtgactgaaagttagaaactgagggttatctttgacacagaattgtgtgcaatattcttaaatactactgctctaaaagttggagaagtcttgcagttatcttagcattgtataaacagccttaagtatagcctaagaagagaattcctttttcttctttagtccttctgccattttttattttcagttatatgtgctgaaataattactggtaaaatttcagggttgtggattatcttccacacatgaattttctctctcctggcacgaatataaagcacatctcttaactgcatggtgccagtgctaatgcttcatcctgttgctggcagtgggatgtggacttagaaaatcaagttctagcattttagtaggttaacactgaagttgtggttgttaggttcacaccctgttttataaacaacatcaaaatggcagaaccattgctgactttaggttcacatgaggaatgtacttttaacaattcccagtactatcagtattgtgaaataattcctctgaaagataagaatcactggcttctatgcgcttcttttctctcatcatcatgttcttttaccccagtttccttacatttttttaaattgtttcagagtttgttttttttttagtttagattgtgaggcaattattaaatcaaaattaattcatccaatacccctttactagaagttttactagaaaatgtattacattttattttttcttaatccagttctgcaaaaatgacctataaatttattcatgtacaattttggttacttgaattgttaaagaaaacattgtttttgactatgggagtcaactcaacatggcagaaccatttttgagatgatgatacaacaggtagtgaaacagcttaagaattccaaaaaaaaaaaaaaaaaaaaaaaaaagaaaactgggtttgggctttgctttaggtatcactggattagaatgagtttaacattagctaaaactgctttgagttgtttggatgattaagagattgccatttttatcttggaagaactagtggtaaaacatccaagagcactaggattgtgatacagaatttgtgaggtttggtggatccacgcccctctcccccactttcccatgatgaaatatcactaataaatcctgtatatttagatattatgctagccatgtaatcagatttatttaattgggtggggcaggtgtgtatttactttagaaaaaatgaaaaagacaagatttatgagaaatatttgaaggcagtacactctggccaactgttaccagttggtatttctacaagttcagaatattttaaacctgatttactagacctgggaattttcaacatggtctaattatttactcaaagacatagatgtgaaaattttaggcaaccttctaaatctttttcaccatggatgaaactataacttaaagaataatacttagaagggttaattggaaatcagagtttgaaataaaacttggaccactttgtatacactcttctcacttgacattttagctatataatatgtactttgagtataacatcaagctttaacaaatatttaaagacaaaaaaatcacgtcagtaaaatactaaaaggctcatttttatatttgttttagatgttttaaatagttgcaatggattaaaaatgatgatttaaaatgttgcttgtaatacagttttgcctgctaaattctccacattttgtaacctgttttatttctttgggtgtaaagcgtttttgcttagtattgtgatattgtatatgttttgtcccagttgtatagtaatgtttcagtccatcatccagctttggctgctgaaatcatacagctgtgaagacttgcctttgtttctgttagactgcttttcagttctgtattgagtatcttaagtactgtagaaaagatgtcacttcttcctttaaggctgttttgtaatatatataaggactggaattgtgtttttaaagaaaagcattcaagtatgacaatatactatctgtgttttcaccattcaaagtgctgtttagtagttgaaacttaaactatttaatgtcatttaataaagtgaccaaaatgtgttgtgctctttattgtattttcacagctttgaaaatctgtgcacatactgtttcatagaaaatgtatagcttttgttgtcctatataatggtggttcttttgcacatttagttatttaatattgagaggtcacgaagtttggttattgaatctgttatatactaaattctgtaaagggagatctctcatctcaaaaagaatttacataccaggaagtccatgtgtgtttgtgttagttttggatgtctttgtgtaatccagccccatttcctgtttcccaacagctgtaacactcattttaagtcaagcagggctaccaacccacacttgatagaaaagctgcttaccattcagaagcttccttattacctggcctccaaatgagctgaatattttgtagccttcccttagctatgttcattttccctccattatcataaaatcagatcgatatttatgtgccccaaacaaaactttaagagcagttacattctgtcccagtagcccttgtttcctttgagagtagcatgttgtgaggctatagagacttattctaccagtaaaacaggtcaatccttttacatgtttattatactaaaaattatgttcagggtatttactactttatttcaccagactcagtctcaagtgacttggctatctccaaatcagatctacccttagagaataaacatttttctaccgttattttttttcaagtctataatctgagccagtcccaaaggagtgatcaagtttcagaaatgctttcatcttcacaacattttatatatactattatatggggtgaataaagttttaaatccgaaatata

SEQ ID NO: 106681 - DNA, 10218 bp, Homo sapiens
  Payload ID: 951
  Gene Symbol: ATRX
  Gene Name: alpha thalassemia/mental retardation syndrome X-linked
  Uniprot ID: P46100
  ENST ID: ENST00000395603
  CDS Start-End: 216-7580
ctcggcccaacaaaatggcggcggcagcggtgtcgctttgtttccgcggctcctgcggcggtggcagtggtagcggcctttgagctgtggggaggttccagcagcagctacagtgacgactaagactccagtgcatttctatcgtaaccgggcgcgggggagcgcagatcggcgcccagcaatcacagaagccgacaaggcgttcaagcgaaaacatgaccgctgagcccatgagtgaaagcaagttgaatacattggtgcagaagcttcatgacttccttgcacactcatcagaagaatctgaagaaacaagttctcctccacgacttgcaatgaatcaaaacacagataaaatcagtggttctggaagtaactctgatatgatggaaaacagcaaggaagagggaactagctcttcagaaaaatccaagtcttcaggatcgtcacgatcaaagaggaaaccttcaattgtaacaaagtatgtagaatcagatgatgaaaaacctttggatgatgaaactgtaaatgaagatgcgtctaatgaaaattcagaaaatgatattactatgcagagcttgccaaaagaagatgggcttcatgggattgtgagctgcactgcttgtggacaacaggtcaatcattttcaaaaagattccatttatagacacccttcattgcaagttcttatttgtaagaattgctttaagtattacatgagtgatgatattagccgtgactcagatggaatggatgaacaatgtaggtggtgtgcggaaggtggaaacttgatttgttgtgacttttgccataatgctttctgcaagaaatgcattctacgcaaccttggtcgaaaggagttgtccacaataatggatgaaaacaaccaatggtattgctacatttgtcacccagagcctttgttggacttggtcactgcatgtaacagcgtatttgagaatttagaacagttgttgcagcaaaataagaagaagataaaagttgacagtgaaaagagtaataaagtatatgaacatacatccagattttctccaaagaagactagttcaaattgtaatggagaagaaaagaaattagatgattcctgttctggctctgtaacctactcttattccgcactaattgtgcccaaagagatgattaagaaggcaaaaaaactgattgagaccacagccaacatgaactccagttatgttaaatttttaaagcaggcaacagataattcagaaatcagttctgctacaaaattacgtcagcttaaggcttttaagtctgtgttggctgatattaagaaggctcatcttgcattggaagaagacttaaattccgagtttcgagcgatggatgctgtaaacaaagagaaaaataccaaagagcataaagtcatagatgctaagtttgaaacaaaagcacgaaaaggagaaaaaccttgtgctttggaaaagaaggatatttcaaagtcagaagctaaactttcaagaaaacaggtagatagtgagcacatgcatcagaatgttccaacagaggaacaaagaacaaataaaagtaccggtggtgaacataagaaatctgatagaaaagaagaacctcaatatgaacctgccaacacttctgaagatttagacatggatattgtgtctgttccttcctcagttccagaagacatttttgagaatcttgagactgctatggaagttcagagttcagttgatcatcaaggggatggcagcagtggaactgaacaagaagtggagagttcatctgtaaaattaaatatttcttcaaaagacaacagaggaggtattaaatcaaaaactacagctaaagtaacaaaagaattatatgttaaactcactcctgtttccctttctaattccccaattaaaggtgctgattgtcaggaagttccacaagataaagatggctataaaagttgtggtctgaaccccaagttagagaaatgtggacttggacaggaaaacagtgataatgagcatttggttgaaaatgaagtttcattacttttagaggaatctgatcttcgaagatccccacgtgtaaagactacacccttgaggcgaccgacagaaactaaccctgtaacatctaattcagatgaagaatgtaatgaaacagttaaggagaaacaaaaactatcagttccagtgagaaaaaaggataagcgtaattcttctgacagtgctatagataatcctaagcctaataaattgccaaaatctaagcaatcagagactgtggatcaaaattcagattctgatgaaatgctagcaatcctcaaagaggtgagcaggatgagtcacagttcttcttcagatactgatattaatgaaattcatacaaaccataagactttgtatgatttaaagactcaggcggggaaagatgataaaggaaaaaggaaacgaaaaagttctacatctggctcagattttgatactaaaaagggcaaatcagctaagagctctataatttctaaaaagaaacgacaaacccagtctgagtcttctaattatgactcagaattagaaaaagagataaagagcatgagtaaaattggtgctgccagaaccaccaaaaaaagaattccaaatacaaaagattttgactcttctgaagatgagaaacacagcaaaaaaggaatggataatcaagggcacaaaaatttgaagacctcacaagaaggatcatctgatgatgctgaaagaaaacaagagagagagactttctcttcagcagaaggcacagttgataaagacacgaccatcatggaattaagagatcgacttcctaagaagcagcaagcaagtgcttccactgatggtgtcgataagctttctgggaaagaggagagttttacttctttggaagttagaaaagttgctgaaactaaagaaaagagcaagcatctcaaaaccaaaacatgtaaaaaagtacaggatggcttatctgatattgcagagaaattcctaaagaaagaccagagcgatgaaacttctgaagatgataaaaagcagagcaaaaagggaactgaagaaaaaaagaaaccttcagactttaagaaaaaagtaattaaaatggaacaacagtatgaatcttcatctgatggcactgaaaagttacctgagcgagaagaaatttgtcattttcctaagggcataaaacaaattaagaatggaacaactgatggagaaaagaaaagtaaaaaaataagagataaaacttctaaaaagaaggatgaattatctgattatgctgagaagtcaacagggaaaggagatagttgtgactcttcagaggataaaaagagtaagaatggagcatatggtagagagaagaaaaggtgcaagttgcttggaaagagttcaaggaagagacaagattgttcatcatctgatactgagaaatattccatgaaagaagatggttgtaactcttctgataagagactgaaaagaatagaattgagggaaagaagaaatttaagttcaaagagaaatactaaggaaatacaaagtggctcatcatcatctgatgctgaggaaagttctgaagataataaaaagaagaagcaaagaacttcatctaaaaagaaggcagtcattgtcaaggagaaaaagagaaactccctaagaacaagcactaaaaggaagcaagctgacattacatcctcatcttcttctgatatagaagatgatgatcagaattctataggtgagggaagcagcgatgaacagaaaattaagcctgtgactgaaaatttagtgctgtcttcacatactggattttgccaatcttcaggagatgaagccttatctaaatcagtgcctgtcacagtggatgatgatgatgacgacaatgatcctgagaatagaattgccaagaagatgcttttagaagaaattaaagccaatctttcctctgatgaggatggatcttcagatgatgagccagaagaagggaaaaaaagaactggaaaacaaaatgaagaaaacccaggagatgaggaagcaaaaaatcaagtcaattctgaatcagattcagattctgaagaatctaagaagccaagatacagacataggcttttgcggcacaaattgactgtgagtgacggagaatctggagaagaaaaaaagacaaagcctaaagagcataaagaagtcaaaggcagaaacagaagaaaggtgagcagtgaagattcagaagattctgattttcaggaatcaggagttagtgaagaagttagtgaatccgaagatgaacagcggcccagaacaaggtctgcaaagaaagcagagttggaagaaaatcagcggagctataaacagaaaaagaaaaggcgacgtattaaggttcaagaagattcatccagtgaaaacaagagtaattctgaggaagaagaggaggaaaaagaagaggaggaggaagaggaggaggaggaggaagaggaggaggaagatgaaaatgatgattccaagtctcctggaaaaggcagaaagaaaattcggaagattcttaaagatgataaactgagaacagaaacacaaaatgctcttaaggaagaggaagagagacgaaaacgtattgctgagagggagcgtgagcgagaaaaattgagagaggtgatagaaattgaagatgcttcacccaccaagtgtccaataacaaccaagttggttttagatgaagatgaagaaaccaaagaacctttagtgcaggttcatagaaatatggttatcaaattgaaaccccatcaagtagatggtgttcagtttatgtgggattgctgctgtgagtctgtgaaaaaaacaaagaaatctccaggttcaggatgcattcttgcccactgtatgggccttggtaagactttacaggtggtaagttttcttcatacagttcttttgtgtgacaaactggatttcagcacggcgttagtggtttgtcctcttaatactgctttgaattggatgaatgaatttgagaagtggcaagagggattaaaagatgatgagaagcttgaggtttctgaattagcaactgtgaaacgtcctcaggagagaagctacatgctgcagaggtggcaagaagatggtggtgttatgatcataggctatgagatgtatagaaatcttgctcaaggaaggaatgtgaagagtcggaaacttaaagaaatatttaacaaagctttggttgatccaggccctgattttgttgtttgtgatgaaggccatattctaaaaaatgaagcatctgctgtttctaaagctatgaattctatacgatcaaggaggaggattattttaacaggaacaccacttcaaaataacctaattgagtatcattgtatggttaattttatcaaggaaaatttacttggatccattaaggagttcaggaatagatttataaatccaattcaaaatggtcagtgtgcagattctaccatggtagatgtcagagtgatgaaaaaacgtgctcacattctctatgagatgttagctggatgtgttcagaggaaagattatacagcattaacaaaattcttgcctccaaaacacgaatatgtgttagctgtgagaatgacttctattcagtgcaagctctatcagtactacttagatcacttaacaggtgtgggcaataatagtgaaggtggaagaggaaaggcaggtgcaaagcttttccaagattttcagatgttaagtagaatatggactcatccttggtgtttgcagctagactacattagcaaagaaaataagggttattttgatgaagacagtatggatgaatttatagcctcagattctgatgaaacctccatgagtttaagctccgatgattatacaaaaaagaagaaaaaagggaaaaaggggaaaaaagatagtagctcaagtggaagtggcagtgacaatgatgttgaagtgattaaggtctggaattcaagatctcggggaggtggtgaaggaaatgtggatgaaacaggaaacaatccttctgtttctttaaaactggaagaaagtaaagctacttcttcttctaatccaagcagcccagctccagactggtacaaagattttgttacagatgctgatgctgaggttttagagcattctgggaaaatggtacttctctttgaaattcttcgaatggcagaggaaattggggataaagtccttgttttcagccagtccctcatatctctggacttgattgaagattttcttgaattagctagtagggagaagacagaagataaagataaaccccttatttataaaggtgaggggaagtggcttcgaaacattgactattaccgtttagatggttccactactgcacagtcaaggaagaagtgggctgaagaatttaatgatgaaactaatgtgagaggacgattatttatcatttctactaaagcaggatctctaggaattaatctggtagctgctaatcgagtaattatattcgacgcttcttggaatccatcttatgacatccagagtatattcagagtttatcgctttggacaaactaagcctgtttatgtatataggttcttagctcagggaaccatggaagataagatttatgatcggcaagtaactaagcagtcactgtcttttcgagttgttgatcagcagcaggtggagcgtcattttactatgaatgagcttactgaactttatacttttgagccagacttattagatgaccctaattcagaaaagaagaagaagagggatactcccatgctgccaaaggataccatacttgcagagctccttcagatacataaagaacacattgtaggataccatgaacatgattctcttttggaccacaaagaagaagaagagttgactgaagaagaaagaaaagcagcttgggctgagtatgaagcagagaagaagggactgaccatgcgtttcaacataccaactgggaccaatttaccccctgtcagtttcaactctcaaactccttatattcctttcaatttgggagccctgtcagcaatgagtaatcaacagctggaggacctcattaatcaaggaagagaaaaagttgtagaagcaacaaacagtgtgacagcagtgaggattcaacctcttgaggatataatttcagctgtatggaaggagaacatgaatctctcagaggcccaagtacaggcgttagcattaagtagacaagccagccaggagcttgatgttaaacgaagagaagcaatctacaatgatgtattgacaaaacaacagatgttaatcagctgtgttcagcgaatacttatgaacagaaggctccagcagcagtacaatcagcagcaacagcaacaaatgacttatcaacaagcaacactgggtcacctcatgatgccaaagcccccaaatttgatcatgaatccttctaactaccagcagattgatatgagaggaatgtatcagccagtggctggtggtatgcagccaccaccattacagcgtgcaccacccccaatgagaagcaaaaatccaggaccttcccaagggaaatcaatgtgattttgcactaaaagcttaatggattgttaaaatcatagaaagatcttttatttttttaggaatcaatgacttaacagaactcaactgtataaatagtttggtccccttaaatgccaatcttccatattagttttactttttttttttttaaatagggcataccatttcttcctgacatttgtcagtgatgttgcctagaatcttcttacacacgctgagtacagaagatatttcaaattgttttcagtgaaaacaagtccttccataatagtaacaactccacagatttcctctctaaatttttatgcctgcttttagcaaccataaaattgtcataaaattaataaatttaggaaagaataaagatttatatattcattctttacatataaaaacacacagctgagttcttagagttgattcctcaagttatgaaatacttttgtacttaatccatttcttgattaaagtgattgaaatggttttaatgttcttttgactgaagtctgaaactgggctcctgctttattgtctctgtgactgaaagttagaaactgagggttatctttgacacagaattgtgtgcaatattcttaaatactactgctctaaaagttggagaagtcttgcagttatcttagcattgtataaacagccttaagtatagcctaagaagagaattcctttttcttctttagtccttctgccattttttattttcagttatatgtgctgaaataattactggtaaaatttcagggttgtggattatcttccacacatgaattttctctctcctggcacgaatataaagcacatctcttaactgcatggtgccagtgctaatgcttcatcctgttgctggcagtgggatgtggacttagaaaatcaagttctagcattttagtaggttaacactgaagttgtggttgttaggttcacaccctgttttataaacaacatcaaaatggcagaaccattgctgactttaggttcacatgaggaatgtacttttaacaattcccagtactatcagtattgtgaaataattcctctgaaagataagaatcactggcttctatgcgcttcttttctctcatcatcatgttcttttaccccagtttccttacatttttttaaattgtttcagagtttgttttttttttagtttagattgtgaggcaattattaaatcaaaattaattcatccaatacccctttactagaagttttactagaaaatgtattacattttattttttcttaatccagttctgcaaaaatgacctataaatttattcatgtacaattttggttacttgaattgttaaagaaaacattgtttttgactatgggagtcaactcaacatggcagaaccatttttgagatgatgatacaacaggtagtgaaacagcttaagaattccaaaaaaaaaaaaaaaaaaaaaaaaaagaaaactgggtttgggctttgctttaggtatcactggattagaatgagtttaacattagctaaaactgctttgagttgtttggatgattaagagattgccatttttatcttggaagaactagtggtaaaacatccaagagcactaggattgtgatacagaatttgtgaggtttggtggatccacgcccctctcccccactttcccatgatgaaatatcactaataaatcctgtatatttagatattatgctagccatgtaatcagatttatttaattgggtggggcaggtgtgtatttactttagaaaaaatgaaaaagacaagatttatgagaaatatttgaaggcagtacactctggccaactgttaccagttggtatttctacaagttcagaatattttaaacctgatttactagacctgggaattttcaacatggtctaattatttactcaaagacatagatgtgaaaattttaggcaaccttctaaatctttttcaccatggatgaaactataacttaaagaataatacttagaagggttaattggaaatcagagtttgaaataaaacttggaccactttgtatacactcttctcacttgacattttagctatataatatgtactttgagtataacatcaagctttaacaaatatttaaagacaaaaaaatcacgtcagtaaaatactaaaaggctcatttttatatttgttttagatgttttaaatagttgcaatggattaaaaatgatgatttaaaatgttgcttgtaatacagttttgcctgctaaattctccacattttgtaacctgttttatttctttgggtgtaaagcgtttttgcttagtattgtgatattgtatatgttttgtcccagttgtatagtaatgtttcagtccatcatccagctttggctgctgaaatcatacagctgtgaagacttgcctttgtttctgttagactgcttttcagttctgtattgagtatcttaagtactgtagaaaagatgtcacttcttcctttaaggctgttttgtaatatatataaggactggaattgtgtttttaaagaaaagcattcaagtatgacaatatactatctgtgttttcaccattcaaagtgctgtttagtagttgaaacttaaactatttaatgtcatttaataaagtgaccaaaatgtg

SEQ ID NO: 106682 - DNA, 814 bp, Homo sapiens
  Payload ID: 951
  Gene Symbol: ATRX
  Gene Name: alpha thalassemia/mental retardation syndrome X-linked
  ENST ID: ENST00000400866
  CDS Start-End: 1-597
gaagatggtggtgttatgatcataggctatgagatgtatagaaatcttgctcaaggaaggaatgtgaagagtcggaaacttaaagaaatatttaacaaagctttggttgatccaggccctgattttgttgtttgtgatgaaggccatattctaaaaaatgaagcatctgctgtttctaaagctatgaattctatacgatcaaggaggaggattattttaacaggaacaccacttcaaaataacctaattgagtatcattgtatggttaattttatcaaggaaaatttacttggatccattaaggagttcaggaatagatttataaatccaattcaaaatggtcagtgtgcagattctaccatggtagatgtcagagtgatgaaaaaacgtgctcacattctctatgagatgttagctggatgtgttcagaggaaagattatacagcattaacaaaattcttgcctccaaaacacgaatatgtgttagctgtgagaatgacttctattcagtgcaagctctatcagtactacttagatcacttaacagttttgcatttgaataaaatgggtatgcttaaaagcataaaatatttctaattaaaacactgatgctgtcaaaattaaaatcaagaagcaaattgatgaaaaagatatacagcacatatgaataatgcccttaatttgtaaagagcttttatttcagaaaaattatgaatgtgaataaatccataaaagaagatatacaaaattccagagtatttttttaaaaagtatttacccacattaataataaaaggtgtataagttaaattca

SEQ ID NO: 106683 - DNA, 10455 bp, Homo sapiens
  Payload ID: 951
  Gene Symbol: ATRX
  Gene Name: alpha thalassemia/mental retardation syndrome X-linked
  ENST ID: ENST00000480283
  CDS Start-End: 216-710
ctcggcccaacaaaatggcggcggcagcggtgtcgctttgtttccgcggctcctgcggcggtggcagtggtagcggcctttgagctgtggggaggttccagcagcagctacagtgacgactaagactccagtgcatttctatcgtaaccgggcgcgggggagcgcagatcggcgcccagcaatcacagaagccgacaaggcgttcaagcgaaaacatgaccgctgagcccatgagtgaaagcaagttgaatacattggtgcagaagcttcatgacttccttgcacactcatcagaagaatctgaagaaacaagttctcctccacgacttgcaatgaatcaaaacacagataaaatcagtggttctggaagtaactctgatatgatggaaaacagcaaggaagagggaactagctcttcagaaaaatccaagtcttcaggatcgtcacgatcaaagaggaaaccttcaattgtaacaaagtatgtagaatcagatgatgaaaaacctttggatgatgaaactgtaaatgaagatgcgtctaatgaaaattcagaaaatgatattactatgcagagcttgccaaaaggtacagtgattgtacagccagagccagtgctgaatgaagacaaagatgattttaaagggcctgaatttagaagcagaagtaaaatgaaaactgaaaatctcaaaaaacgcggagtgctgtggtgaatatccttatatttgattccttgtgcacatgtgggagaaaatctccaaagaattacctagttttgtttaattcttgagcgatgtatgcaccaaagcacatagaagatacttaaagatgggcttcatgggattgtgagctgcactgcttgtggacaacaggtcaatcattttcaaaaagattccatttatagacacccttcattgcaagttcttatttgtaagaattgctttaagtattacatgagtgatgatattagccgtgactcagatggaatggatgaacaatgtaggtggtgtgcggaaggtggaaacttgatttgttgtgacttttgccataatgctttctgcaagaaatgcattctacgcaaccttggtcgaaaggagttgtccacaataatggatgaaaacaaccaatggtattgctacatttgtcacccagagcctttgttggacttggtcactgcatgtaacagcgtatttgagaatttagaacagttgttgcagcaaaataagaagaagataaaagttgacagtgaaaagagtaataaagtatatgaacatacatccagattttctccaaagaagactagttcaaattgtaatggagaagaaaagaaattagatgattcctgttctggctctgtaacctactcttattccgcactaattgtgcccaaagagatgattaagaaggcaaaaaaactgattgagaccacagccaacatgaactccagttatgttaaatttttaaagcaggcaacagataattcagaaatcagttctgctacaaaattacgtcagcttaaggcttttaagtctgtgttggctgatattaagaaggctcatcttgcattggaagaagacttaaattccgagtttcgagcgatggatgctgtaaacaaagagaaaaataccaaagagcataaagtcatagatgctaagtttgaaacaaaagcacgaaaaggagaaaaaccttgtgctttggaaaagaaggatatttcaaagtcagaagctaaactttcaagaaaacaggtagatagtgagcacatgcatcagaatgttccaacagaggaacaaagaacaaataaaagtaccggtggtgaacataagaaatctgatagaaaagaagaacctcaatatgaacctgccaacacttctgaagatttagacatggatattgtgtctgttccttcctcagttccagaagacatttttgagaatcttgagactgctatggaagttcagagttcagttgatcatcaaggggatggcagcagtggaactgaacaagaagtggagagttcatctgtaaaattaaatatttcttcaaaagacaacagaggaggtattaaatcaaaaactacagctaaagtaacaaaagaattatatgttaaactcactcctgtttccctttctaattccccaattaaaggtgctgattgtcaggaagttccacaagataaagatggctataaaagttgtggtctgaaccccaagttagagaaatgtggacttggacaggaaaacagtgataatgagcatttggttgaaaatgaagtttcattacttttagaggaatctgatcttcgaagatccccacgtgtaaagactacacccttgaggcgaccgacagaaactaaccctgtaacatctaattcagatgaagaatgtaatgaaacagttaaggagaaacaaaaactatcagttccagtgagaaaaaaggataagcgtaattcttctgacagtgctatagataatcctaagcctaataaattgccaaaatctaagcaatcagagactgtggatcaaaattcagattctgatgaaatgctagcaatcctcaaagaggtgagcaggatgagtcacagttcttcttcagatactgatattaatgaaattcatacaaaccataagactttgtatgatttaaagactcaggcggggaaagatgataaaggaaaaaggaaacgaaaaagttctacatctggctcagattttgatactaaaaagggcaaatcagctaagagctctataatttctaaaaagaaacgacaaacccagtctgagtcttctaattatgactcagaattagaaaaagagataaagagcatgagtaaaattggtgctgccagaaccaccaaaaaaagaattccaaatacaaaagattttgactcttctgaagatgagaaacacagcaaaaaaggaatggataatcaagggcacaaaaatttgaagacctcacaagaaggatcatctgatgatgctgaaagaaaacaagagagagagactttctcttcagcagaaggcacagttgataaagacacgaccatcatggaattaagagatcgacttcctaagaagcagcaagcaagtgcttccactgatggtgtcgataagctttctgggaaagaggagagttttacttctttggaagttagaaaagttgctgaaactaaagaaaagagcaagcatctcaaaaccaaaacatgtaaaaaagtacaggatggcttatctgatattgcagagaaattcctaaagaaagaccagagcgatgaaacttctgaagatgataaaaagcagagcaaaaagggaactgaagaaaaaaagaaaccttcagactttaagaaaaaagtaattaaaatggaacaacagtatgaatcttcatctgatggcactgaaaagttacctgagcgagaagaaatttgtcattttcctaagggcataaaacaaattaagaatggaacaactgatggagaaaagaaaagtaaaaaaataagagataaaacttctaaaaagaaggatgaattatctgattatgctgagaagtcaacagggaaaggagatagttgtgactcttcagaggataaaaagagtaagaatggagcatatggtagagagaagaaaaggtgcaagttgcttggaaagagttcaaggaagagacaagattgttcatcatctgatactgagaaatattccatgaaagaagatggttgtaactcttctgataagagactgaaaagaatagaattgagggaaagaagaaatttaagttcaaagagaaatactaaggaaatacaaagtggctcatcatcatctgatgctgaggaaagttctgaagataataaaaagaagaagcaaagaacttcatctaaaaagaaggcagtcattgtcaaggagaaaaagagaaactccctaagaacaagcactaaaaggaagcaagctgacattacatcctcatcttcttctgatatagaagatgatgatcagaattctataggtgagggaagcagcgatgaacagaaaattaagcctgtgactgaaaatttagtgctgtcttcacatactggattttgccaatcttcaggagatgaagccttatctaaatcagtgcctgtcacagtggatgatgatgatgacgacaatgatcctgagaatagaattgccaagaagatgcttttagaagaaattaaagccaatctttcctctgatgaggatggatcttcagatgatgagccagaagaagggaaaaaaagaactggaaaacaaaatgaagaaaacccaggagatgaggaagcaaaaaatcaagtcaattctgaatcagattcagattctgaagaatctaagaagccaagatacagacataggcttttgcggcacaaattgactgtgagtgacggagaatctggagaagaaaaaaagacaaagcctaaagagcataaagaagtcaaaggcagaaacagaagaaaggtgagcagtgaagattcagaagattctgattttcaggaatcaggagttagtgaagaagttagtgaatccgaagatgaacagcggcccagaacaaggtctgcaaagaaagcagagttggaagaaaatcagcggagctataaacagaaaaagaaaaggcgacgtattaaggttcaagaagattcatccagtgaaaacaagagtaattctgaggaagaagaggaggaaaaagaagaggaggaggaagaggaggaggaggaggaagaggaggaggaagatgaaaatgatgattccaagtctcctggaaaaggcagaaagaaaattcggaagattcttaaagatgataaactgagaacagaaacacaaaatgctcttaaggaagaggaagagagacgaaaacgtattgctgagagggagcgtgagcgagaaaaattgagagaggtgatagaaattgaagatgcttcacccaccaagtgtccaataacaaccaagttggttttagatgaagatgaagaaaccaaagaacctttagtgcaggttcatagaaatatggttatcaaattgaaaccccatcaagtagatggtgttcagtttatgtgggattgctgctgtgagtctgtgaaaaaaacaaagaaatctccaggttcaggatgcattcttgcccactgtatgggccttggtaagactttacaggtggtaagttttcttcatacagttcttttgtgtgacaaactggatttcagcacggcgttagtggtttgtcctcttaatactgctttgaattggatgaatgaatttgagaagtggcaagagggattaaaagatgatgagaagcttgaggtttctgaattagcaactgtgaaacgtcctcaggagagaagctacatgctgcagaggtggcaagaagatggtggtgttatgatcataggctatgagatgtatagaaatcttgctcaaggaaggaatgtgaagagtcggaaacttaaagaaatatttaacaaagctttggttgatccaggccctgattttgttgtttgtgatgaaggccatattctaaaaaatgaagcatctgctgtttctaaagctatgaattctatacgatcaaggaggaggattattttaacaggaacaccacttcaaaataacctaattgagtatcattgtatggttaattttatcaaggaaaatttacttggatccattaaggagttcaggaatagatttataaatccaattcaaaatggtcagtgtgcagattctaccatggtagatgtcagagtgatgaaaaaacgtgctcacattctctatgagatgttagctggatgtgttcagaggaaagattatacagcattaacaaaattcttgcctccaaaacacgaatatgtgttagctgtgagaatgacttctattcagtgcaagctctatcagtactacttagatcacttaacaggtgtgggcaataatagtgaaggtggaagaggaaaggcaggtgcaaagcttttccaagattttcagatgttaagtagaatatggactcatccttggtgtttgcagctagactacattagcaaagaaaataagggttattttgatgaagacagtatggatgaatttatagcctcagattctgatgaaacctccatgagtttaagctccgatgattatacaaaaaagaagaaaaaagggaaaaaggggaaaaaagatagtagctcaagtggaagtggcagtgacaatgatgttgaagtgattaaggtctggaattcaagatctcggggaggtggtgaaggaaatgtggatgaaacaggaaacaatccttctgtttctttaaaactggaagaaagtaaagctacttcttcttctaatccaagcagcccagctccagactggtacaaagattttgttacagatgctgatgctgaggttttagagcattctgggaaaatggtacttctctttgaaattcttcgaatggcagaggaaattggggataaagtccttgttttcagccagtccctcatatctctggacttgattgaagattttcttgaattagctagtagggagaagacagaagataaagataaaccccttatttataaaggtgaggggaagtggcttcgaaacattgactattaccgtttagatggttccactactgcacagtcaaggaagaagtgggctgaagaatttaatgatgaaactaatgtgagaggacgattatttatcatttctactaaagcaggatctctaggaattaatctggtagctgctaatcgagtaattatattcgacgcttcttggaatccatcttatgacatccagagtatattcagagtttatcgctttggacaaactaagcctgtttatgtatataggttcttagctcagggaaccatggaagataagatttatgatcggcaagtaactaagcagtcactgtcttttcgagttgttgatcagcagcaggtggagcgtcattttactatgaatgagcttactgaactttatacttttgagccagacttattagatgaccctaattcagaaaagaagaagaagagggatactcccatgctgccaaaggataccatacttgcagagctccttcagatacataaagaacacattgtaggataccatgaacatgattctcttttggaccacaaagaagaagaagagttgactgaagaagaaagaaaagcagcttgggctgagtatgaagcagagaagaagggactgaccatgcgtttcaacataccaactgggaccaatttaccccctgtcagtttcaactctcaaactccttatattcctttcaatttgggagccctgtcagcaatgagtaatcaacagctggaggacctcattaatcaaggaagagaaaaagttgtagaagcaacaaacagtgtgacagcagtgaggattcaacctcttgaggatataatttcagctgtatggaaggagaacatgaatctctcagaggcccaagtacaggcgttagcattaagtagacaagccagccaggagcttgatgttaaacgaagagaagcaatctacaatgatgtattgacaaaacaacagatgttaatcagctgtgttcagcgaatacttatgaacagaaggctccagcagcagtacaatcagcagcaacagcaacaaatgacttatcaacaagcaacactgggtcacctcatgatgccaaagcccccaaatttgatcatgaatccttctaactaccagcagattgatatgagaggaatgtatcagccagtggctggtggtatgcagccaccaccattacagcgtgcaccacccccaatgagaagcaaaaatccaggaccttcccaagggaaatcaatgtgattttgcactaaaagcttaatggattgttaaaatcatagaaagatcttttatttttttaggaatcaatgacttaacagaactcaactgtataaatagtttggtccccttaaatgccaatcttccatattagttttactttttttttttttaaatagggcataccatttcttcctgacatttgtcagtgatgttgcctagaatcttcttacacacgctgagtacagaagatatttcaaattgttttcagtgaaaacaagtccttccataatagtaacaactccacagatttcctctctaaatttttatgcctgcttttagcaaccataaaattgtcataaaattaataaatttaggaaagaataaagatttatatattcattctttacatataaaaacacacagctgagttcttagagttgattcctcaagttatgaaatacttttgtacttaatccatttcttgattaaagtgattgaaatggttttaatgttcttttgactgaagtctgaaactgggctcctgctttattgtctctgtgactgaaagttagaaactgagggttatctttgacacagaattgtgtgcaatattcttaaatactactgctctaaaagttggagaagtcttgcagttatcttagcattgtataaacagccttaagtatagcctaagaagagaattcctttttcttctttagtccttctgccattttttattttcagttatatgtgctgaaataattactggtaaaatttcagggttgtggattatcttccacacatgaattttctctctcctggcacgaatataaagcacatctcttaactgcatggtgccagtgctaatgcttcatcctgttgctggcagtgggatgtggacttagaaaatcaagttctagcattttagtaggttaacactgaagttgtggttgttaggttcacaccctgttttataaacaacatcaaaatggcagaaccattgctgactttaggttcacatgaggaatgtacttttaacaattcccagtactatcagtattgtgaaataattcctctgaaagataagaatcactggcttctatgcgcttcttttctctcatcatcatgttcttttaccccagtttccttacatttttttaaattgtttcagagtttgttttttttttagtttagattgtgaggcaattattaaatcaaaattaattcatccaatacccctttactagaagttttactagaaaatgtattacattttattttttcttaatccagttctgcaaaaatgacctataaatttattcatgtacaattttggttacttgaattgttaaagaaaacattgtttttgactatgggagtcaactcaacatggcagaaccatttttgagatgatgatacaacaggtagtgaaacagcttaagaattccaaaaaaaaaaaaaaaaaaaaaaaaaagaaaactgggtttgggctttgctttaggtatcactggattagaatgagtttaacattagctaaaactgctttgagttgtttggatgattaagagattgccatttttatcttggaagaactagtggtaaaacatccaagagcactaggattgtgatacagaatttgtgaggtttggtggatccacgcccctctcccccactttcccatgatgaaatatcactaataaatcctgtatatttagatattatgctagccatgtaatcagatttatttaattgggtggggcaggtgtgtatttactttagaaaaaatgaaaaagacaagatttatgagaaatatttgaaggcagtacactctggccaactgttaccagttggtatttctacaagttcagaatattttaaacctgatttactagacctgggaattttcaacatggtctaattatttactcaaagacatagatgtgaaaattttaggcaaccttctaaatctttttcaccatggatgaaactataacttaaagaataatacttagaagggttaattggaaatcagagtttgaaataaaacttggaccactttgtatacactcttctcacttgacattttagctatataatatgtactttgagtataacatcaagctttaacaaatatttaaagacaaaaaaatcacgtcagtaaaatactaaaaggctcatttttatatttgttttagatgttttaaatagttgcaatggattaaaaatgatgatttaaaatgttgcttgtaatacagttttgcctgctaaattctccacattttgtaacctgttttatttctttgggtgtaaagcgtttttgcttagtattgtgatattgtatatgttttgtcccagttgtatagtaatgtttcagtccatcatccagctttggctgctgaaatcatacagctgtgaagacttgcctttgtttctgttagactgcttttcagttctgtattgagtatcttaagtactgtagaaaagatgtcacttcttcctttaaggctgttttgtaatatatataaggactggaattgtgtttttaaagaaaagcattcaagtatgacaatatactatctgtgttttcaccattcaaagtgctgtttagtagttgaaacttaaactatttaatgtcatttaataaagtgaccaaaatgtg

SEQ ID NO: 106684 - DNA, 593 bp, Homo sapiens
  Payload ID: 951
  Gene Symbol: ATRX
  Gene Name: alpha thalassemia/mental retardation syndrome X-linked
  ENST ID: ENST00000625063
  CDS Start-End: 1-593
ggaagagggaactagctcttcagaaaaatccaagtcttcaggatcgtcacgatcaaagaggaaaccttcaattgtaacaaagtatgtagaatcagatgatgaaaaacctttggatgatgaaactgtaaatgaagatgcgtctaatgaaaattcagaaaatgatattactatgcagagcttgccaaaaggtacagtgattgtacagccagagccagtgctgaatgaagacaaagatgattttaaagggcctgaatttagaagcagaagtaaaatgaaaactgaaaatctcaaaaaacgcggagatgggcttcatgggattgtgagctgcactgcttgtggacaacaggtcaatcattttcaaaaagattccatttatagacacccttcattgcaagttcttatttgtaagaattgctttaagtattacatgagtgatgatattagccgtgactcagatggaatggatgaacaatgtaggtggtgtgcggaaggtggaaacttgatttgttgtgacttttgccataatgctttctgcaagaaatgcattctacgcaaccttggtcgaaaggagttgtccacaataatggatgaaa

SEQ ID NO: 106685 - DNA, 583 bp, Homo sapiens
  Payload ID: 951
  Gene Symbol: ATRX
  Gene Name: alpha thalassemia/mental retardation syndrome X-linked
  ENST ID: ENST00000624668
  CDS Start-End: 260-583
aacaaaatggcggcggcagcggtgtcgctttgtttccgcggctcctgcggcggtggcagtggtagcggcctttgagctgtggggaggttccagcagcagctacagtgacgactaagactccagtgcatttctatcgtaaccgggcgcgggggagcgcagatcggcgcccagcaatcacagaagccgacaaggcgttcaagcgaaaacatgaccgctgagcccatgagataaaatcagtggttctggaagtaactctgatatgatggaaaacagcaaggaagagggaactagctcttcagaaaaatccaagtcttcaggatcgtcacgatcaaagaggaaaccttcaattgtaacaaagtatgtagaatcagatgatgaaaaacctttggatgatgaaactgtaaatgaagatgcgtctaatgaaaattcagaaaatgatattactatgcagagcttgccaaaagaagatgggcttcatgggattgtgagctgcactgcttgtggacaacaggtcaatcattttcaaaaagattccatttatagacacccttcattgcaagttcttatttgtaagaattgcttt

SEQ ID NO: 106686 - DNA, 4272 bp, Homo sapiens
  Payload ID: 951
  Gene Symbol: ATRX
  Gene Name: alpha thalassemia/mental retardation syndrome X-linked
  ENST ID: ENST00000624166
  CDS Start-End: 220-4272
gagcctcggcccaacaaaatggcggcggcagcggtgtcgctttgtttccgcggctcctgcggcggtggcagtggtagcggcctttgagctgtggggaggttccagcagcagctacagtgacgactaagactccagtgcatttctatcgtaaccgggcgcgggggagcgcagatcggcgcccagcaatcacagaagccgacaaggcgttcaagcgaaaacatgaccgctgagcccatgagtgaaagcaagttgaatacattggtgcagaagcttcatgacttccttgcacactcatcagaagaatctgaagaaacaagttctcctccacgacttgcaatgaatcaaaacacagataaaatcagtggttctggaagtaactctgatatgatggaaaacagcaaggaagagggaactagctcttcagaaaaatccaagtcttcaggatcgtcacgatcaaagaggaaaccttcaattgtaacaaagtatgtagaatcagatgatgaaaaacctttggatgatgaaactgtaaatgaagatgcgtctaatgaaaattcagaaaatgatattactatgcagagcttgccaaaagatgggcttcatgggattgtgagctgcactgcttgtggacaacaggtcaatcattttcaaaaagattccatttatagacacccttcattgcaagttcttatttgtaagaattgctttaagtattacatgagtgatgatattagccgtgactcagatggaatggatgaacaatgtaggtggtgtgcggaaggtggaaacttgatttgttgtgacttttgccataatgctttctgcaagaaatgcattctacgcaaccttggtcgaaaggagttgtccacaataatggatgaaaacaaccaatggtattgctacatttgtcacccagagcctttgttggacttggtcactgcatgtaacagcgtatttgagaatttagaacagttgttgcagcaaaataagaagaagataaaagttgacagtgaaaagagtaataaagtatatgaacatacatccagattttctccaaagaagactagttcaaattgtaatggagaagaaaagaaattagatgattcctgttctggctctgtaacctactcttattccgcactaattgtgcccaaagagatgattaagaaggcaaaaaaactgattgagaccacagccaacatgaactccagttatgttaaatttttaaagcaggcaacagataattcagaaatcagttctgctacaaaattacgtcagcttaaggcttttaagtctgtgttggctgatattaagaaggctcatcttgcattggaagaagacttaaattccgagtttcgagcgatggatgctgtaaacaaagagaaaaataccaaagagcataaagtcatagatgctaagtttgaaacaaaagcacgaaaaggagaaaaaccttgtgctttggaaaagaaggatatttcaaagtcagaagctaaactttcaagaaaacaggtagatagtgagcacatgcatcagaatgttccaacagaggaacaaagaacaaataaaagtaccggtggtgaacataagaaatctgatagaaaagaagaacctcaatatgaacctgccaacacttctgaagatttagacatggatattgtgtctgttccttcctcagttccagaagacatttttgagaatcttgagactgctatggaagttcagagttcagttgatcatcaaggggatggcagcagtggaactgaacaagaagtggagagttcatctgtaaaattaaatatttcttcaaaagacaacagaggaggtgctgattgtcaggaagttccacaagataaagatggctataaaagttgtggtctgaaccccaagttagagaaatgtggacttggacaggaaaacagtgataatgagcatttggttgaaaatgaagtttcattacttttagaggaatctgatcttcgaagatccccacgtgtaaagactacacccttgaggcgaccgacagaaactaaccctgtaacatctaattcagatgaagaatgtaatgaaacagttaaggagaaacaaaaactatcagttccagtgagaaaaaaggataagcgtaattcttctgacagtgctatagataatcctaagcctaataaattgccaaaatctaagcaatcagagactgtggatcaaaattcagattctgatgaaatgctagcaatcctcaaagaggtgagcaggatgagtcacagttcttcttcagatactgatattaatgaaattcatacaaaccataagactttgtatgatttaaagactcaggcggggaaagatgataaaggaaaaaggaaacgaaaaagttctacatctggctcagattttgatactaaaaagggcaaatcagctaagagctctataatttctaaaaagaaacgacaaacccagtctgagtcttctaattatgactcagaattagaaaaagagataaagagcatgagtaaaattggtgctgccagaaccaccaaaaaaagaattccaaatacaaaagattttgactcttctgaagatgagaaacacagcaaaaaaggaatggataatcaagggcacaaaaatttgaagacctcacaagaaggatcatctgatgatgctgaaagaaaacaagagagagagactttctcttcagcagaaggcacagttgataaagacacgaccatcatggaattaagagatcgacttcctaagaagcagcaagcaagtgcttccactgatggtgtcgataagctttctgggaaagaggagagttttacttctttggaagttagaaaagttgctgaaactaaagaaaagagcaagcatctcaaaaccaaaacatgtaaaaaagtacaggatggcttatctgatattgcagagaaattcctaaagaaagaccagagcgatgaaacttctgaagatgataaaaagcagagcaaaaagggaactgaagaaaaaaagaaaccttcagactttaagaaaaaagtaattaaaatggaacaacagtatgaatcttcatctgatggcactgaaaagttacctgagcgagaagaaatttgtcattttcctaagggcataaaacaaattaagaatggaacaactgatggagaaaagaaaagtaaaaaaataagagataaaacttctaaaaagaaggatgaattatctgattatgctgagaagtcaacagggaaaggagatagttgtgactcttcagaggataaaaagagtaagaatggagcatatggtagagagaagaaaaggtgcaagttgcttggaaagagttcaaggaagagacaagattgttcatcatctgatactgagaaatattccatgaaagaagatggttgtaactcttctgataagagactgaaaagaatagaattgagggaaagaagaaatttaagttcaaagagaaatactaaggaaatacaaagtggctcatcatcatctgatgctgaggaaagttctgaagataataaaaagaagaagcaaagaacttcatctaaaaagaaggcagtcattgtcaaggagaaaaagagaaactccctaagaacaagcactaaaaggaagcaagctgacattacatcctcatcttcttctgatatagaagatgatgatcagaattctataggtgagggaagcagcgatgaacagaaaattaagcctgtgactgaaaatttagtgctgtcttcacatactggattttgccaatcttcaggagatgaagccttatctaaatcagtgcctgtcacagtggatgatgatgatgacgacaatgatcctgagaatagaattgccaagaagatgcttttagaagaaattaaagccaatctttcctctgatgaggatggatcttcagatgatgagccagaagaagggaaaaaaagaactggaaaacaaaatgaagaaaacccaggagatgaggaagcaaaaaatcaagtcaattctgaatcagattcagattctgaagaatctaagaagccaagatacagacataggcttttgcggcacaaattgactgtgagtgacggagaatctggagaagaaaaaaagacaaagcctaaagagcataaagaagtcaaaggcagaaacagaagaaaggtgagcagtgaagattcagaagattctgattttcaggaatcaggagttagtgaagaagttagtgaatccgaagatgaacagcggcccagaacaaggtctgcaaagaaagcagagttggaagaaaatcagcggagctat

SEQ ID NO: 106687 - DNA, 1860 bp, Homo sapiens
  Payload ID: 951
  Gene Symbol: ATRX
  Gene Name: alpha thalassemia/mental retardation syndrome X-linked
  ENST ID: ENST00000623321
  CDS Start-End: 277-1860
tgcctgagcctcggcccaacaaaatggcggcggcagcggtgtcgctttgtttccgcggctcctgcggcggtggcagtggtagcggcctttgagctgtggggaggttccagcagcagctacagtgacgactaagactccagtgcatttctatcgtaaccgggcgcgggggagcgcagatcggcgcccagcaatcacagaagccgacaaggcgttcaagcgaaaacatgaccgctgagcccatgagataaaatcagtggttctggaagtaactctgatatgatggaaaacagcaaggaagagggaactagctcttcagaaaaatccaagtcttcaggatcgtcacgatcaaagaggaaaccttcaattgtaacaaagtatgtagaatcagatgatgaaaaacctttggatgatgaaactgtaaatgaagatgcgtctaatgaaaattcagaaaatgatattactatgcagagcttgccaaaaggtacagtgattgtacagccagagccagtgctgaatgaagacaaagatgattttaaagggcctgaatttagaagcagaagtaaaatgaaaactgaaaatctcaaaaaacgcggagaagatgggcttcatgggattgtgagctgcactgcttgtggacaacaggtcaatcattttcaaaaagattccatttatagacacccttcattgcaagttcttatttgtaagaattgctttaagtattacatgagtgatgatattagccgtgactcagatggaatggatgaacaatgtaggtggtgtgcggaaggtggaaacttgatttgttgtgacttttgccataatgctttctgcaagaaatgcattctacgcaaccttggtcgaaaggagttgtccacaataatggatgaaaacaaccaatggtattgctacatttgtcacccagagcctttgttggacttggtcactgcatgtaacagcgtatttgagaatttagaacagttgttgcagcaaaataagaagaagataaaagttgacagtgaaaagagtaataaagtatatgaacatacatccagattttctccaaagaagactagttcaaattgtaatggagaagaaaagaaattagatgattcctgttctggctctgtaacctactcttattccgcactaattgtgcccaaagagatgattaagaaggcaaaaaaactgattgagaccacagccaacatgaactccagttatgttaaatttttaaagcaggcaacagataattcagaaatcagttctgctacaaaattacgtcagcttaaggcttttaagtctgtgttggctgatattaagaaggctcatcttgcattggaagaagacttaaattccgagtttcgagcgatggatgctgtaaacaaagagaaaaataccaaagagcataaagtcatagatgctaagtttgaaacaaaagcacgaaaaggagaaaaaccttgtgctttggaaaagaaggatatttcaaagtcagaagctaaactttcaagaaaacaggtagatagtgagcacatgcatcagaatgttccaacagaggaacaaagaacaaataaaagtaccggtggtgaacataagaaatctgatagaaaagaagaacctcaatatgaacctgccaacacttctgaagatttagacatggatattgtgtctgttccttcctcagttccagaagacatttttgagaatcttgagactgctatggaagttcagagttcagttgatcatcaaggggatggcagcagtggaactgaacaagaagtggagagttcatctgtaaaattaaatatttcttcaaaagacaacagaggaggtattaaatcaaaaactacagctaaagtaaca

SEQ ID NO: 106688 - DNA, 725 bp, Homo sapiens
  Payload ID: 951
  Gene Symbol: ATRX
  Gene Name: alpha thalassemia/mental retardation syndrome X-linked
  ENST ID: ENST00000623242
  CDS Start-End: 1-199
tgaaaatgatgattccaagtctcctggaaaaggcagaaagaaaattcggaagattcttaaagatgataaactgagaacagaaacacaaaatgctcttaaggaagaggaagagagacgaaaacgtattgctgagagggagcgtgagcgagaaaaattgagagaggtaactaatttctttcttcttctttttcttttgtagctacagggtcttgctctgttgcccaggctggcctcgaactcttgggctcaagtgatcctcctaccttggcctcctaaacttctgggattacaggcgtgatagaaattgaagatgcttcacccaccaagtgtccaataacaaccaagttggttttagatgaagatgaagaaaccaaagaacctttagtgcaggttcatagaaatatggttatcaaattgaaaccccatcaagtagatggtgttcagtttatgtgggattgctgctgtgagtctgtgaaaaaaacaaagaaatctccaggttcaggatgcattcttgcccactgtatgggccttggtaagactttacaggtggtaagttttcttcatacagttcttttgtgtgacaaactggatttcagcacggcgttagtggtttgtcctcttaatactgctttgaattggatgaatgaatttgagaagtggcaagagggattaaaagatgatgagaagcttgaggtttctgaattagcaactgtgaaacgtcctca

SEQ ID NO: 106689 - DNA, 3071 bp, Homo sapiens
  Payload ID: 951
  Gene Symbol: ATRX
  Gene Name: alpha thalassemia/mental retardation syndrome X-linked
  ENST ID: ENST00000624032
  CDS Start-End: 208-3071
aacaaaatggcggcggcagcggtgtcgctttgtttccgcggctcctgcggcggtggcagtggtagcggcctttgagctgtggggaggttccagcagcagctacagtgacgactaagactccagtgcatttctatcgtaaccgggcgcgggggagcgcagatcggcgcccagcaatcacagaagccgacaaggcgttcaagcgaaaacatgaccgctgagcccatgagtgaaagcaagttgaatacattggtgcagaagcttcatgacttccttgcacactcatcagaagaatctgaagaaacaagttctcctccacgacttgcaatgaatcaaaacacagataaaatcagtggttctggaagtaactctgatatgatggaaaacagcaaggaagagggaactagctcttcagaaaaatccaagtcttcaggatcgtcacgatcaaagaggaaaccttcaattgtaacaaagtatgtagaatcagatgatgaaaaacctttggatgatgaaactgtaaatgaagatgcgtctaatgaaaattcagaaaatgatattactatgcagagcttgccaaaaggtacagtgattgtacagccagagccagtgctgaatgaagacaaagatgattttaaagggcctgaatttagaagcagaagtaaaatgaaaactgaaaatctcaaaaaacgcggagaagatgggcttcatgggattgtgagctgcactgcttgtggacaacaggtcaatcattttcaaaaagattccatttatagacacccttcattgcaagttcttatttgtaagaattgctttaagtattacatgagtgatgatattagccgtgactcagatggaatggatgaacaatgtaggtggtgtgcggaaggtggaaacttgatttgttgtgacttttgccataatgctttctgcaagaaatgcattctacgcaaccttggtcgaaaggagttgtccacaataatggatgaaaacaaccaatggtattgctacatttgtcacccagagcctttgttggacttggtcactgcatgtaacagcgtatttgagaatttagaacagttgttgcagcaaaataagaagaagataaaagttgacagtgaaaagagtaataaagtatatgaacatacatccagattttctccaaagaagactagttcaaattgtaatggagaagaaaagaaattagatgattcctgttctggctctgtaacctactcttattccgcactaattgtgcccaaagagatgattaagaaggcaaaaaaactgattgagaccacagccaacatgaactccagttatgttaaatttttaaagcaggcaacagataattcagaaatcagttctgctacaaaattacgtcagcttaaggcttttaagtctgtgttggctgatattaagaaggctcatcttgcattggaagaagacttaaattccgagtttcgagcgatggatgctgtaaacaaagagaaaaataccaaagagcataaagtcatagatgctaagtttgaaacaaaagcacgaaaaggagaaaaaccttgtgctttggaaaagaaggatatttcaaagtcagaagctaaactttcaagaaaacaggtagatagtgagcacatgcatcagaatgttccaacagaggaacaaagaacaaataaaagtaccggtggtgaacataagaaatctgatagaaaagaagaacctcaatatgaacctgccaacacttctgaagatttagacatggatattgtgtctgttccttcctcagttccagaagacatttttgagaatcttgagactgctatggaagttcagagttcagttgatcatcaaggggatggcagcagtggaactgaacaagaagtggagagttcatctgtaaaattaaatatttcttcaaaagacaacagaggaggtgctgattgtcaggaagttccacaagataaagatggctataaaagttgtggtctgaaccccaagttagagaaatgtggacttggacaggaaaacagtgataatgagcatttggttgaaaatgaagtttcattacttttagaggaatctgatcttcgaagatccccacgtgtaaagactacacccttgaggcgaccgacagaaactaaccctgtaacatctaattcagatgaagaatgtaatgaaacagttaaggagaaacaaaaactatcagttccagtgagaaaaaaggataagcgtaattcttctgacagtgctatagataatcctaagcctaataaattgccaaaatctaagcaatcagagactgtggatcaaaattcagattctgatgaaatgctagcaatcctcaaagaggtgagcaggatgagtcacagttcttcttcagatactgatattaatgaaattcatacaaaccataagactttgtatgatttaaagactcaggcggggaaagatgataaaggaaaaaggaaacgaaaaagttctacatctggctcagattttgatactaaaaagggcaaatcagctaagagctctataatttctaaaaagaaacgacaaacccagtctgagtcttctaattatgactcagaattagaaaaagagataaagagcatgagtaaaattggtgctgccagaaccaccaaaaaaagaattccaaatacaaaagattttgactcttctgaagatgagaaacacagcaaaaaaggaatggataatcaagggcacaaaaatttgaagacctcacaagaaggatcatctgatgatgctgaaagaaaacaagagagagagactttctcttcagcagaaggcacagttgataaagacacgaccatcatggaattaagagatcgacttcctaagaagcagcaagcaagtgcttccactgatggtgtcgataagctttctgggaaagaggagagttttacttctttggaagttagaaaagttgctgaaactaaagaaaagagcaagcatctcaaaaccaaaacatgtaaaaaagtacaggatggcttatctgatattgcagagaaattcctaaagaaagaccagagcgatgaaacttctgaagatgataaaaagca

SEQ ID NO: 106690 - DNA, 803 bp, Homo sapiens
  Payload ID: 951
  Gene Symbol: ATRX
  Gene Name: alpha thalassemia/mental retardation syndrome X-linked
  ENST ID: ENST00000623316
  CDS Start-End: 1-527
gaagaggaaaggcaggtgcaaagcttttccaagattttcagatgttaagtagaatatggactcatccttggtgtttgcagctagactacattagcaaagaaaataagggttattttgatgaagacagtatggatgaatttatagcctcagattctgatgaaacctccatgagtttaagctccgatgattatacaaaaaagaagaaaaaagggaaaaaggggaaaaaagatagtagctcaagtggaagtggcagtgacaatgatgttgaagtgattaaggtctggaattcaagatctcggggaggtggtgaaggaaatgtggatgaaacaggaaacaatccttctgtttctttaaaactggaagaaaatatttataaagtgcttactatatgcccagacataaggagggaactgataagcctaaatggtaaattgaagaaggtaaagctacttcttcttctaatccaagcagcccagctccagactggtacaaagattttgttacagatgctgatgctgaggttttagagcattctgggaaaatggtacttctctttgaaattcttcgaatggcagaggaaattggggataaagtccttgttttcagccagtccctcatatctctggacttgattgaagattttcttgaattagctagtagggagaagacagaagataaagataaaccccttatttataaaggtgaggggaagtggcttcgaaacattgactattaccgtttagatggttccactactgcacagtcaaggaagaagtgggctgaagaatttaatgatgaaacta

SEQ ID NO: 106691 - DNA, 2967 bp, Homo sapiens
  Payload ID: 951
  Gene Symbol: ATRX
  Gene Name: alpha thalassemia/mental retardation syndrome X-linked
  ENST ID: ENST00000493470
  CDS Start-End: 1-882
acaactgatggagaaaagaaaagtaaaaaaataagagataaaacttctaaaaagaaggatgaattatctgattatgctgagaagtcaacagggaaaggagatagttgtgactcttcagaggataaaaagagtaagaatggagcatatggtagagagaagaaaaggtgcaagttgcttggaaagagttcaaggaagagacaagattgttcatcatctgatactgagaaatattccatgaaagaagatggttgtaactcttctgataagagactgaaaagaatagaattgagggaaagaagaaatttaagttcaaagagaaatactaaggaaatacaaagtggctcatcatcatctgatgctgaggaaagttctgaagataataaaaagaagaagcaaagaacttcatctaaaaagaaggcagtcattgtcaaggagaaaaagagaaactccctaagaacaagcactaaaaggaagcaagctgacattacatcctcatcttcttctgatatagaagatgatgatcagaattctataggtgagggaagcagcgatgaacagaaaattaagcctgtgactgaaaatttagtgctgtcttcacatactggattttgccaatcttcaggagatgaagccttatctaaatcagtgcctgtcacagtggatgatgatgatgacgacaatgatcctgagaataggtatgattccatctgtaaggactttaaaaagattataacacaccctaggcatgggcacaaacagcagcaacggaacagcaagcaggttgtaaaaaccaggagtgcctgccttagaaagactcgctcacagtcttcctgcaagtttgaaagaaaggccagaaaatgggctaaaactcagaaaccttaagagaaagtaatatcattatttacacacctagcatagggtgtgttataaatacagaactgtcaattttatgttgctatgtaaactgcagtaatttttttggaataatttattttgacagattattgatgaaagtaaatcatatctcagtaaattggtaacaacagacatctcctctatatttgactattgttaattgccatccaatatggtggtcctatttattaaggcctgttgagaagaaacaaaaagagagattactcagatatttaagattaagaaattgctttcaaaataagtgtcagtttacaaggtatctagactgagttagagtttaaccagttttcaaataaaatagaaatacacggtatgagagcatttactttaataagacttaataggtttaaatgtcaacagtgtagcctatacagatatacttaagtaaggggtggctgggtgaagaaaaaaaaagacactatcagtgtagtgaagaataaggaaaacaacagtattaaagactatagctataatgtttcaacataacttttaaacacttcctggacaatagcataccccatgctcataatcttcaacaagaagacagcatggtatagtgcatggaattttggaataatgggcataagggtatctgatttctaacatttttaacaactgtctgtgtcatcatgggcaagtgactttactttttgtcaaaaatttactatatttaagaagaaaaagttgggcgaaattttctgtaattctagtaccaaaaaatccatgatagatttgagatgatttcattaaagagcactacattaaccattcatttattcctaatagtaagttctaacattaagaaaacataaaaatatacatgtaattttctgtcataattttgtaagaaattaactgacttagtaaatgccctgggttcagctgttagtttcgctcttttgtatcttgctgatgctgttaggtttctctgtttcaaaggtcagcattctgctaattaacagaagaatgtttttattaaggtgaatgaacagttttattttacagttttgaatagagcttaattgtggacacaaatattcagattctgcttgcctacttttttaaattaaaaaatgtatatccatttattttatgggataggtggtaggttccagaatggagtgataagggcatacaatttattcatcagggattttacattatatcatcacagccagatactgaaagcatttaaaattttactcttttttaagatgctttaatttttcttcatttatatttgctatttgattttctatacatcatgaggcctcagatgttactcaaaggctaataatgttttaaacattctatatcttaatttaactgtgaatgatttactttaatttcatatttaaccaccaaataagagtgttgttaaggtataatttttttgtgtgtgttagagcttgtcaaaatataaatatcattttcaacttttaagttacctgatcgtatctctctgtaactggcaagtattttattggaaagtatctttaattccaccttgaatttgtgattaaaaaatacaaccctgttgagtacttttgagaagaattgaattttatcttgagcatgtctttctatactcagtttaatttgtttttataaaatatacaatttattaacttgtttaatattcactataccaaagaggtatctaatacccatgggttatgtagtcatgatggggatacaaatactttcttgcactattttagtatagattatatatttgagcatatttgaatatgcactaagcaacttaaaaaattcatttgcagatcacgattaagtcttagaattatttttctaacttcctaatttttgagtaggttgtattttggtagacagcatattgtaattgtatgtaaatttgtacacaattgtgtgtaaattgtgtataaatcttatatgctttgtctttttagcagtattgtaatacattttcagtgttggtgtttatgaagcgatagtgtattattgcaaatggttaactatttggatgcaataaatttttgtaaacctttt

SEQ ID NO: 106692 - DNA, 628 bp, Homo sapiens
  Payload ID: 951
  Gene Symbol: ATRX
  Gene Name: alpha thalassemia/mental retardation syndrome X-linked
  ENST ID: ENST00000622960
  CDS Start-End: 487-628
aattctcctgcctgagcctcggcccaacaaaatggcggcggcagcggtgtcgctttgtttccgcggctcctgcggcggtggcagtggtagcggcctttgagctgtggggaggttccagcagcagctacagtgacgactaagactccagtgcatttctatcgtaaccgggcgcgggggagcgcagatcggcgcccagcaatcacagaagccgacaaggcgttcaagcgaaaacatgaccgctgagcccatgaggtaaaacgcaaccccgtctcatgggccccagcggtctgggcccaggcaccgtctgagtcgggtgtttgggaaggcgttcgcttggtgggttaggcctgtgtgttgcttagccgaaagaggcatcgttttctctttagtgaaagcaagttgaatacattggtgcagaagcttcatgacttccttgcacactcatcagaagaatctgaagaaacaagttctcctccacgacttgcaatgaatcaaaacacagataaaatcagtggttctggaagtaactctgatatgatggaaaacagcaaggaagagggaactagctcttcagaaaaatccaagtcttcaggatcgtcacgatcaaagaggaaaccttcaattgtaa

SEQ ID NO: 106693 - DNA, 2611 bp, Homo sapiens
  Payload ID: 952
  Gene Symbol: ATAT1
  Gene Name: alpha tubulin acetyltransferase 1
  Uniprot ID: Q5SQI0
  ENST ID: ENST00000318999
  CDS Start-End: 45-947
gaagtgacgtcgtgtggggcgggtccgaccgcgcacaatgggccatggagttcccgttcgatgtggacgcgctgttcccggagcggatcacggtgctggaccagcacctgaggcccccagcccgccgacccggaaccacaacgccggcccgtgttgatctacagcagcaaattatgaccattatagatgaactgggcaaggcttctgccaaggcccagaatctttccgctcctatcactagtgcatcaaggatgcagagtaaccgccatgttgtttatattctcaaagacagttcagcccgaccggctggaaaaggagccattattggtttcatcaaagttggatacaagaagctctttgtactggatgatcgtgaggctcataatgaggtagaaccactttgcatcctggacttttacatccatgagtctgtgcaacgccatggccatgggcgagaactcttccagtatatgttgcagaaggagcgagtggaaccgcaccaactggcaattgaccgaccctcacagaagctgctgaaattcctgaataagcactacaatctggagaccacagtcccacaggtgaacaactttgtgatctttgaaggcttctttgcccatcaacatcctccagcaaggaagctgccacccaagagagcagagggagacatcaagccatactcctctagtgaccgagaatttctgaaggtagctgtggagcctccttggcccctaaacagggcccctcgccgcgccacacctccagcccacccacccccccgctccagcagcctgggaaactcaccagaacgaggtcccctccgcccctttgtgccagagcaggagctgctgcgttccttgcgcctctgccccccacaccctaccgcccgccttctgttggctgctgaccctgggggcagcccagctcaacgtcgtcgcaccaggtaataggagttgaagggctaaggagcctcacagctataaaagaggatgttagaaatggcaaagggcaatttgaatccatcagagagatggatcaataagatgggtggcttggggggggtcctgaaacctttcaagaaaaatatttgtgcaagtgatctgggaaaaaaatgcagtgaaggagcagaataggaccttatatggagcctagggaccctggctttaatgtgagagttatgtggaatggtaggaagaacaccgagatccatcgagttgggggaacagagccttctaagattgggaaaatcttcgcttaatacttgctggggaaggggcagtgtctgacagagagtgggaagccactggcttgtgtgccaagagtccatcgcagcaggcagggagtgggcatttcctttatttctctccctttctcttcacctctgacttctctgtttttctctcccccgccccccgccatttcccatctcccttcctcccatccataacatccttccacagctcccttccccgctctgaggagagtcgatactaacagctaccctctccctgccctgggagacctggggtgggcagggaacccctccctgagaacctcagacccactcttccattgcatcctgtaggacccagtggaacctgacagagcccataggattccctcttctactttcttagacagcagggatgtcagggtctcaaactgcctaacactttgtagcttttcttaacacaaaagcaccccttctctcctaacttgggctctgaatactttcccaacaggaagtctgatctgttgccagacttcttggttagatggctcatacatttatctagagaagcacactcttgcttgctgtcaaactttagaccaccatggaaggtctaagggcatcctgtgccagggaaactttttaaggaattttatctatgggataaaccccatattccctctagtgtctactggtggctctaatactgctttgtgctgcctgccacacttgccctttgagcctgcgaatggccgctagtgagcaagctctgcttcagagcagtctagttaggtagaacagggacttaccagcttcccaaagggatctactcaccattgccaaactcttcatttccacattttgtgtaggtgtcagggaaccccaaactggtgttgctttggggtctctaaaggagattggctgacaccaccatttcccccagatccagattctctgagggaggttgtttcttgagagtagatccagagtgtcaaggatctgttagatcctggaatcccttcttgcatccatccctccctggtagctaggtcccgatatactcctgtcttgtgagattgtcgagatgagatgggggaccactcttcctctgtccttcctctctcctttcctccatagcaaggacgaccttccctgctccatgcccagagtatagctagatcccttcccctccctaccctctgaatgtgtgctagatcaggtgccccactgtgtttcctgaaatccttgggagccggatctccccatctcccctactcactcttcccttttcttctctcagtgttgtctgaataaagtgtgaaatcttttgtgttttctaaattgacattttcaatgaaaaaaagaatcacaaaaaaaaaa

SEQ ID NO: 106694 - DNA, 2061 bp, Homo sapiens
  Payload ID: 952
  Gene Symbol: ATAT1
  Gene Name: alpha tubulin acetyltransferase 1
  Uniprot ID: Q5SQI0
  ENST ID: ENST00000319027
  CDS Start-End: 12-944
cacaatgggccatggagttcccgttcgatgtggacgcgctgttcccggagcggatcacggtgctggaccagcacctgaggcccccagcccgccgacccggaaccacaacgccggcccgtgttgatctacagcagcaaattatgaccattatagatgaactgggcaaggcttctgccaaggcccagaatctttccgctcctatcactagtgcatcaaggatgcagagtaaccgccatgttgtttatattctcaaagacagttcagcccgaccggctggaaaaggagccattattggtttcatcaaagttggatacaagaagctctttgtactggatgatcgtgaggctcataatgaggtagaaccactttgcatcctggacttttacatccatgagtctgtgcaacgccatggccatgggcgagaactcttccagtatatgttgcagaaggagcgagtggaaccgcaccaactggcaattgaccgaccctcacagaagctgctgaaattcctgaataagcactacaatctggagaccacagtcccacaggtgaacaactttgtgatctttgaaggcttctttgcccatcaacatcctccagcaaggaagctgccacccaagagagcagagggagacatcaagccatactcctctagtgaccgagaatttctgaaggtagctgtggagcctccttggcccctaaacagggcccctcgccgcgccacacctccagcccacccacccccccgctccagcagcctgggaaactcaccagaacgaggtcccctccgcccctttgtgccagagcaggagctgctgcgttccttgcgcctctgccccccacaccctaccgcccgccttctgttggctgctgaccctgggggcagcccagctcaacgtcgtcgcaccagctcccttccccgctctgaggagagtcgatactaacagctaccctctccctgccctgggagacctggggtgggcagggaacccctccctgagaacctcagacccactcttccattgcatcctgtaggacccagtggaacctgacagagcccataggattccctcttctactttcttagacagcagggatgtcagggtctcaaactgcctaacactttgtagcttttcttaacacaaaagcaccccttctctcctaacttgggctctgaatactttcccaacaggaagtctgatctgttgccagacttcttggttagatggctcatacatttatctagagaagcacactcttgcttgctgtcaaactttagaccaccatggaaggtctaagggcatcctgtgccagggaaactttttaaggaattttatctatgggataaaccccatattccctctagtgtctactggtggctctaatactgctttgtgctgcctgccacacttgccctttgagcctgcgaatggccgctagtgagcaagctctgcttcagagcagtctagttaggtagaacagggacttaccagcttcccaaagggatctactcaccattgccaaactcttcatttccacattttgtgtaggtgtcagggaaccccaaactggtgttgctttggggtctctaaaggagattggctgacaccaccatttcccccagatccagattctctgagggaggttgtttcttgagagtagatccagagtgtcaaggatctgttagatcctggaatcccttcttgcatccatccctccctggtagctaggtcccgatatactcctgtcttgtgagattgtcgagatgagatgggggaccactcttcctctgtccttcctctctcctttcctccatagcaaggacgaccttccctgctccatgcccagagtatagctagatcccttcccctccctaccctctgaatgtgtgctagatcaggtgccccactgtgtttcctgaaatccttgggagccggatctccccatctcccctactcactcttcccttttcttctctcagtgttgtctgaataaagtgtgaaatcttttgtgttttctaaattgacattttcaatgaaaaaaagaatcacaaaaaaaaaa

SEQ ID NO: 106695 - DNA, 1728 bp, Homo sapiens
  Payload ID: 952
  Gene Symbol: ATAT1
  Gene Name: alpha tubulin acetyltransferase 1
  Uniprot ID: Q5SQI0
  ENST ID: ENST00000330083
  CDS Start-End: 319-1548
atggagttcccgttcgatgtggacgcgctgttcccggagcggatcacggtgctggaccagcacctgaggcccccagcccgccgacccggaaccacaacgccggcccggtgacagctcaaacccaccctctggcccttttctcccggttcctctccaaacctggtccaggcaccacgcccccttctcactgactagtgatcgccccttttgatgtccaggcctgcctttttggtgacctctgaccctgggcctagtgggattgatcagcgcttggatctgtgacctttcaccccgggcccaaaatgtcccaatcaaaggatgtggttgacctggcctttctgcttcctcacaataaccttaagggaggagggagtgtgccaccttgaaagtgttgatctacagcagcaaattatgaccattatagatgaactgggcaaggcttctgccaaggcccagaatctttccgctcctatcactagtgcatcaaggatgcagagtaaccgccatgttgtttatattctcaaagacagttcagcccgaccggctggaaaaggagccattattggtttcatcaaagttggatacaagaagctctttgtactggatgatcgtgaggctcataatgaggtagaaccactttgcatcctggacttttacatccatgagtctgtgcaacgccatggccatgggcgagaactcttccagtatatgttgcagaaggagcgagtggaaccgcaccaactggcaattgaccgaccctcacagaagctgctgaaattcctgaataagcactacaatctggagaccacagtcccacaggtgaacaactttgtgatctttgaaggcttctttgcccatcaacatcggccccctgctccctctctgagggcaactcgacactctcgtgctgctgcagtcgatcccacgcccgctgctccagcaaggaagctgccacccaagagagcagagggagacatcaagccatactcctctagtgaccgagaatttctgaaggtagctgtggagcctccttggcccctaaacagggcccctcgccgcgccacacctccagcccacccacccccccgctccagcagcctgggaaactcaccagaacgaggtcccctccgcccctttgtgccagagcaggagctgctgcgttccttgcgcctctgccccccacaccctaccgcccgccttctgttggctgctgaccctgggggcagcccagctcaacgtcgtcgcaccagggggactcccccaggtctggtagcccaaagctgctgctacagccgccatgggggggtgaattcctcatcccccaatacaggcaaccaagactccaagcagggagaacaggaaacaaagaataggtctgccagtgaggagcaggccttgtcacaggatgggtctggggagaagcccatgcacacagctcctccacaggccccggccccgccagcccagtcctggacagtgggtggggacatactcaacgccaggttcattcgaaacctgcaggaacgtcgcagcaccaggccttggtgaccgcagccccgtcaaacatcttcaaagtattatttctccctcactacaggaaagagccaaagcccaaccctcataatagatggatacattcattcattcattcattcagcaggcttatcagattcaagtcatttgtatcttttaaccagaccaataaaagtatttatttttatcacaaga

SEQ ID NO: 106696 - DNA, 2119 bp, Homo sapiens
  Payload ID: 952
  Gene Symbol: ATAT1
  Gene Name: alpha tubulin acetyltransferase 1
  Uniprot ID: Q5SQI0
  ENST ID: ENST00000329992
  CDS Start-End: 1-1002
atggagttcccgttcgatgtggacgcgctgttcccggagcggatcacggtgctggaccagcacctgaggcccccagcccgccgacccggaaccacaacgccggcccgtgttgatctacagcagcaaattatgaccattatagatgaactgggcaaggcttctgccaaggcccagaatctttccgctcctatcactagtgcatcaaggatgcagagtaaccgccatgttgtttatattctcaaagacagttcagcccgaccggctggaaaaggagccattattggtttcatcaaagttggatacaagaagctctttgtactggatgatcgtgaggctcataatgaggtagaaccactttgcatcctggacttttacatccatgagtctgtgcaacgccatggccatgggcgagaactcttccagtatatgttgcagaaggagcgagtggaaccgcaccaactggcaattgaccgaccctcacagaagctgctgaaattcctgaataagcactacaatctggagaccacagtcccacaggtgaacaactttgtgatctttgaaggcttctttgcccatcaacatcggccccctgctccctctctgagggcaactcgacactctcgtgctgctgcagtcgatcccacgcccgctgctccagcaaggaagctgccacccaagagagcagagggagacatcaagccatactcctctagtgaccgagaatttctgaaggtagctgtggagcctccttggcccctaaacagggcccctcgccgcgccacacctccagcccacccacccccccgctccagcagcctgggaaactcaccagaacgaggtcccctccgcccctttgtgccagagcaggagctgctgcgttccttgcgcctctgccccccacaccctaccgcccgccttctgttggctgctgaccctgggggcagcccagctcaacgtcgtcgcaccagctcccttccccgctctgaggagagtcgatactaacagctaccctctccctgccctgggagacctggggtgggcagggaacccctccctgagaacctcagacccactcttccattgcatcctgtaggacccagtggaacctgacagagcccataggattccctcttctactttcttagacagcagggatgtcagggtctcaaactgcctaacactttgtagcttttcttaacacaaaagcaccccttctctcctaacttgggctctgaatactttcccaacaggaagtctgatctgttgccagacttcttggttagatggctcatacatttatctagagaagcacactcttgcttgctgtcaaactttagaccaccatggaaggtctaagggcatcctgtgccagggaaactttttaaggaattttatctatgggataaaccccatattccctctagtgtctactggtggctctaatactgctttgtgctgcctgccacacttgccctttgagcctgcgaatggccgctagtgagcaagctctgcttcagagcagtctagttaggtagaacagggacttaccagcttcccaaagggatctactcaccattgccaaactcttcatttccacattttgtgtaggtgtcagggaaccccaaactggtgttgctttggggtctctaaaggagattggctgacaccaccatttcccccagatccagattctctgagggaggttgtttcttgagagtagatccagagtgtcaaggatctgttagatcctggaatcccttcttgcatccatccctccctggtagctaggtcccgatatactcctgtcttgtgagattgtcgagatgagatgggggaccactcttcctctgtccttcctctctcctttcctccatagcaaggacgaccttccctgctccatgcccagagtatagctagatcccttcccctccctaccctctgaatgtgtgctagatcaggtgccccactgtgtttcctgaaatccttgggagccggatctccccatctcccctactcactcttcccttttcttctctcagtgttgtctgaataaagtgtgaaatcttttgtgttttctaaattgacattttcaatgaaaaaaagaatcacaaaaaaaaaa

SEQ ID NO: 106697 - DNA, 2646 bp, Homo sapiens
  Payload ID: 952
  Gene Symbol: ATAT1
  Gene Name: alpha tubulin acetyltransferase 1
  Uniprot ID: Q5SQI0
  ENST ID: ENST00000376483
  CDS Start-End: 11-982
acaatgggccatggagttcccgttcgatgtggacgcgctgttcccggagcggatcacggtgctggaccagcacctgaggcccccagcccgccgacccggaaccacaacgccggcccgtgttgatctacagcagcaaattatgaccattatagatgaactgggcaaggcttctgccaaggcccagaatctttccgctcctatcactagtgcatcaaggatgcagagtaaccgccatgttgtttatattctcaaagacagttcagcccgaccggctggaaaaggagccattattggtttcatcaaagttggatacaagaagctctttgtactggatgatcgtgaggctcataatgaggtagaaccactttgcatcctggacttttacatccatgagtctgtgcaacgccatggccatgggcgagaactcttccagtatatgttgcagaaggagcgagtggaaccgcaccaactggcaattgaccgaccctcacagaagctgctgaaattcctgaataagcactacaatctggagaccacagtcccacaggtgaacaactttgtgatctttgaaggcttctttgcccatcaacatcggccccctgctccctctctgagggcaactcgacactctcgtgctgctgcagtcgatcccacgcccgctgctccagcaaggaagctgccacccaagagagcagagggagacatcaagccatactcctctagtgaccgagaatttctgaaggtagctgtggagcctccttggcccctaaacagggcccctcgccgcgccacacctccagcccacccacccccccgctccagcagcctgggaaactcaccagaacgaggtcccctccgcccctttgtgccagagcaggagctgctgcgttccttgcgcctctgccccccacaccctaccgcccgccttctgttggctgctgaccctgggggcagcccagctcaacgtcgtcgcaccaggtaataggagttgaagggctaaggagcctcacagctataaaagaggatgttagaaatggcaaagggcaatttgaatccatcagagagatggatcaataagatgggtggcttggggggggtcctgaaacctttcaagaaaaatatttgtgcaagtgatctgggaaaaaaatgcagtgaaggagcagaataggaccttatatggagcctagggaccctggctttaatgtgagagttatgtggaatggtaggaagaacaccgagatccatcgagttgggggaacagagccttctaagattgggaaaatcttcgcttaatacttgctggggaaggggcagtgtctgacagagagtgggaagccactggcttgtgtgccaagagtccatcgcagcaggcagggagtgggcatttcctttatttctctccctttctcttcacctctgacttctctgtttttctctcccccgccccccgccatttcccatctcccttcctcccatccataacatccttccacagctcccttccccgctctgaggagagtcgatactaacagctaccctctccctgccctgggagacctggggtgggcagggaacccctccctgagaacctcagacccactcttccattgcatcctgtaggacccagtggaacctgacagagcccataggattccctcttctactttcttagacagcagggatgtcagggtctcaaactgcctaacactttgtagcttttcttaacacaaaagcaccccttctctcctaacttgggctctgaatactttcccaacaggaagtctgatctgttgccagacttcttggttagatggctcatacatttatctagagaagcacactcttgcttgctgtcaaactttagaccaccatggaaggtctaagggcatcctgtgccagggaaactttttaaggaattttatctatgggataaaccccatattccctctagtgtctactggtggctctaatactgctttgtgctgcctgccacacttgccctttgagcctgcgaatggccgctagtgagcaagctctgcttcagagcagtctagttaggtagaacagggacttaccagcttcccaaagggatctactcaccattgccaaactcttcatttccacattttgtgtaggtgtcagggaaccccaaactggtgttgctttggggtctctaaaggagattggctgacaccaccatttcccccagatccagattctctgagggaggttgtttcttgagagtagatccagagtgtcaaggatctgttagatcctggaatcccttcttgcatccatccctccctggtagctaggtcccgatatactcctgtcttgtgagattgtcgagatgagatgggggaccactcttcctctgtccttcctctctcctttcctccatagcaaggacgaccttccctgctccatgcccagagtatagctagatcccttcccctccctaccctctgaatgtgtgctagatcaggtgccccactgtgtttcctgaaatccttgggagccggatctccccatctcccctactcactcttcccttttcttctctcagtgttgtctgaataaagtgtgaaatcttttgtgttttctaaattgacattttcaatgaaaaaaagaatcacaaaaaaaaaa

SEQ ID NO: 106698 - DNA, 1476 bp, Homo sapiens
  Payload ID: 952
  Gene Symbol: ATAT1
  Gene Name: alpha tubulin acetyltransferase 1
  Uniprot ID: Q5SQI0
  ENST ID: ENST00000376485
  CDS Start-End: 31-1296
tggggcgggtccgaccgcgcacaatgggccatggagttcccgttcgatgtggacgcgctgttcccggagcggatcacggtgctggaccagcacctgaggcccccagcccgccgacccggaaccacaacgccggcccgtgttgatctacagcagcaaattatgaccattatagatgaactgggcaaggcttctgccaaggcccagaatctttccgctcctatcactagtgcatcaaggatgcagagtaaccgccatgttgtttatattctcaaagacagttcagcccgaccggctggaaaaggagccattattggtttcatcaaagttggatacaagaagctctttgtactggatgatcgtgaggctcataatgaggtagaaccactttgcatcctggacttttacatccatgagtctgtgcaacgccatggccatgggcgagaactcttccagtatatgttgcagaaggagcgagtggaaccgcaccaactggcaattgaccgaccctcacagaagctgctgaaattcctgaataagcactacaatctggagaccacagtcccacaggtgaacaactttgtgatctttgaaggcttctttgcccatcaacatcggccccctgctccctctctgagggcaactcgacactctcgtgctgctgcagtcgatcccacgcccgctgctccagcaaggaagctgccacccaagagagcagagggagacatcaagccatactcctctagtgaccgagaatttctgaaggtagctgtggagcctccttggcccctaaacagggcccctcgccgcgccacacctccagcccacccacccccccgctccagcagcctgggaaactcaccagaacgaggtcccctccgcccctttgtgccagagcaggagctgctgcgttccttgcgcctctgccccccacaccctaccgcccgccttctgttggctgctgaccctgggggcagcccagctcaacgtcgtcgcaccagggggactcccccaggtctggtagcccaaagctgctgctacagccgccatgggggggtgaattcctcatcccccaatacaggcaaccaagactccaagcagggagaacaggaaacaaagaataggtctgccagtgaggagcaggccttgtcacaggatgggtctggggagaagcccatgcacacagctcctccacaggccccggccccgccagcccagtcctggacagtgggtggggacatactcaacgccaggttcattcgaaacctgcaggaacgtcgcagcaccaggccttggtgaccgcagccccgtcaaacatcttcaaagtattatttctccctcactacaggaaagagccaaagcccaaccctcataatagatggatacattcattcattcattcattcagcaggcttatcagattcaagtcatttgtatcttttaaccagaccaataaaagtatttatttttatcacaaga

SEQ ID NO: 106699 - DNA, 1728 bp, Homo sapiens; identical to SEQ ID NO: 106695
  Payload ID: 952
  Gene Symbol: ATAT1
  Gene Name: alpha tubulin acetyltransferase 1
  Uniprot ID: Q5SQI0
  ENST ID: ENST00000383582
  CDS Start-End: 319-1548

SEQ ID NO: 106700 - DNA, 2119 bp, Homo sapiens
  Payload ID: 952
  Gene Symbol: ATAT1
  Gene Name: alpha tubulin acetyltransferase 1
  Uniprot ID: Q5SQI0
  ENST ID: ENST00000383583
  CDS Start-End: 1-1002
atggagttcccgttcgatgtggacgcgctgttcccggagcggatcacggtgctggaccagcacctgaggcccccagcccgccgacccggaaccacaacgccggcccgtgttgatctacagcagcaaattatgaccattatagatgaactgggcaaggcttctgccaaggcccagaatctttccgctcctatcactagtgcatcaaggatgcagagtaaccgccatgttgtttatattctcaaagacagttcagcccgaccggctggaaaaggagccattattggtttcatcaaagttggatacaagaagctctttgtactggatgatcgtgaggctcataatgaggtagaaccactttgcatcctggacttttacatccatgagtctgtgcaacgccatggccatgggcgagaactcttccagtatatgttgcagaaggagcgagtggaaccgcaccaactggcaattgaccgaccctcacagaagctgctgaaattcctgaataagcactacaatctggagaccacagtcccacaggtgaacaactttgtgatctttgaaggcttctttgcccatcaacatcggccccctgctccctctctgagggcaactcgacactctcgtgctgctgcagtcgatcccacgcccgctgctccagcaaggaagctgccacccaagagagcagagggagacatcaagccatactcctctagtgaccgagaatttctgaaggtagctgtggagcctccttggcccctaaacagggcccctcgccgcgccacacctccagcccacccacccccccgctccagcagcctgggaaactcaccagaacgaggtcccctccgcccctttgtgccagagcaggagctgctgcgttccttgcgcctctgccccccacaccctaccgcccgccttctgttggctgctgaccctgggggcagcccagctcaacgtcgtcgcaccagctcccttccccgctctgaggagagtcgatactaacagctaccctctccctgccctgggagacctggggtgggcagggaacccctccctgagaacctcagacccactcttccattgcatcctgtaggacccagtggaacctgacagagcccataggattccctcttctactttcttagacagcagggatgtcagggtctcaaactgcctaacactttgtagcttttcttaacacaaaagcaccccttctctcctaacttgggctctgaatactttcccaacaggaagtctgatctgttgccagacttcttggttagatggctcatacatttatctagagaagcacactcttgcttgctgtcaaactttagaacaccatggaaggtctaagggcatcctgtgccagggaaactttttaaggaattttatctatgggataaaccccatattccctctagtgtctactggtggctctaatactgctttgtgctgcctgccacacttgccctttgagcctgcgaatggccgctagtgagcaagctctgcttcagagcagtctagttaggtagaacagggacttaccagcttcccaaagggatctactcaccattgccaaactcttcatttccacattttgtgtaggtgtcagggaaccccaaactggtgttgctttggggtctctaaaggagattggctgacaccaccatttcccccagatccagattctctgagggaggttgtttcttgagagtagatccagagtgtcaaggatctgttagatcctggaatcccttcttgcatccatccctccctggtagctaggtcccgatatactcctgtcttgtgagattgtcgagatgagatgggggaccactcttcctctgtccttcctctctcctttcctccatagcaaggacgaccttccctgctccatgcccagagtatagctagatcccttcccctccctaccctctgaatgtgtgctagatcaggtgccccactgtgtttcctgaaatccttgggagccggatctccccatctcccctactcactcttcccttttcttctctcagtgttgtctgaataaagtgtgaaatcttttgtgttttctaaattgacattttcaatgaaaaaaagaatcacaaaaaaaaaa

SEQ ID NO: 106701 - DNA, 2611 bp, Homo sapiens
  Payload ID: 952
  Gene Symbol: ATAT1
  Gene Name: alpha tubulin acetyltransferase 1
  Uniprot ID: Q5SQI0
  ENST ID: ENST00000383584
  CDS Start-End: 45-947
gaagtgacgtcgtgtggggcgggtccgaccgcgcacaatgggccatggagttcccgttcgatgtggacgcgctgttcccggagcggatcacggtgctggaccagcacctgaggcccccagcccgccgacccggaaccacaacgccggcccgtgttgatctacagcagcaaattatgaccattatagatgaactgggcaaggcttctgccaaggcccagaatctttccgctcctatcactagtgcatcaaggatgcagagtaaccgccatgttgtttatattctcaaagacagttcagcccgaccggctggaaaaggagccattattggtttcatcaaagttggatacaagaagctctttgtactggatgatcgtgaggctcataatgaggtagaaccactttgcatcctggacttttacatccatgagtctgtgcaacgccatggccatgggcgagaactcttccagtatatgttgcagaaggagcgagtggaaccgcaccaactggcaattgaccgaccctcacagaagctgctgaaattcctgaataagcactacaatctggagaccacagtcccacaggtgaacaactttgtgatctttgaaggcttctttgcccatcaacatcctccagcaaggaagctgccacccaagagagcagagggagacatcaagccatactcctctagtgaccgagaatttctgaaggtagctgtggagcctccttggcccctaaacagggcccctcgccgcgccacacctccagcccacccacccccccgctccagcagcctgggaaactcaccagaacgaggtcccctccgcccctttgtgccagagcaggagctgctgcgttccttgcgcctctgccccccacaccctaccgcccgccttctgttggctgctgaccctgggggcagcccagctcaacgtcgtcgcaccaggtaataggagttgaagggctaaggagcctcacagctataaaagaggatgttagaaatggcaaagggcaatttgaatccatcagagagatggatcaataagatgggtggcttggggggggtcctgaaacctttcaagaaaaatatttgtgcaagtgatctgggaaaaaaatgcagtgaaggagcagaataggaccttatatggagcctagggaccctggctttaatgtgagagttatgtggaatggtaggaagaacaccgagatccatcgagttgggggaacagagccttctaagattgggaaaatcttcgcttaatacttgctggggaaggggcagtgtctgacagagagtgggaagccactggcttgtgtgccaagagtccatcgcagcaggcagggagtgggcatttcctttatttctctccctttctcttcacctctgacttctctgtttttctctcccccgccccccgccatttcccatctcccttcctcccatccataacatccttccacagctcccttccccgctctgaggagagtcgatactaacagctaccctctccctgccctgggagacctggggtgggcagggaacccctccctgagaacctcagacccactcttccattgcatcctgtaggacccagtggaacctgacagagcccataggattccctcttctactttcttagacagcagggatgtcagggtctcaaactgcctaacactttgtagcttttcttaacacaaaagcaccccttctctcctaacttgggctctgaatactttcccaacaggaagtctgatctgttgccagacttcttggttagatggctcatacatttatctagagaagcacactcttgcttgctgtcaaactttagaacaccatggaaggtctaagggcatcctgtgccagggaaactttttaaggaattttatctatgggataaaccccatattccctctagtgtctactggtggctctaatactgctttgtgctgcctgccacacttgccctttgagcctgcgaatggccgctagtgagcaagctctgcttcagagcagtctagttaggtagaacagggacttaccagcttcccaaagggatctactcaccattgccaaactcttcatttccacattttgtgtaggtgtcagggaaccccaaactggtgttgctttggggtctctaaaggagattggctgacaccaccatttcccccagatccagattctctgagggaggttgtttcttgagagtagatccagagtgtcaaggatctgttagatcctggaatcccttcttgcatccatccctccctggtagctaggtcccgatatactcctgtcttgtgagattgtcgagatgagatgggggaccactcttcctctgtccttcctctctcctttcctccatagcaaggacgaccttccctgctccatgcccagagtatagctagatcccttcccctccctaccctctgaatgtgtgctagatcaggtgccccactgtgtttcctgaaatccttgggagccggatctccccatctcccctactcactcttcccttttcttctctcagtgttgtctgaataaagtgtgaaatcttttgtgttttctaaattgacattttcaatgaaaaaaagaatcacaaaaaaaaaa

SEQ ID NO: 106702 - DNA, 1476 bp, Homo sapiens; identical to SEQ ID NO: 106698
  Payload ID: 952
  Gene Symbol: ATAT1
  Gene Name: alpha tubulin acetyltransferase 1
  Uniprot ID: Q5SQI0
  ENST ID: ENST00000383585
  CDS Start-End: 31-1296

SEQ ID NO: 106703 - DNA, 2646 bp, Homo sapiens
  Payload ID: 952
  Gene Symbol: ATAT1
  Gene Name: alpha tubulin acetyltransferase 1
  Uniprot ID: Q5SQI0
  ENST ID: ENST00000400575
  CDS Start-End: 11-982
acaatgggccatggagttcccgttcgatgtggacgcgctgttcccggagcggatcacggtgctggaccagcacctgaggcccccagcccgccgacccggaaccacaacgccggcccgtgttgatctacagcagcaaattatgaccattatagatgaactgggcaaggcttctgccaaggcccagaatctttccgctcctatcactagtgcatcaaggatgcagagtaaccgccatgttgtttatattctcaaagacagttcagcccgaccggctggaaaaggagccattattggtttcatcaaagttggatacaagaagctctttgtactggatgatcgtgaggctcataatgaggtagaaccactttgcatcctggacttttacatccatgagtctgtgcaacgccatggccatgggcgagaactcttccagtatatgttgcagaaggagcgagtggaaccgcaccaactggcaattgaccgaccctcacagaagctgctgaaattcctgaataagcactacaatctggagaccacagtcccacaggtgaacaactttgtgatctttgaaggcttctttgcccatcaacatcggccccctgctccctctctgagggcaactcgacactctcgtgctgctgcagtcgatcccacgcccgctgctccagcaaggaagctgccacccaagagagcagagggagacatcaagccatactcctctagtgaccgagaatttctgaaggtagctgtggagcctccttggcccctaaacagggcccctcgccgcgccacacctccagcccacccacccccccgctccagcagcctgggaaactcaccagaacgaggtcccctccgcccctttgtgccagagcaggagctgctgcgttccttgcgcctctgccccccacaccctaccgcccgccttctgttggctgctgaccctgggggcagcccagctcaacgtcgtcgcaccaggtaataggagttgaagggctaaggagcctcacagctataaaagaggatgttagaaatggcaaagggcaatttgaatccatcagagagatggatcaataagatgggtggcttggggggggtcctgaaacctttcaagaaaaatatttgtgcaagtgatctgggaaaaaaatgcagtgaaggagcagaataggaccttatatggagcctagggaccctggctttaatgtgagagttatgtggaatggtaggaagaacaccgagatccatcgagttgggggaacagagccttctaagattgggaaaatcttcgcttaatacttgctggggaaggggcagtgtctgacagagagtgggaagccactggcttgtgtgccaagagtccatcgcagcaggcagggagtgggcatttcctttatttctctccctttctcttcacctctgacttctctgtttttctctcccccgccccccgccatttcccatctcccttcctcccatccataacatccttccacagctcccttccccgctctgaggagagtcgatactaacagctaccctctccctgccctgggagacctggggtgggcagggaacccctccctgagaacctcagacccactcttccattgcatcctgtaggacccagtggaacctgacagagcccataggattccctcttctactttcttagacagcagggatgtcagggtctcaaactgcctaacactttgtagcttttcttaacacaaaagcaccccttctctcctaacttgggctctgaatactttcccaacaggaagtctgatctgttgccagacttcttggttagatggctcatacatttatctagagaagcacactcttgcttgctgtcaaactttagaacaccatggaaggtctaagggcatcctgtgccagggaaactttttaaggaattttatctatgggataaaccccatattccctctagtgtctactggtggctctaatactgctttgtgctgcctgccacacttgccctttgagcctgcgaatggccgctagtgagcaagctctgcttcagagcagtctagttaggtagaacagggacttaccagcttcccaaagggatctactcaccattgccaaactcttcatttccacattttgtgtaggtgtcagggaaccccaaactggtgttgctttggggtctctaaaggagattggctgacaccaccatttcccccagatccagattctctgagggaggttgtttcttgagagtagatccagagtgtcaaggatctgttagatcctggaatcccttcttgcatccatccctccctggtagctaggtcccgatatactcctgtcttgtgagattgtcgagatgagatgggggaccactcttcctctgtccttcctctctcctttcctccatagcaaggacgaccttccctgctccatgcccagagtatagctagatcccttcccctccctaccctctgaatgtgtgctagatcaggtgccccactgtgtttcctgaaatccttgggagccggatctccccatctcccctactcactcttcccttttcttctctcagtgttgtctgaataaagtgtgaaatcttttgtgttttctaaattgacattttcaatgaaaaaaagaatcacaaaaaaaaaa

SEQ ID NO: 106704 - DNA, 2061 bp, Homo sapiens
  Payload ID: 952
  Gene Symbol: ATAT1
  Gene Name: alpha tubulin acetyltransferase 1
  Uniprot ID: Q5SQI0
  ENST ID: ENST00000400576
  CDS Start-End: 12-944
cacaatgggccatggagttcccgttcgatgtggacgcgctgttcccggagcggatcacggtgctggaccagcacctgaggcccccagcccgccgacccggaaccacaacgccggcccgtgttgatctacagcagcaaattatgaccattatagatgaactgggcaaggcttctgccaaggcccagaatctttccgctcctatcactagtgcatcaaggatgcagagtaaccgccatgttgtttatattctcaaagacagttcagcccgaccggctggaaaaggagccattattggtttcatcaaagttggatacaagaagctctttgtactggatgatcgtgaggctcataatgaggtagaaccactttgcatcctggacttttacatccatgagtctgtgcaacgccatggccatgggcgagaactcttccagtatatgttgcagaaggagcgagtggaaccgcaccaactggcaattgaccgaccctcacagaagctgctgaaattcctgaataagcactacaatctggagaccacagtcccacaggtgaacaactttgtgatctttgaaggcttctttgcccatcaacatcctccagcaaggaagctgccacccaagagagcagagggagacatcaagccatactcctctagtgaccgagaatttctgaaggtagctgtggagcctccttggcccctaaacagggcccctcgccgcgccacacctccagcccacccacccccccgctccagcagcctgggaaactcaccagaacgaggtcccctccgcccctttgtgccagagcaggagctgctgcgttccttgcgcctctgccccccacaccctaccgcccgccttctgttggctgctgaccctgggggcagcccagctcaacgtcgtcgcaccagctcccttccccgctctgaggagagtcgatactaacagctaccctctccctgccctgggagacctggggtgggcagggaacccctccctgagaacctcagacccactcttccattgcatcctgtaggacccagtggaacctgacagagcccataggattccctcttctactttcttagacagcagggatgtcagggtctcaaactgcctaacactttgtagcttttcttaacacaaaagcaccccttctctcctaacttgggctctgaatactttcccaacaggaagtctgatctgttgccagacttcttggttagatggctcatacatttatctagagaagcacactcttgcttgctgtcaaactttagaacaccatggaaggtctaagggcatcctgtgccagggaaactttttaaggaattttatctatgggataaaccccatattccctctagtgtctactggtggctctaatactgctttgtgctgcctgccacacttgccctttgagcctgcgaatggccgctagtgagcaagctctgcttcagagcagtctagttaggtagaacagggacttaccagcttcccaaagggatctactcaccattgccaaactcttcatttccacattttgtgtaggtgtcagggaaccccaaactggtgttgctttggggtctctaaaggagattggctgacaccaccatttcccccagatccagattctctgagggaggttgtttcttgagagtagatccagagtgtcaaggatctgttagatcctggaatcccttcttgcatccatccctccctggtagctaggtcccgatatactcctgtcttgtgagattgtcgagatgagatgggggaccactcttcctctgtccttcctctctcctttcctccatagcaaggacgaccttccctgctccatgcccagagtatagctagatcccttcccctccctaccctctgaatgtgtgctagatcaggtgccccactgtgtttcctgaaatccttgggagccggatctccccatctcccctactcactcttcccttttcttctctcagtgttgtctgaataaagtgtgaaatcttttgtgttttctaaattgacattttcaatgaaaaaaagaatcacaaaaaaaaaa

SEQ ID NO: 106705 - DNA, 2646 bp, Homo sapiens
  Payload ID: 952
  Gene Symbol: ATAT1
  Gene Name: alpha tubulin acetyltransferase 1
  Uniprot ID: Q5SQI0
  ENST ID: ENST00000457161
  CDS Start-End: 11-982
acaatgggccatggagttcccgttcgatgtggacgcgctgttcccggagcggatcacggtgctggaccagcacctgaggcccccagcccgccgacccggaaccacaacgccggcccgtgttgatctacagcagcaaattatgaccattatagatgaactgggcaaggcttctgccaaggcccagaatctttccgctcctatcactagtgcatcaaggatgcagagtaaccgccatgttgtttatattctcaaagacagttcagcccgaccggctggaaaaggagccattattggtttcatcaaagttggatacaagaagctctttgtactggatgatcgtgaggctcataatgaggtagaaccactttgcatcctggacttttacatccatgagtctgtgcaacgccatggccatgggcgagaactcttccagtatatgttgcagaaggagcgagtggaaccgcaccaactggcaattgaccgaccctcacagaagctgctgaaattcctgaataagcactacaatctggagaccacagtcccacaggtgaacaactttgtgatctttgaaggcttctttgcccatcaacatcggccccctgctccctctctgagggcaactcgacactctcgtgctgctgcagtcgatcccacgcccgctgctccagcaaggaagctgccacccaagagagcagagggagacatcaagccatactcctctagtgaccgagaatttctgaaggtagctgtggagcctccttggcccctaaacagggcccctcgccgcgccacacctccagcccacccacccccccgctccagcagcctgggaaactcaccagaacgaggtcccctccgcccctttgtgccagagcaggagctgctgcgttccttgcgcctctgccccccacaccctaccgcccgccttctgttggctgctgaccctgggggcagcccagctcaacgtcgtcgcaccaggtaataggagttgaagggctaaggagcctcacagctataaaagaggatgttagaaatggcaaagggcaatttgaatccatcagagagatggatcaataagatgggtggcttggggggggtcctgaaacctttcaagaaaaatatttgtgcaagtgatctgggaaaaaaatgcagtgaaggagcagaataggaccttatatggagcctagggaccctggctttaatgtgagagttatgtggaatggtaggaagaacaccgagatccatcgagttgggggaacagagccttctaagattgggaaaatcttcgcttaatacttgctggggaaggggcagtgtctgacagagagtgggaagccactggcttgtgtgccaagagtccatcgcagcaggcagggagtgggcatttcctttatttctctccctttctcttcacctctgacttctctgtttttctctcccccgccccccgccatttcccatctcccttcctcccatccataacatccttccacagctcccttccccgctctgaggagagtcgatactaacagctaccctatccctgccctgggagacctggggtgggcagggaacccctccctgagaacctcagacccactcttccattgcatcctgtaggacccagtggaacctgacagagcccataggattccctcttctactttcttagacagcagggatgtcagggtctcaaactgcctaacactttgtagcttttcttaacacaaaagcaccccttctctcctaacttgggctctgaatactttcccaacaggaagtctgatctgttgccagacttcttggttagatggctcatacatttatctagagaagcacactcttgcttgctgtcaaactttagaacaccatggaaggtctaagggcatcctgtgccagggaaactttttaaggaattttatctatgggataaaccccatattccctctagtgtctactggtggctctaatactgctttgtgctgcctgccacacttgccctttgagcctgcgaatggccgctagtgagcaagctctgcttcagagcagtctagttaggtagaacagggacttaccagcttcccaaagggatctactcaccattgccaaactcttcatttccacattttgtgtaggtgtcagggaaccccaaactggtgttgctttggggtctctaaaggagattggctgacaccaccatttcccccagatccagattctctgagggaggttgtttcttgagagtagatccagagtgtcaaggatctgttagatcctggaatcccttcttgcatccatccctccctggtagctaggtcccgatatactcctgtcttgtgagattgtcgagatgagatgggggaccactcttcctctgtccttcctctctcctttcctccatagcaaggacgaccttccctgctccatgcccagagtatagctagatcccttcccctccctaccctctgaatgtgtgctagatcaggtgccccactgtgtttcctgaaatccttgggagccggatctccccatctcccctactcactcttcccttttcttctctcagtgttgtctgaataaagtgtgaaatcttttgtgttttctaaattgacattttcaatgaaaaaaagaatcacaaaaaaaaaa

SEQ ID NO: 106706 - DNA, 2646 bp, Homo sapiens; identical to SEQ ID NO: 106703
  Payload ID: 952
  Gene Symbol: ATAT1
  Gene Name: alpha tubulin acetyltransferase 1
  Uniprot ID: Q5SQI0
  ENST ID: ENST00000411724
  CDS Start-End: 11-982

SEQ ID NO: 106707 - DNA, 1728 bp, Homo sapiens; identical to SEQ ID NO: 106695
  Payload ID: 952
  Gene Symbol: ATAT1
  Gene Name: alpha tubulin acetyltransferase 1
  Uniprot ID: Q5SQI0
  ENST ID: ENST00000448670
  CDS Start-End: 319-1548

SEQ ID NO: 106708 - DNA, 1728 bp, Homo sapiens; identical to SEQ ID NO: 106695
  Payload ID: 952
  Gene Symbol: ATAT1
  Gene Name: alpha tubulin acetyltransferase 1
  Uniprot ID: Q5SQI0
  ENST ID: ENST00000425448
  CDS Start-End: 319-1548

SEQ ID NO: 106709 - DNA, 2646 bp, Homo sapiens; identical to SEQ ID NO: 106703
  Payload ID: 952
  Gene Symbol: ATAT1
  Gene Name: alpha tubulin acetyltransferase 1
  Uniprot ID: Q5SQI0
  ENST ID: ENST00000446100
  CDS Start-End: 11-982

SEQ ID NO: 106710 - DNA, 2611 bp, Homo sapiens; identical to SEQ ID NO: 106693
  Payload ID: 952
  Gene Symbol: ATAT1
  Gene Name: alpha tubulin acetyltransferase 1
  Uniprot ID: Q5SQI0
  ENST ID: ENST00000417183
  CDS Start-End: 45-947

SEQ ID NO: 106711 - DNA, 2119 bp, Homo sapiens; identical to SEQ ID NO: 106700
  Payload ID: 952
  Gene Symbol: ATAT1
  Gene Name: alpha tubulin acetyltransferase 1
  Uniprot ID: Q5SQI0
  ENST ID: ENST00000456704
  CDS Start-End: 1-1002

SEQ ID NO: 106712 - DNA, 1476 bp, Homo sapiens; identical to SEQ ID NO: 106698
  Payload ID: 952
  Gene Symbol: ATAT1
  Gene Name: alpha tubulin acetyltransferase 1
  Uniprot ID: Q5SQI0
  ENST ID: ENST00000442844
  CDS Start-End: 31-1296

SEQ ID NO: 106713 - DNA, 1728 bp, Homo sapiens; identical to SEQ ID NO: 106695
  Payload ID: 952
  Gene Symbol: ATAT1
  Gene Name: alpha tubulin acetyltransferase 1
  Uniprot ID: Q5SQI0
  ENST ID: ENST00000457334
  CDS Start-End: 319-1548

SEQ ID NO: 106714 - DNA, 1476 bp, Homo sapiens; identical to SEQ ID NO: 106698
  Payload ID: 952
  Gene Symbol: ATAT1
  Gene Name: alpha tubulin acetyltransferase 1
  Uniprot ID: Q5SQI0
  ENST ID: ENST00000445486
  CDS Start-End: 31-1296

SEQ ID NO: 106715 - DNA, 2119 bp, Homo sapiens; identical to SEQ ID NO: 106700
  Payload ID: 952
  Gene Symbol: ATAT1
  Gene Name: alpha tubulin acetyltransferase 1
  Uniprot ID: Q5SQI0
  ENST ID: ENST00000456215
  CDS Start-End: 1-1002

SEQ ID NO: 106716 - DNA, 2119 bp, Homo sapiens; identical to SEQ ID NO: 106696
  Payload ID: 952
  Gene Symbol: ATAT1
  Gene Name: alpha tubulin acetyltransferase 1
  Uniprot ID: Q5SQI0
  ENST ID: ENST00000428764
  CDS Start-End: 1-1002

SEQ ID NO: 106717 - DNA, 2611 bp, Homo sapiens; identical to SEQ ID NO: 106693
  Payload ID: 952
  Gene Symbol: ATAT1
  Gene Name: alpha tubulin acetyltransferase 1
  Uniprot ID: Q5SQI0
  ENST ID: ENST00000449905
  CDS Start-End: 45-947

SEQ ID NO: 106718 - DNA, 2611 bp, Homo sapiens; identical to SEQ ID NO: 106701
  Payload ID: 952
  Gene Symbol: ATAT1
  Gene Name: alpha tubulin acetyltransferase 1
  Uniprot ID: Q5SQI0
  ENST ID: ENST00000416917
  CDS Start-End: 45-947

SEQ ID NO: 106719 - DNA, 2646 bp, Homo sapiens; identical to SEQ ID NO: 106697
  Payload ID: 952
  Gene Symbol: ATAT1
  Gene Name: alpha tubulin acetyltransferase 1
  Uniprot ID: Q5SQI0
  ENST ID: ENST00000423654
  CDS Start-End: 11-982

SEQ ID NO: 106720 - DNA, 2119 bp, Homo sapiens; identical to SEQ ID NO: 106696
  Payload ID: 952
  Gene Symbol: ATAT1
  Gene Name: alpha tubulin acetyltransferase 1
  Uniprot ID: Q5SQI0
  ENST ID: ENST00000450220
  CDS Start-End: 1-1002

SEQ ID NO: 106721 - DNA, 2611 bp, Homo sapiens; identical to SEQ ID NO: 106701
  Payload ID: 952
  Gene Symbol: ATAT1
  Gene Name: alpha tubulin acetyltransferase 1
  Uniprot ID: Q5SQI0
  ENST ID: ENST00000443114
  CDS Start-End: 45-947

SEQ ID NO: 106722 - DNA, 2061 bp, Homo sapiens; identical to SEQ ID NO: 106704
  Payload ID: 952
  Gene Symbol: ATAT1
  Gene Name: alpha tubulin acetyltransferase 1
  Uniprot ID: Q5SQI0
  ENST ID: ENST00000443391
  CDS Start-End: 12-944

SEQ ID NO: 106723 - DNA, 2119 bp, Homo sapiens
  Payload ID: 952
  Gene Symbol: ATAT1
  Gene Name: alpha tubulin acetyltransferase 1
  Uniprot ID: Q5SQI0
  ENST ID: ENST00000450003
  CDS Start-End: 1-1002
atggagttcccgttcgatgtggacgcgctgttcccggagcggatcacggtgctggaccagcacctgaggcccccagcccgccgacccggaaccacaacgccggcccgtgttgatctacagcagcaaattatgaccattatagatgaactgggcaaggcttctgccaaggcccagaatctttccgctcctatcactagtgcatcaaggatgcagagtaaccgccatgttgtttatattctcaaagacagttcagcccgaccggctggaaaaggagccattattggtttcatcaaagttggatacaagaagctctttgtactggatgatcgtgaggctcataatgaggtagaaccactttgcatcctggacttttacatccatgagtctgtgcaacgccatggccatgggcgagaactcttccagtatatgttgcagaaggagcgagtggaaccgcaccaactggcaattgaccgaccctcacagaagctgctgaaattcctgaataagcactacaatctggagaccacagtcccacaggtgaacaactttgtgatctttgaaggcttctttgcccatcaacatcggccccctgctccctctctgagggcaactcgacactctcgtgctgctgcagtcgatcccacgcccgctgctccagcaaggaagctgccacccaagagagcagagggagacatcaagccatactcctctagtgaccgagaatttctgaaggtagctgtggagcctccttggcccctaaacagggcccctcgccgcgccacacctccagcccacccacccccccgctccagcagcctgggaaactcaccagaacgaggtcccctccgcccctttgtgccagagcaggagctgctgcgttccttgcgcctctgccccccacaccctaccgcccgccttctgttggctgctgaccctgggggcagcccagctcaacgtcgtcgcaccagctcccttccccgctctgaggagagtcgatactaacagctaccctatccctgccctgggagacctggggtgggcagggaacccctccctgagaacctcagacccactcttccattgcatcctgtaggacccagtggaacctgacagagcccataggattccctcttctactttcttagacagcagggatgtcagggtctcaaactgcctaacactttgtagcttttcttaacacaaaagcaccccttctctcctaacttgggctctgaatactttcccaacaggaagtctgatctgttgccagacttcttggttagatggctcatacatttatctagagaagcacactcttgcttgctgtcaaactttagaacaccatggaaggtctaagggcatcctgtgccagggaaactttttaaggaattttatctatgggataaaccccatattccctctagtgtctactggtggctctaatactgctttgtgctgcctgccacacttgccctttgagcctgcgaatggccgctagtgagcaagctctgcttcagagcagtctagttaggtagaacagggacttaccagcttcccaaagggatctactcaccattgccaaactcttcatttccacattttgtgtaggtgtcagggaaccccaaactggtgttgctttggggtctctaaaggagattggctgacaccaccatttcccccagatccagattctctgagggaggttgtttcttgagagtagatccagagtgtcaaggatctgttagatcctggaatcccttcttgcatccatccctccctggtagctaggtcccgatatactcctgtcttgtgagattgtcgagatgagatgggggaccactcttcctctgtccttcctctctcctttcctccatagcaaggacgaccttccctgctccatgcccagagtatagctagatcccttcccctccctaccctctgaatgtgtgctagatcaggtgccccactgtgtttcctgaaatccttgggagccggatctccccatctcccctactcactcttcccttttcttctctcagtgttgtctgaataaagtgtgaaatcttttgtgttttctaaattgacattttcaatgaaaaaaagaatcacaaaaaaaaaa

SEQ ID NO: 106724 - DNA, 1476 bp, Homo sapiens; identical to SEQ ID NO: 106698
  Payload ID: 952
  Gene Symbol: ATAT1
  Gene Name: alpha tubulin acetyltransferase 1
  Uniprot ID: Q5SQI0
  ENST ID: ENST00000454794
  CDS Start-End: 31-1296

SEQ ID NO: 106725 - DNA, 2061 bp, Homo sapiens; identical to SEQ ID NO: 106694
  Payload ID: 952
  Gene Symbol: ATAT1
  Gene Name: alpha tubulin acetyltransferase 1
  Uniprot ID: Q5SQI0
  ENST ID: ENST00000430611
  CDS Start-End: 12-944

SEQ ID NO: 106726 - DNA, 2061 bp, Homo sapiens; identical to SEQ ID NO: 106704
  Payload ID: 952
  Gene Symbol: ATAT1
  Gene Name: alpha tubulin acetyltransferase 1
  Uniprot ID: Q5SQI0
  ENST ID: ENST00000454987
  CDS Start-End: 12-944

SEQ ID NO: 106727 - DNA, 1476 bp, Homo sapiens; identical to SEQ ID NO: 106698
  Payload ID: 952
  Gene Symbol: ATAT1
  Gene Name: alpha tubulin acetyltransferase 1
  Uniprot ID: Q5SQI0
  ENST ID: ENST00000420586
  CDS Start-End: 31-1296

SEQ ID NO: 106728 - DNA, 2646 bp, Homo sapiens; identical to SEQ ID NO: 106697
  Payload ID: 952
  Gene Symbol: ATAT1
  Gene Name: alpha tubulin acetyltransferase 1
  Uniprot ID: Q5SQI0
  ENST ID: ENST00000418248
  CDS Start-End: 11-982

SEQ ID NO: 106729 - DNA, 2061 bp, Homo sapiens
  Payload ID: 952
  Gene Symbol: ATAT1
  Gene Name: alpha tubulin acetyltransferase 1
  Uniprot ID: Q5SQI0
  ENST ID: ENST00000424121
  CDS Start-End: 12-944
cacaatgggccatggagttcccgttcgatgtggacgcgctgttcccggagcggatcacggtgctggaccagcacctgaggcccccagcccgccgacccggaaccacaacgccggcccgtgttgatctacagcagcaaattatgaccattatagatgaactgggcaaggcttctgccaaggcccagaatctttccgctcctatcactagtgcatcaaggatgcagagtaaccgccatgttgtttatattctcaaagacagttcagcccgaccggctggaaaaggagccattattggtttcatcaaagttggatacaagaagctctttgtactggatgatcgtgaggctcataatgaggtagaaccactttgcatcctggacttttacatccatgagtctgtgcaacgccatggccatgggcgagaactcttccagtatatgttgcagaaggagcgagtggaaccgcaccaactggcaattgaccgaccctcacagaagctgctgaaattcctgaataagcactacaatctggagaccacagtcccacaggtgaacaactttgtgatctttgaaggcttctttgcccatcaacatcctccagcaaggaagctgccacccaagagagcagagggagacatcaagccatactcctctagtgaccgagaatttctgaaggtagctgtggagcctccttggcccctaaacagggcccctcgccgcgccacacctccagcccacccacccccccgctccagcagcctgggaaactcaccagaacgaggtcccctccgcccctttgtgccagagcaggagctgctgcgttccttgcgcctctgccccccacaccctaccgcccgccttctgttggctgctgaccctgggggcagcccagctcaacgtcgtcgcaccagctcccttccccgctctgaggagagtcgatactaacagctaccctatccctgccctgggagacctggggtgggcagggaacccctccctgagaacctcagacccactcttccattgcatcctgtaggacccagtggaacctgacagagcccataggattccctcttctactttcttagacagcagggatgtcagggtctcaaactgcctaacactttgtagcttttcttaacacaaaagcaccccttctctcctaacttgggctctgaatactttcccaacaggaagtctgatctgttgccagacttcttggttagatggctcatacatttatctagagaagcacactcttgcttgctgtcaaactttagaacaccatggaaggtctaagggcatcctgtgccagggaaactttttaaggaattttatctatgggataaaccccatattccctctagtgtctactggtggctctaatactgctttgtgctgcctgccacacttgccctttgagcctgcgaatggccgctagtgagcaagctctgcttcagagcagtctagttaggtagaacagggacttaccagcttcccaaagggatctactcaccattgccaaactcttcatttccacattttgtgtaggtgtcagggaaccccaaactggtgttgctttggggtctctaaaggagattggctgacaccaccatttcccccagatccagattctctgagggaggttgtttcttgagagtagatccagagtgtcaaggatctgttagatcctggaatcccttcttgcatccatccctccctggtagctaggtcccgatatactcctgtcttgtgagattgtcgagatgagatgggggaccactcttcctctgtccttcctctctcctttcctccatagcaaggacgaccttccctgctccatgcccagagtatagctagatcccttcccctccctaccctctgaatgtgtgctagatcaggtgccccactgtgtttcctgaaatccttgggagccggatctccccatctcccctactcactcttcccttttcttctctcagtgttgtctgaataaagtgtgaaatcttttgtgttttctaaattgacattttcaatgaaaaaaagaatcacaaaaaaaaaa

SEQ ID NO: 106730 - DNA, 1728 bp, Homo sapiens; identical to SEQ ID NO: 106695
  Payload ID: 952
  Gene Symbol: ATAT1
  Gene Name: alpha tubulin acetyltransferase 1
  Uniprot ID: Q5SQI0
  ENST ID: ENST00000416435
  CDS Start-End: 319-1548

SEQ ID NO: 106731 - DNA, 2611 bp, Homo sapiens
  Payload ID: 952
  Gene Symbol: ATAT1
  Gene Name: alpha tubulin acetyltransferase 1
  Uniprot ID: Q5SQI0
  ENST ID: ENST00000423338
  CDS Start-End: 45-947
gaagtgacgtcgtgtggggcgggtccgaccgcgcacaatgggccatggagttcccgttcgatgtggacgcgctgttcccggagcggatcacggtgctggaccagcacctgaggcccccagcccgccgacccggaaccacaacgccggcccgtgttgatctacagcagcaaattatgaccattatagatgaactgggcaaggcttctgccaaggcccagaatctttccgctcctatcactagtgcatcaaggatgcagagtaaccgccatgttgtttatattctcaaagacagttcagcccgaccggctggaaaaggagccattattggtttcatcaaagttggatacaagaagctctttgtactggatgatcgtgaggctcataatgaggtagaaccactttgcatcctggacttttacatccatgagtctgtgcaacgccatggccatgggcgagaactcttccagtatatgttgcagaaggagcgagtggaaccgcaccaactggcaattgaccgaccctcacagaagctgctgaaattcctgaataagcactacaatctggagaccacagtcccacaggtgaacaactttgtgatctttgaaggcttctttgcccatcaacatcctccagcaaggaagctgccacccaagagagcagagggagacatcaagccatactcctctagtgaccgagaatttctgaaggtagctgtggagcctccttggcccctaaacagggcccctcgccgcgccacacctccagcccacccacccccccgctccagcagcctgggaaactcaccagaacgaggtcccctccgcccctttgtgccagagcaggagctgctgcgttccttgcgcctctgccccccacaccctaccgcccgccttctgttggctgctgaccctgggggcagcccagctcaacgtcgtcgcaccaggtaataggagttgaagggctaaggagcctcacagctataaaagaggatgttagaaatggcaaagggcaatttgaatccatcagagagatggatcaataagatgggtggcttggggggggtcctgaaacctttcaagaaaaatatttgtgcaagtgatctgggaaaaaaatgcagtgaaggagcagaataggaccttatatggagcctagggaccctggctttaatgtgagagttatgtggaatggtaggaagaacaccgagatccatcgagttgggggaacagagccttctaagattgggaaaatcttcgcttaatacttgctggggaaggggcagtgtctgacagagagtgggaagccactggcttgtgtgccaagagtccatcgcagcaggcagggagtgggcatttcctttatttctctccctttctcttcacctctgacttctctgtttttctctcccccgccccccgccatttcccatctcccttcctcccatccataacatccttccacagctcccttccccgctctgaggagagtcgatactaacagctaccctatccctgccctgggagacctggggtgggcagggaacccctccctgagaacctcagacccactcttccattgcatcctgtaggacccagtggaacctgacagagcccataggattccctcttctactttcttagacagcagggatgtcagggtctcaaactgcctaacactttgtagcttttcttaacacaaaagcaccccttctctcctaacttgggctctgaatactttcccaacaggaagtctgatctgttgccagacttcttggttagatggctcatacatttatctagagaagcacactcttgcttgctgtcaaactttagaacaccatggaaggtctaagggcatcctgtgccagggaaactttttaaggaattttatctatgggataaaccccatattccctctagtgtctactggtggctctaatactgctttgtgctgcctgccacacttgccctttgagcctgcgaatggccgctagtgagcaagctctgcttcagagcagtctagttaggtagaacagggacttaccagcttcccaaagggatctactcaccattgccaaactcttcatttccacattttgtgtaggtgtcagggaaccccaaactggtgttgctttggggtctctaaaggagattggctgacaccaccatttcccccagatccagattctctgagggaggttgtttcttgagagtagatccagagtgtcaaggatctgttagatcctggaatcccttcttgcatccatccctccctggtagctaggtcccgatatactcctgtcttgtgagattgtcgagatgagatgggggaccactcttcctctgtccttcctctctcctttcctccatagcaaggacgaccttccctgctccatgcccagagtatagctagatcccttcccctccctaccctctgaatgtgtgctagatcaggtgccccactgtgtttcctgaaatccttgggagccggatctccccatctcccctactcactcttcccttttcttctctcagtgttgtctgaataaagtgtgaaatcttttgtgttttctaaattgacattttcaatgaaaaaaagaatcacaaaaaaaaaa

SEQ ID NO: 106732 - DNA, 2061 bp, Homo sapiens; identical to SEQ ID NO: 106694
  Payload ID: 952
  Gene Symbol: ATAT1
  Gene Name: alpha tubulin acetyltransferase 1
  Uniprot ID: Q5SQI0
  ENST ID: ENST00000445973
  CDS Start-End: 12-944

SEQ ID NO: 106733 - DNA, 1728 bp, Homo sapiens; identical to SEQ ID NO: 106695
  Payload ID: 952
  Gene Symbol: ATAT1
  Gene Name: alpha tubulin acetyltransferase 1
  Uniprot ID: Q5SQI0
  ENST ID: ENST00000432643
  CDS Start-End: 319-1548

SEQ ID NO: 106734 - DNA, 1476 bp, Homo sapiens; identical to SEQ ID NO: 106698
  Payload ID: 952
  Gene Symbol: ATAT1
  Gene Name: alpha tubulin acetyltransferase 1
  Uniprot ID: Q5SQI0
  ENST ID: ENST00000432356
  CDS Start-End: 31-1296

SEQ ID NO: 106735 - DNA, 1771 bp, Homo sapiens
  Payload ID: 953
  Gene Symbol: A4GNT
  Gene Name: alpha-1,4-N-acetylglucosaminyltransferase
  Uniprot ID: Q9UNA3
  ENST ID: ENST00000236709
  CDS Start-End: 203-1225
atttctaagacctcaaatactggttaactgcatttgcagctagaagttaggctctgattcactgttttgtattttctaaaagggttatatgtaatttgaaagatagacctgccaagacgtgagatctgtgttctccttggttagagctaacatttttggtgaggaaagcactgcaggagcaggctggcacagagaagaggacatgcggaaggagctccagctctccctgtcagtcaccttgctgcttgtctgtggcttcctctaccagttcaccctgaagtccagctgcctcttctgtttgccttctttcaagtcccaccaggggctggaagccctcctgagccacagacgtggcattgtgtttctagagacctcagagagaatggagccaccccatttggtctcctgttccgtagagtctgctgccaagatttatcctgagtggcctgtggtgttctttatgaagggtcttactgattccacaccgatgccctcaaactccacatacccagctttttccttcctgtcagcaatagacaacgttttcctcttccctttggatatgaaaaggctgcttgaagacacaccattgttttcatggtacaatcaaatcaacgccagcgcagagagaaactggctccacatcagctcggatgcatcccgcctggccatcatctggaaatacggtggcatctacatggacaccgatgtcatctccatcaggcccatccctgaggagaactttttggctgcgcaggcttctcggtactctagtaatggaatatttgggttcctcccccaccacccctttttgtgggaatgcatggaaaactttgttgaacactataattcagccatttggggcaaccaaggccctgagttgatgacaaggatgttgagggtatggtgtaaacttgaagacttccaggaggtgagcgacctcaggtgtctgaacatatccttcttacacccccaaagattttaccccatctcctatcgagagtggaggcgctactatgaagtgtgggatacagagccaagcttcaatgtctcttatgccctgcatttgtggaaccacatgaaccaggaggggcgggctgtgattagaggaagcaacacactggtggaaaatctctatcgcaagcactgtcccaggacttacagggacctgattaaaggcccagaggggtcagtgactggggagctgggtccaggtaacaaataaagctaacactcgtttgctgctgctgcagtgtggaaatggacatttcctggagtgccacattttcacttgatctccactgtctcttggcggggtgggcagagggttgcctctcaaatgtcagttaggattagctttctctgtctgtaatagaaaaatcccaaatgatactggctataaaacatacacccatggtccatttgactgcttgacctccaacccaccatgtttgcatttcaggcagtaggatgaagaaaagaggaaaggtgcacttgctttattttgtgaagacttcctgcaagtaccgtataacactttctcttacattgcactgactgagatgtagctgcaagagaggctgggaagtttaaggaggaagaaaaaatgggtactgggataggcagctaacagttttgctacatgttctatttaatacagtaagattaattccaggacctgttagagcattgactgaggtaaaaagagacttgatttctagtcctgattttgacattcattaatgcattcagtcaataaatattaactgag

SEQ ID NO: 106736 - DNA, 1722 bp, Homo sapiens
  Payload ID: 954
  Gene Symbol: A1BG
  Gene Name: alpha-1-B glycoprotein
  Uniprot ID: P04217
  ENST ID: ENST00000263100
  CDS Start-End: 63-1550
gggcctcattgctgcagacgctcaccccagacactcactgcaccggagtgagcgcgaccatcatgtccatgctcgtggtctttctcttgctgtggggtgtcacctggggcccagtgacagaagcagccatattttatgagacgcagcccagcctgtgggcagagtccgaatcactgctgaaacccttggccaatgtgacgctgacgtgccaggcccacctggagactccagacttccagctgttcaagaatggggtggcccaggagcctgtgcaccttgactcacctgccatcaagcaccagttcctgctgacgggtgacacccagggccgctaccgctgccgctcgggcttgtccacaggatggacccagctgagcaagctcctggagctgacagggccaaagtccttgcctgctccctggctctcgatggcgccagtgtcctggatcacccccggcctgaaaacaacagcagtgtgccgaggtgtgctgcggggtgtgacttttctgctgaggcgggagggcgaccatgagtttctggaggtgcctgaggcccaggaggatgtggaggccacctttccagtccatcagcctggcaactacagctgcagctaccggaccgatggggaaggcgccctctctgagcccagcgctactgtgaccattgaggagctcgctgcaccaccaccgcctgtgctgatgcaccatggagagtcctcccaggtcctgcaccctggcaacaaggtgaccctcacctgcgtggctcccctgagtggagtggacttccagctacggcgcggggagaaagagctgctggtacccaggagcagcaccagcccagatcgcatcttctttcacctgaacgcggtggccctgggggatggaggtcactacacctgccgctaccggctgcatgacaaccaaaacggctggtccggggacagcgcgccggtcgagctgattctgagcgatgagacgctgcccgcgccggagttctccccggagccggagtccggcagggccttgcggctgcggtgcctggcgcccctggagggcgcgcgcttcgccctggtgcgcgaggacaggggcgggcgccgcgtgcaccgtttccagagccccgctgggaccgaggcgctcttcgagctgcacaacatttccgtggctgactccgccaactacagctgcgtctacgtggacctgaagccgcctttcgggggctccgcgcccagcgagcgcttggagctgcacgtggacggaccccctcccaggcctcagctccgggcgacgtggagtggggcggtcctggcgggccgagatgccgtcctgcgctgcgagggacccatccccgacgtcaccttcgagctgctgcgcgagggcgagacgaaggccgtgaagacggtccgcacccccggggccgcggcgaacctcgagctgatcttcgtggggccccagcacgccggcaactacaggtgccgctaccgctcctgggtgccccacaccttcgaatcggagctcagcgaccctgtggagctcctggtggcagaaagctgatgcagccgcgggcccagggtgctgttggtgtcctcagaagtgccggggattctggactggctccctcccctcctgttgcagcacaaggccggggtctctggggggctggagaagcctccctcattcctcccaggaattaataaatgtgaagagaggctctgtttaaaatgtc

SEQ ID NO: 106737 - DNA, 917 bp, Homo sapiens
  Payload ID: 954
  Gene Symbol: A1BG
  Gene Name: alpha-1-B glycoprotein
  ENST ID: ENST00000600966
  CDS Start-End: 1-917
ctgacgtgccaggcccacctggagactccagacttccagctgttcaagaatggggtggcccaggagcctgtgcaccttgactcacctgccatcaagcaccagttcctgctgacgggtgacacccagggccgctaccgctgccgctcgggcttgtccacaggatggacccagctgagcaagctcctggagctgacagggccaaagtccttgcctgctccctggctctcgatggcgccagtgtcctggatcacccccggcctgaaaacaacagcagtgtgccgaggtgtgctgcggggtgtgacttttctgctgaggcgggagggcgaccatgagtttctggaggtgcctgaggcccaggaggatgtggaggccacctttccagtccatcagcctggcaactacagctgcagctaccggaccgatggggaaggcgccctctctgagcccagcgctactgtgaccattgaggagctcggaccaggtccaggaagctggccacacggttgcctgggtctgatggttgcaaaggagtttgggcagaggatgcccaaagaatggaaggctgcaccaccaccgcctgtgctgatgcaccatggagagtcctcccaggtcctgcaccctggcaacaaggtgaccctcacctgcgtggctcccctgagtggagtggacttccagctacggcgcggggagaaagagctgctggtacccaggagcagcaccagcccagatcgcatcttctttcacctgaacgcggtggccctgggggatggaggtcactacacctgccgctaccggctgcatgacaaccaaaacggctggtccggggacagcgcgccggtcgagctgattctgagcgatgagacgctgcccgcgccggagttctccccggagccggagtccggcagggccttgcggct

SEQ ID NO: 106738 - DNA, 1434 bp, Homo sapiens
  Payload ID: 955
  Gene Symbol: AMBP
  Gene Name: alpha-1-microglobulin/bikunin precursor
  Uniprot ID: P02760
  ENST ID: ENST00000265132
  CDS Start-End: 264-1322
attgtgcttggccaatgcctcttctgaagcagccatcccggcctcttggtactgctgaccccagccaggctacagggatcgattggagctgtccttggggctgtaattggccccagctgagcagggcaaacactgaggtcaactacaagccacaggccccttccccagcctcagttcacagctgccctgttgcagggaggcggtggcccttctgttgctagaccgagcctgtgggatataccaaggcagaggagcccatagccatgaggagcctcggggccctgctcttgctgctgagcgcctgcctggcggtgagcgctggccctgtgccaacgccgcccgacaacatccaagtgcaggaaaacttcaatatctctcggatctatgggaagtggtacaacctggccatcggttccacctgcccctggctgaagaagatcatggacaggatgacagtgagcacgctggtgctgggagagggcgctacagaggcggagatcagcatgaccagcactcgttggcggaaaggtgtctgtgaggagacgtctggagcttatgagaaaacagatactgatgggaagtttctctatcacaaatccaaatggaacataaccatggagtcctatgtggtccacaccaactatgatgagtatgccattttcctgaccaagaaattcagccgccatcatggacccaccattactgccaagctctacgggcgggcgccgcagctgagggaaactctcctgcaggacttcagagtggttgcccagggtgtgggcatccctgaggactccatcttcaccatggctgaccgaggtgaatgtgtccctggggagcaggaaccagagcccatcttaatcccgagagtccggagggctgtgctaccccaagaagaggaaggatcagggggtgggcaactggtaactgaagtcaccaagaaagaagattcctgccagctgggctactcggccggtccctgcatgggaatgaccagcaggtatttctataatggtacatccatggcctgtgagactttccagtacggcggctgcatgggcaacggtaacaacttcgtcacagaaaaggagtgtctgcagacctgccgaactgtggcggcctgcaatctccccatagtccggggcccctgccgagccttcatccagctctgggcatttgatgctgtcaaggggaagtgcgtcctcttcccctacgggggctgccagggcaacgggaacaagttctactcagagaaggagtgcagagagtactgcggtgtccctggtgatggtgatgaggagctgctgcgcttctccaactgacaactggccggtctgcaagtcagaggatggccagtgtctgtcccggggtcctgtggcaggcagcgccaagcaacctgggtccaaataaaaactaaattgtaaactcctgaaa

SEQ ID NO: 106739 - DNA, 1057 bp, Homo sapiens
  Payload ID: 955
  Gene Symbol: AMBP
  Gene Name: alpha-1-microglobulin/bikunin precursor
  ENST ID: ENST00000603230
  CDS Start-End: 120-836
acaagccacaggccccttccccagcctcagttcacagctgccctgttgcagggaggcggtggcccttctgttgctagaccgagcctgtgggatataccaaggcagaggagcccatagccatgaggagcctcggggccctgctcttgctgctgagcgcctgcctggcggtgagcgctggccctgtgccaacgccgcccgacaacatccaagtgcaggaaaacttcaatatctctcggatctatgggaagtggtacaacctggccatcggttccacctgcccctggctgaagaagatcatggacaggatgacagtgagcacgctggtgctgggagagggcgctacagaggcggagatcagcatgaccagcactcgttggcggaaaggtgtctgtgaggagacgtctggagcttatgagaaaacagatactgatgggaagtttctctatcacaaatccaaatggaacataaccatggagtcctatgtggtccacaccaactatgatgagtatgccattttcctgaccaagaaattcagccgccatcatggacccaccattactgccaagctctacgggcgggcgccgcagctgagggaaactctcctgcaggacttcagagtggttgcccagggtgtgggcatccctgaggactccatcttcaccatggctgaccgagtgaatggccttgagcaagccacacaggcaggaccattcatgaagtggactaaggcacgacaagttcccagcacgatgctcaccaaagatacaaatccgggtctaggatggcccctgggcctggtcctgttattcactcctctctcctgctctgtgacctaggtgaatgtgtccctggggagcaggaaccagagcccatcttaatcccgagagtccggagggctgtgctaccccaagaagaggaaggatcagggggtgggcaactggtaactgaagtcaccaagaaagaagattcctgccagctgggctactcggccggtccctgcatgggaatgaccagcaggtatttctataatggtacatccatggcctgtgagactttc

SEQ ID NO: 106740 - DNA, 579 bp, Homo sapiens
  Payload ID: 955
  Gene Symbol: AMBP
  Gene Name: alpha-1-microglobulin/bikunin precursor
  ENST ID: ENST00000466610
  CDS Start-End: 1-579
cacaaatccaaatggaacataaccatggagtcctatgtggtccacaccaactatgatgagtatgccattttcctgaccaagaaattcagccgccatcatggacccaccattactgccaagctctacgggcgggcgccgcagctgagggaaactctcctgcaggacttcagagtggttgcccagggtgtgggcatccctgaggactccatcttcaccatggctgaccgaggtgaatgtgtccctggggagcaggaaccagagcccatcttaatcccgagagtccggagggctgtgctaccccaagaagaggaaggatcagggggtgggcaactggtaactgaagtcaccaagaaagaagattcctgccagctgggctactcggccggtccctgcatgggaatgaccagcaggtatttctataatggtacatccatggcctgtgagactttccagtacggcggctgcatgggcaacggtaacaacttcgtcacagtccggggcccctgccgagccttcatccagctctgggcatttgatgctgtcaaggggaagtgcgtcctcttcccctacgggggctgc

SEQ ID NO: 106741 - DNA, 1307 bp, Homo sapiens
  Payload ID: 956
  Gene Symbol: AZGP1
  Gene Name: alpha-2-glycoprotein 1, zinc-binding
  Uniprot ID: P25311
  ENST ID: ENST00000292401
  CDS Start-End: 138-1034
atcatttttttttctctattaggggaggagcccgtcctggcactcccattggcctgtagattcacctcccctgggcagggccccaggacccaggataatatctgtgcctcctgcccagaaccctccaagcagacacaatggtaagaatggtgcctgtcctgctgtctctgctgctgcttctgggtcctgctgtcccccaggagaaccaagatggtcgttactctctgacctatatctacactgggctgtccaagcatgttgaagacgtccccgcgtttcaggcccttggctcactcaatgacctccagttctttagatacaacagtaaagacaggaagtctcagcccatgggactctggagacaggtggaaggaatggaggattggaagcaggacagccaacttcagaaggccagggaggacatctttatggagaccctgaaagacatcgtggagtattacaacgacagtaacgggtctcacgtattgcagggaaggtttggttgtgagatcgagaataacagaagcagcggagcattctggaaatattactatgatggaaaggactacattgaattcaacaaagaaatcccagcctgggtccccttcgacccagcagcccagataaccaagcagaagtgggaggcagaaccagtctacgtgcagcgggccaaggcttacctggaggaggagtgccctgcgactctgcggaaatacctgaaatacagcaaaaatatcctggaccggcaagatcctccctctgtggtggtcaccagccaccaggccccaggagaaaagaagaaactgaagtgcctggcctacgacttctacccagggaaaattgatgtgcactggactcgggccggcgaggtgcaggagcctgagttacggggagatgttcttcacaatggaaatggcacttaccagtcctgggtggtggtggcagtgcccccgcaggacacagccccctactcctgccacgtgcagcacagcagcctggcccagcccctcgtggtgccctgggaggccagctaggaagcaagggttggaggcaatgtgggatctcagacccagtagctgcccttcctgcctgatgtgggagctgaaccacagaaatcacagtcaatggatccacaaggcctgaggagcagtgtggggggacagacaggaggtggatttggagaccgaagactgggatgcctgtcttgagtagacttggacccaaaaaatcatctcaccttgagcccacccccaccccattgtctaatctgtagaagctaataaataatcatccctccttgcctagca

SEQ ID NO: 106742 - DNA, 719 bp, Homo sapiens
  Payload ID: 956
  Gene Symbol: AZGP1
  Gene Name: alpha-2-glycoprotein 1, zinc-binding
  ENST ID: ENST00000419575
  CDS Start-End: 1-257
tgacctatatctacactgggctgtccaagcatgttgaagacgtccccgcgtttcaggcccttggctcactcaatgacctccagttctttagatacaacagtaaagacaggaagtctcagcccatgggactctggagacagcaaaaatatcctggaccggcaagatcctccctctgtggtggtcaccagccaccaggccccaggagaaaagaagaaactgaagtgcctggcctacgacttctacccagggaaaattgatgtgcactggactcgggccggcgaggtgcaggagcctgagttacggggagatgttcttcacaatggaaatggcacttaccagtcctgggtggtggtggcagtgcccccgcaggacacagccccctactcctgccacgtgcagcacagcagcctggcccagcccctcgtggtgccctgggaggccagctaggaagcaagggttggaggcaatgtgggatctcagacccagtagctgcccttcctgcctgatgtgggagctgaaccacagaaatcacagtcaatggatccacaaggcctgaggagcagtgtggggggacagacaggaggtggatttggagaccgaagactgggatgcctgtcttgagtagacttggacccaaaaaatcatctcaccttgagcccacccccaccccattgtctaatctgtagaagctaataaataatcatccctccttgcctagc

SEQ ID NO: 106743 - DNA, 2027 bp, Homo sapiens
  Payload ID: 956
  Gene Symbol: AZGP1
  Gene Name: alpha-2-glycoprotein 1, zinc-binding
  ENST ID: ENST00000411734
  CDS Start-End: 7-690
gtaagaatggtgcctgtcctgctgtctctgctgctgcttctgggtcctgctgtcccccaggagaaccaagatggtcgttactctctgacctatatctacactgggctgtccaagcatgttgaagacgtccccgcgtttcaggcccttggctcactcaatgacctccagttctttagatacaacagtaaagacaggaagtctcagcccatgggactctggagacaggtggaaggaatggaggattggaagcaggacagccaacttcagaaggccagggaggacatctttatggagaccctgaaagacatcgtggagtattacaacgacagtaacgggtctcacgtattgcagggaaggtttggttgtgagatcgagaataacagaagcagcggagcattctggaaatattactatgatggaaaggactacattgaattcaacaaagaaatcccagcctgggtccccttcgacccagcagcccagataaccaagcagaagtgggaggcagaaccagtctacgtgcagcgggccaaggcttacctggaggaggagtgccctgcgactctgcggaaatacctgaaatacagcaaaaatatcctggaccggcaaggtactcactgcttcctgctccccagtactgagcccagaataaaagacgatctcaggctaggagctcaggcaacatcttagtccggtctcatctgttcctggatgtccctcagacccccagctttcatcttttaggatttattccttccctgggataatataatttgtggtccaaaaagaacatcatcaaaatttcaggcagaatgggccaggaaggccattctttcttgatgagtgtccccaaatcatctccaattaacagacaaggagcttgaggttagggaggtgagggtaacactgtctgtaagaggcagagctgggactcaaattccagatttcagattccaaatcccatcgttttttatctctacaatgatgcctcccatctgggtggtggagagaagggaggcgtgtaaaatgtcagccccagaaggacaagagcaagccagtgtgagcggaattgatggctgcaagctgagacttggattggagacgtagtgagactcaggattgtgcagtgctgcagggaagtggttgctggatagaggcatgggctgaaccaagcagctggactgagactgggggacagaactccaaagcccactgagatgtgggaaaacatggagaagcacacggagcattcacaacttattgccgtcagagtcaatacatgggtgaggtggggattgggcaagagggaaagcgtcagccttccctgatattctggaaagtctcccggggctgggggtgggcaggtacagagcttcgagctctgctgatcgctgacatccaggggtgggggtaggaagagacctgggccgggagaagtccacctcaagcctgcagtgtcacactctatccctccacagatcctccctctgtggtggtcaccagccaccaggccccaggagaaaagaagaaactgaagtgcctggcctacgacttctacccagggaaaattgatgtgcactggactcgggccggcgaggtgcaggagcctgagttacggggagatgttcttcacaatggaaatggcacttaccagtcctgggtggtggtggcagtgcccccgcaggacacagccccctactcctgccacgtgcagcacagcagcctggcccagcccctcgtggtgccctgggaggccagctaggaagcaagggttggaggcaatgtgggatctcagacccagtagctgcccttcctgcctgatgtgggagctgaaccacagaaatcacagtcaatggatccacaaggcctgaggagcagtgtggggggacagacaggaggtggatttggagaccgaagactgggatgcctgtcttgagtagacttggacccaaaaaatcatctcaccttgagcccacccccaccccattgtctaatctgtagaagctaataaataatcatccctcctt

SEQ ID NO: 106744 - DNA, 1553 bp, Homo sapiens
  Payload ID: 957
  Gene Symbol: AHSG
  Gene Name: alpha-2-HS-glycoprotein
  ENST ID: ENST00000273784
  CDS Start-End: 77-1183
ttcccagcagagcacctgggttggtcccgaagcctccaaccacctgcacgcctgccagggcctctctggggcagccatgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcaaaatgtgattccagtccagcagactcagccgaggacgtgcgcaaggtgtgccaagactgccccctgctggccccgctgaacgacaccagggtggtgcacgccgcgaaagctgccctggccgccttcaacgctcagaacaacggctccaattttcagctggaggaaatttcccgggctcagcttgtgcccctcccaccttctacctatgtggagtttacagtgtctggcactgactgtgttgctaaagaggccacagaggcagccaagtgtaacctgctggcagaaaagcaatatggcttttgtaaggcaacactcagtgagaagcttggtggggcagaggttgcagtgacctgcatggtgttccaaacacagcccgtgagctcacagccccaaccagaaggtgccaatgaagcagtccccacacccgtggtggacccagatgcacctccgtcccctccacttggcgcacctggactccctccagctggctcacccccagactcccatgtgttactggcagctcctccaggacaccagttgcaccgggcgcactacgacctgcgccacaccttcatgggtgtggtctcattggggtcaccctcaggagaagtgtcgcacccccggaaaacacgcacagtggtgcagcctagtgttggtgctgctgctgggccagtggttcctccatgtccggggaggatcagacacttcaaggtctaggctagacatggcagagatgaggaggtttggcacagaaaacatagccaccattttgtccaagcctgggcatgggtggggggccttgtctgctggccacgcaagtgtcacatgcgatctacattaatatcaagtcttgactccctacttcccgtcattcctcacaggacagaagcagagtgggtggtggttatgtttgacagaaggcattaggttgacaacttgtcatgattttgacggtaagccaccatgattgtgttctctgcctctggttgaccttacaaaaaccattggaactgtgactttgaaaggtgctcttgctaagcttatatgtgcctgttaatgaaagtgcctgaaagaccttccttaataa

SEQ ID NO: 106745 - DNA, 1711 bp, Homo sapiens
  Payload ID: 957
  Gene Symbol: AHSG
  Gene Name: alpha-2-HS-glycoprotein
  Uniprot ID: P02765
  ENST ID: ENST00000411641
  CDS Start-End: 220-1323
tgtttgcttttccagggctgatgtttgcagggtgtttttttttttcttttgaaccaaagcagaaatcatcctgtatccttatgcaattcttccggcaggctccaacagataaataaagcccaccaccctccatgggtctacctttcccagcagagcacctgggttggtcccgaagcctccaaccacctgcacgcctgccagggcctctctggggcagccatgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcaaaatgtgattccagtccagactcagccgaggacgtgcgcaaggtgtgccaagactgccccctgctggccccgctgaacgacaccagggtggtgcacgccgcgaaagctgccctggccgccttcaacgctcagaacaacggctccaattttcagctggaggaaatttcccgggctcagcttgtgcccctcccaccttctacctatgtggagtttacagtgtctggcactgactgtgttgctaaagaggccacagaggcagccaagtgtaacctgctggcagaaaagcaatatggcttttgtaaggcaacactcagtgagaagcttggtggggcagaggttgcagtgacctgcatggtgttccaaacacagcccgtgagctcacagccccaaccagaaggtgccaatgaagcagtccccacacccgtggtggacccagatgcacctccgtcccctccacttggcgcacctggactccctccagctggctcacccccagactcccatgtgttactggcagctcctccaggacaccagttgcaccgggcgcactacgacctgcgccacaccttcatgggtgtggtctcattggggtcaccctcaggagaagtgtcgcacccccggaaaacacgcacagtggtgcagcctagtgttggtgctgctgctgggccagtggttcctccatgtccggggaggatcagacacttcaaggtctaggctagacatggcagagatgaggaggtttggcacagaaaacatagccaccattttgtccaagcctgggcatgggtggggggccttgtctgctggccacgcaagtgtcacatgcgatctacattaatatcaagtcttgactccctacttcccgtcattcctcacaggacagaagcagagtgggtggtggttatgtttgacagaaggcattaggttgacaacttgtcatgattttgacggtaagccaccatgattgtgttctctgcctctggttgaccttacaaaaaccattggaactgtgactttgaaaggtgctcttgctaagcttatatgtgcctgttaatgaaagtgcctgaaagaccttccttaataaagaaggttctaagctgaa

SEQ ID NO: 106746 - DNA, 4844 bp, Homo sapiens
  Payload ID: 958
  Gene Symbol: A2M
  Gene Name: alpha-2-macroglobulin
  Uniprot ID: P01023
  ENST ID: ENST00000318602
  CDS Start-End: 309-4733
gaaaagcttattagctgctgtacggtaaaagtgagctcttacgggaatgggaatgtagttttagccctccagggattctatttagcccgccaggaattaaccttgactataaataggccatcaatgacctttccagagaatgttcagagacctcaactttgtttagagatcttgtgtgggtggaacttcctgtttgcacacagagcagcataaagcccagttgctttgggaagtgtttgggaccagatggattgtagggagtagggtacaatacagtctgttctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacagggaattcccttctttgggcaggtgcgcctagtagatgggaaaggcgtccctataccaaataaagtcatattcatcagaggaaatgaagcaaactattactccaatgctaccacggatgagcatggccttgtacagttctctatcaacaccaccaatgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttctattatctgataatggcaaagggaggcattgtccgaactgggactcatggactgcttgtgaagcaggaagacatgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacaatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatgagtcagatgtaatgggaagaggccatgcacgcctggtgcatgttgaagagcctcacacggagaccgtacgaaagtacttccctgagacatggatctgggatttggtggtggtaaactcagcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtcctaaactaccttcccaaatgcatccgggtcagtgtgcagctggaagcctctcccgccttcctagctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggagacatattaggctctgccatgcaaaacacacaaaatcttctccagatgccctatggctgtggagagcagaatatggtcctctttgctcctaacatctatgtactggattatctaaatgaaacacagcagcttactccagagatcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaagggaggagtagaagatgaagtgaccctctccgcctatatcaccatcgcccttctggagattcctctcacagtcactcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaaagtgacaggagaaggatgtgtctacctccagacatccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctctggcttcattcccctgaagccaacagtgaaaatgcttgaaagatctaaccatgtgagccggacagaagtcagcagcaaccatgtcttgatttaccttgataaggtgtcaaatcagacactgagcttgttcttcacggttctgcaagatgtcccagtaagagatctgaaaccagccatagtgaaagtctatgattactacgagacggatgagtttgcaattgctgagtacaatgctccttgcagcaaagatcttggaaatgcttgaagaccacaaggctgaaaagtgctttgctggagtcctgttctcagagctccacagaagacacgtgtttttgtatctttaaagacttgatgaataaacactttttctggtcaa

SEQ ID NO: 106747 - DNA, 623 bp, Homo sapiens
  Payload ID: 958
  Gene Symbol: A2M
  Gene Name: alpha-2-macroglobulin
  ENST ID: ENST00000404455
  CDS Start-End: 120-623
atacaagagatgtgagaagcaccataaaaggcgttgtgaggagttgtgggggagtgagggagagaagaggttgaaaagcttattagctgctgtacggtaaaactccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcag

SEQ ID NO: 106748 - DNA, 593 bp, Homo sapiens
  Payload ID: 958
  Gene Symbol: A2M
  Gene Name: alpha-2-macroglobulin
  ENST ID: ENST00000546069
  CDS Start-End: 1-222
aatggaggcaccctgctggggctgaagaagctctccttctattatctgataatggcaaagggaggcattgtccgaactgggactcatggactgcttgtgaagcaggaagacatgaagggccatttttccatctcaatccctgtgaagtcagacattgctcctgtcgctcggtttacaacctgctaccagaaaaggacctcactggcttccctgggcctttgaatgaccaggacaatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatgagtcagatgtaatgggaagaggccatgcacgcctggtgcatgttgaagagcctcacacggagaccgtacgaaagtacttccctgagacatggatctgggatttggtggtggtaaactcagcaggtgtggctgaggtaggagtaacagtc

SEQ ID NO: 106749 - DNA, 590 bp, Homo sapiens
  Payload ID: 958
  Gene Symbol: A2M
  Gene Name: alpha-2-macroglobulin
  ENST ID: ENST00000539638
  CDS Start-End: 12-284
ctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgcttgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatga

SEQ ID NO: 106750 - DNA, 5274 bp, Homo sapiens
  Payload ID: 959
  Gene Symbol: A2ML1
  Gene Name: alpha-2-macroglobulin-like 1
  Uniprot ID: A8K2U0
  ENST ID: ENST00000299698
  CDS Start-End: 181-4545
gtccaccacctaacctggtggttacagaaggaggaacacagtcctcctgtgttccaggtgccaggaggtgactgactatagcatcagtcatcactgcacaccctacctggaattagtatataaagctacgcggagcgatctctgcccctgaccctggaaaaatctgtctcacccacaaagatgtgggctcagctccttctaggaatgttggccctatcaccagccattgcagaagaacttccaaactacctggtgacattaccagcccggctaaatttcccctccgttcagaaggtttgtttggacctgagccctgggtacagtgatgttaaattcacggttactctggagaccaaggacaagacccagaagttgctagaatactctggactgaagaagaggcacttacattgtatctcctttcttgtaccacctcctgctggtggcacagaagaagtggccacaatccgggtgtcgggagttggaaataacatcagctttgaggagaagaaaaaggttctaattcagaggcaggggaacggcacctttgtacagactgacaaacctctctacaccccagggcagcaagtgtatttccgcattgtcaccatggatagcaacttcgttccagtgaatgacaagtactccatggtggaactacaggatccaaatagcaacaggattgcacagtggctggaagtggtacctgagcaaggcattgtagacctgtccttccaactggcaccagaggcaatgctgggcacctacactgtggcagtggctgagggcaagacctttggtactttcagtgtggaggaatatgtgctgccgaagtttaaggtggaagtggtggaacccaaggagttatcaacggtgcaggaatctttcttagtaaaaatttgttgtaggtacacctatggaaagcccatgctaggggcagtgcaggtatctgtgtgtcagaaggcaaatacttactggtatcgagaggtggaacgggaacagcttcctgacaaatgcaggaacctctctggacagactgacaaaacaggatgtttctcagcacctgtggacatggccacctttgacctcattggatatgcgtacagccatcaaatcaatattgtggctactgttgtggaggaagggacaggtgtggaggccaatgccactcagaatatctacatttctccacaaatgggatcaatgacctttgaagacaccagcaatttttaccatccaaatttccccttcagtgggaagataagagttaggggccatgatgactccttcctcaagaaccatctagtgtttctggtgatttatggcacaaatggaaccttcaaccagaccctggttactgataacaatggcctagctccctttaccttggagacatccggttggaatgggacagacgtttctctggagggaaagtttcaaatggaagacttagtatataatccggaacaagtgccacgttactaccaaaatgcctacctgcacctgcgacccttctacagcacaacccgcagcttccttggcatccaccggctaaacggccccttgaaatgtggccagccccaggaagtgctggtggattattacatcgacccggccgatgcaagccctgaccaagagatcagcttctcctactatttaatagggaaaggaagtttggtgatggaggggcagaaacacctgaactctaagaagaaaggactgaaagcctccttctctctctcactgaccttcacttcgagactggcccctgatccttccctggtgatctatgccatttttcccagtggaggtgttgtagctgacaaaattcagttctcagtcgagatgtgctttgacaatcaggtttcccttggcttctccccctcccagcagcttccaggagcagaagtggagctgcagctgcaggcagctcccggatccctgtgtgcgctccgggcggtggatgagagtgtcttactgcttaggccagacagagagctgagcaaccgctctgtctatgggatgtttccattctggtatggtcactacccctatcaagtggctgagtatgatcagtgtccagtgtctggcccatgggactttcctcagcccctcattgacccaatgccccaagggcattcgagccagcgttccattatctggaggccctcgttctctgaaggcacggaccttttcagctttttccgggacgtgggcctgaaaatactgtccaatgccaaaatcaagaagccagtagattgcagtcacagatctccagaatacagcactgctatgggtgcaggcggtggtcatccagaggcttttgagtcatcaactcctttacatcaagcagaggattctcaggtccgccagtacttcccagagacctggctctgggatctgtttcctattggtaactcggggaaggaggcggtccacgtcacagttcctgacgccatcaccgagtggaaggcgatgagtttctgcacttcccagtcaagaggcttcgggctttcacccactgttggactaactgctttcaagccgttctttgttgacctgactctcccttactcagtagtccgtggggaatcctttcgtcttactgccaccatcttcaattacctaaaggattgcatcagggttcagactgacctggctaaatcgcatgagtaccagctagaatcatgggcagattctcagacctccagttgtctctgtgctgatgacgcaaaaacccaccactggaacatcacagctgtcaaattgggtcacattaactttactattagtacaaagattctggacagcaatgaaccatgtgggggccagaaggggtttgttccccaaaagggccgaagtgacacgctcatcaagccagttctcgtcaaacctgagggagtcctggtggagaagacacacagctcattgctgtgcccaaaaggaaaggtggcatctgaatctgtctccctggagctcccagtggacattgttcctgactcgaccaaggcttatgttacggttctgggagacattatgggcacagccctgcagaacctggatggtctggtgcagatgcccagtggctgtggcgagcagaacatggtcttgtttgctcccatcatctatgtcttgcagtacctggagaaggcagggctgctgacggaggagatcaggtctcgggcagtgggtttcctggaaatagggtaccagaaggagctgatgtacaaacacagcaatggctcatacagtgcctttggggagcgagatggaaatggaaacacatggctgacagcgtttgtcacaaaatgctttggccaagctcagaaattcatcttcattgatcccaagaacatccaggatgctctcaagtggatggcaggaaaccagctccccagtggctgctatgccaacgtgggaaatctccttcacacagctatgaagggtggtgttgatgatgaggtctccttgactgcgtatgtcacagctgcattgctggagatgggaaaggatgtagatgacccaatggtgagtcagggtctacggtgtctcaagaattcggccacctccacgaccaacctctacacacaggccctgttggcttacattttctccctggctggggaaatggacatcagaaacattctccttaaacagttagatcaacaggctatcatctcaggagaatccatttactggagccagaaacctactccatcatcgaacgccagcccttggtctgagcctgcggctgtagatgtggaactcacagcatatgcattgttggcccagcttaccaagcccagcctgactcaaaaggagatagcgaaggccactagcatagtggcttggttggccaagcaacacaatgcatatgggggcttctcttctactcaggatactgtagttgctctccaagctcttgccaaatatgccactaccgcctacatgccatctgaggagatcaacctggttgtaaaatccactgagaatttccagcgcacattcaacatacagtcagttaacagattggtatttcagcaggataccctgcccaatgtccctggaatgtacacgttggaggcctcaggccagggctgtgtctatgtgcagacggtgttgagatacaatattctccctcccacaaatatgaagacctttagtcttagtgtggaaataggaaaagctagatgtgagcaaccgacttcacctcgatccttgactctcactattcacaccagttatgtggggagccgtagctcttccaatatggctattgtggaagtgaagatgctatctgggttcagtcccatggagggcaccaatcagttacttctccagcaacccctggtgaagaaggttgaatttggaactgacacacttaacatttacttggatgagctcattaagaacactcagacttacaccttcaccatcagccaaagtgtgctggtcaccaacttgaaaccagcaaccatcaaggtctatgactactacctaccagatgaacaggcaacaattcagtattctgatccctgtgaatgaggataggagctggaaactcaattagtcctctgtgacatttactggagggtggaacattcttctgtcgcttgaagcagaactcattcaatcaaataatttaatttctctgactagtatatgggtaacaaatgaatatgtctgaacctcagctataatactttctactacctttgcaaggagatgggataggaacaatcactcagaggaggcgttgcatgggcagggtcatagggggaagaaaggtggtttagctgttttatttagccattcagggggctctccagagaggagacggtggtagagggtgaactagagaagataagaatgtcttcctaggccggatgcggtggctcacgcctgtaatcccagcactttgggattgcgaggtgggcggatcacttgaggtcaggagttcaagaccagcctggccaacatggtaaaacccgtctctactaacaatacaaagattagcctggtgtggtggcacgggcctgtaatcgcagccccttggaaggccaaggcaggagaatcgcctcaacactggaggtggaggttgcagtgagctgagattgtgccactgcactccagcctgggcaatgaggcaagaccctgtctcaaaaaataataaataataataataataatgtttttctagagtttcagtctaagggaaaatgtgatttagggctttggaaattggctaaaaaaataaaaatggaaaagaaaatc

SEQ ID NO: 106751 - DNA, 3460 bp, Homo sapiens
  Payload ID: 959
  Gene Symbol: A2ML1
  Gene Name: alpha-2-macroglobulin-like 1
  Uniprot ID: A8K2U0
  ENST ID: ENST00000539547
  CDS Start-End: 169-3060
aatgtcagaagggctcagggtggtttaggatgaaattatttccactgaattttaaattgagctgtaattaaaaaacacttatgaggatagattttcgctgactttctgttacaaagattataagaaaataaaatttggagatcttcaagaaatggcagacagttatctatgttaatagggaaaggaagtttggtgatggaggggcagaaacacctgaactctaagaagaaaggactgaaagcctccttctctctctcactgaccttcacttcgagactggcccctgatccttccctggtgatctatgccatttttcccagtggaggtgttgtagctgacaaaattcagttctcagtcgagatgtgctttgacaatcaggtttcccttggcttctccccctcccagcagcttccaggagcagaagtggagctgcagctgcaggcagctcccggatccctgtgtgcgctccgggcggtggatgagagtgtcttactgcttaggccagacagagagctgagcaaccgctctgtctatgggatgtttccattctggtatggtcactacccctatcaagtggctgagtatgatcagtgtccagtgtctggcccatgggactttcctcagcccctcattgacccaatgccccaagggcattcgagccagcgttccattatctggaggccctcgttctctgaaggcacggaccttttcagctttttccgggacgtgggcctgaaaatactgtccaatgccaaaatcaagaagccagtagattgcagtcacagatctccagaatacagcactgctatgggtgcaggcggtggtcatccagaggcttttgagtcatcaactcctttacatcaagcagaggattctcaggtccgccagtacttcccagagacctggctctgggatctgtttcctattggtaactcggggaaggaggcggtccacgtcacagttcctgacgccatcaccgagtggaaggcgatgagtttctgcacttcccagtcaagaggcttcgggctttcacccactgttggactaactgctttcaagccgttctttgttgacctgactctcccttactcagtagtccgtggggaatcctttcgtcttactgccaccatcttcaattacctaaaggattgcatcagggttcagactgacctggctaaatcgcatgagtaccagctagaatcatgggcagattctcagacctccagttgtctctgtgctgatgacgcaaaaacccaccactggaacatcacagctgtcaaattgggtcacattaactttactattagtacaaagattctggacagcaatgaaccatgtgggggccagaaggggtttgttccccaaaagggccgaagtgacacgctcatcaagccagttctcgtcaaacctgagggagtcctggtggagaagacacacagctcattgctgtgcccaaaaggaaaggtggcatctgaatctgtctccctggagctcccagtggacattgttcctgactcgaccaaggcttatgttacggttctgggagacattatgggcacagccctgcagaacctggatggtctggtgcagatgcccagtggctgtggcgagcagaacatggtcttgtttgctcccatcatctatgtcttgcagtacctggagaaggcagggctgctgacggaggagatcaggtctcgggcagtgggtttcctggaaatagggtaccagaaggagctgatgtacaaacacagcaatggctcatacagtgcctttggggagcgagatggaaatggaaacacatggctgacagcgtttgtcacaaaatgctttggccaagctcagaaattcatcttcattgatcccaagaacatccaggatgctctcaagtggatggcaggaaaccagctccccagtggctgctatgccaacgtgggaaatctccttcacacagctatgaagggtggtgttgatgatgaggtctccttgactgcgtatgtcacagctgcattgctggagatgggaaaggatgtagatgacccaatggtgagtcagggtctacggtgtctcaagaattcggccacctccacgaccaacctctacacacaggccctgttggcttacattttctccctggctggggaaatggacatcagaaacattctccttaaacagttagatcaacaggctatcatctcaggagaatccatttactggagccagaaacctactccatcatcgaacgccagcccttggtctgagcctgcggctgtagatgtggaactcacagcatatgcattgttggcccagcttaccaagcccagcctgactcaaaaggagatagcgaaggccactagcatagtggcttggttggccaagcaacacaatgcatatgggggcttctcttctactcaggatactgtagttgctctccaagctcttgccaaatatgccactaccgcctacatgccatctgaggagatcaacctggttgtaaaatccactgagaatttccagcgcacattcaacatacagtcagttaacagattggtatttcagcaggataccctgcccaatgtccctggaatgtacacgttggaggcctcaggccagggctgtgtctatgtgcagacggtgttgagatacaatattctccctcccacaaatatgaagacctttagtcttagtgtggaaataggaaaagctagatgtgagcaaccgacttcacctcgatccttgactctcactattcacaccagttatgtggggagccgtagctcttccaatatggctattgtggaagtgaagatgctatctgggttcagtcccatggagggcaccaatcagttacttctccagcaacccctggtgaagaaggttgaatttggaactgacacacttaacatttacttggatgagctcattaagaacactcagacttacaccttcaccatcagccaaagtgtgctggtcaccaacttgaaaccagcaaccatcaaggtctatgactactacctaccagatgaacaggcaacaattcagtattctgatccctgtgaatgaggataggagctggaaactcaattagtcctctgtgacatttactggagggtggaacattcttctgtcgcttgaagcagaactcattcaatcaaataatttaatttctctgactagtatatgggtaacaaatgaatatgtctgaacctcagctataatactttctactacctttgcaaggagatgggataggaacaatcactcagaggaggcgttgcatgggcagggtcatagggggaagaaaggtggtttagctgttttatttagccattcagggggctctccagagaggagacggtggtagagggtgaactagagaagataagaatgtcttcctaggccggatgcggtggctcacgcctgtaatcccagcactttgggattgcgaggtgggcggatcact

SEQ ID NO: 106752 - DNA, 570 bp, Homo sapiens
  Payload ID: 959
  Gene Symbol: A2ML1
  Gene Name: alpha-2-macroglobulin-like 1
  ENST ID: ENST00000545692
  CDS Start-End: 20-570
gcatttgtcaagctagtggatgctgggtgagttaatagggaaaggaagtttggtgatggaggggcagaaacacctgaactctaagaagaaaggactgaaagcctccttctctctctcactgaccttcacttcgagactggcccctgatccttccctggtgatctatgccatttttcccagtggaggtgttgtagctgacaaaattcagttctcagtcgagatgtgctttgacaatcaggtttcccttggcttctccccctcccagcagcttccaggagcagaagtggagctgcagctgcaggcagctcccggatccctgtgtgcgctccgggcggtggatgagagtgtcttactgcttaggccagacagagagctgagcaaccgctctgtctatgggatgtttccattctggtatggtcactacccctatcaagtggctgagtatgatcagtgtccagtgtctggcccatgggactttcctcagcccctcattgacccaatgccccaagggcattcgagccagcgttccattatctggaggccctcgttctctgaaggcacggacctttt

SEQ ID NO: 106753 - DNA, 462 bp, Homo sapiens
  Payload ID: 959
  Gene Symbol: A2ML1
  Gene Name: alpha-2-macroglobulin-like 1
  ENST ID: ENST00000536789
  CDS Start-End: 219-462
gtggacgggaagggggagttagaagaggagatttctcctctagagggttcaatgtcagaagggctcagggtggtttaggatgaaattatttccactgaattttaaattgagctgtaattaaaaaacacttatgaggatagattttcgctgactttctgttacaaagattataagaaaataaaatttggagatcttcaagaaatggcagacagttatctatggtgaggaacaatttctatgctgtcagactcctcccatccacctgcgtggttctcagccagacctccaactgcaggaggagccaccaggacccgttggcagcatcctgcatttgtcaagctagtggatgctggttaatagggaaaggaagtttggtgatggaggggcagaaacacctgaactctaagaagaaaggactgaaagcctccttctctctctcactgaccttcacttcgagactgg

SEQ ID NO: 106754 - DNA, 3370 bp, Homo sapiens
  Payload ID: 959
  Gene Symbol: A2ML1
  Gene Name: alpha-2-macroglobulin-like 1
  ENST ID: ENST00000541459
  CDS Start-End: 1-3015
agcttccttggcatccaccggctaaacggccccttgaaatgtggccagccccaggaagtgctggtggattattacatcgacccggccgatgcaagccctgaccaagagatcagcttctcctactatttaatagggaaaggaagtttggtgatggaggggcagaaacacctgaactctaagaagaaaggactgaaagcctccttctctctctcactgaccttcacttcgagactggcccctgatccttccctggtgatctatgccatttttcccagtggaggtgttgtagctgacaaaattcagttctcagtcgagatgtgctttgacaatcaggtttcccttggcttctccccctcccagcagcttccaggagcagaagtggagctgcagctgcaggcagctcccggatccctgtgtgcgctccgggcggtggatgagagtgtcttactgcttaggccagacagagagctgagcaaccgctctgtctatgggatgtttccattctggtatggtcactacccctatcaagtggctgagtatgatcagtgtccagtgtctggcccatgggactttcctcagcccctcattgacccaatgccccaagggcattcgagccagcgttccattatctggaggccctcgttctctgaaggcacggaccttttcagctttttccgggacgtgggcctgaaaatactgtccaatgccaaaatcaagaagccagtagattgcagtcacagatctccagaatacagcactgctatgggtgcaggcggtggtcatccagaggcttttgagtcatcaactcctttacatcaagcagaggattctcaggtccgccagtacttcccagagacctggctctgggatctgtttcctattggtaactcggggaaggaggcggtccacgtcacagttcctgacgccatcaccgagtggaaggcgatgagtttctgcacttcccagtcaagaggcttcgggctttcacccactgttggactaactgctttcaagccgttctttgttgacctgactctcccttactcagtagtccgtggggaatcctttcgtcttactgccaccatcttcaattacctaaaggattgcatcagggttcagactgacctggctaaatcgcatgagtaccagctagaatcatgggcagattctcagacctccagttgtctctgtgctgatgacgcaaaaacccaccactggaacatcacagctgtcaaattgggtcacattaactttactattagtacaaagattctggacagcaatgaaccatgtgggggccagaaggggtttgttccccaaaagggccgaagtgacacgctcatcaagccagttctcgtcaaacctgagggagtcctggtggagaagacacacagctcattgctgtgcccaaaaggaaaggtggcatctgaatctgtctccctggagctcccagtggacattgttcctgactcgaccaaggcttatgttacggttctgggagacattatgggcacagccctgcagaacctggatggtctggtgcagatgcccagtggctgtggcgagcagaacatggtcttgtttgctcccatcatctatgtcttgcagtacctggagaaggcagggctgctgacggaggagatcaggtctcgggcagtgggtttcctggaaatagggtaccagaaggagctgatgtacaaacacagcaatggctcatacagtgcctttggggagcgagatggaaatggaaacacatggctgacagcgtttgtcacaaaatgctttggccaagctcagaaattcatcttcattgatcccaagaacatccaggatgctctcaagtggatggcaggaaaccagctccccagtggctgctatgccaacgtgggaaatctccttcacacagctatgaagggtggtgttgatgatgaggtctccttgactgcgtatgtcacagctgcattgctggagatgggaaaggatgtagatgacccaatggtgagtcagggtctacggtgtctcaagaattcggccacctccacgaccaacctctacacacaggccctgttggcttacattttctccctggctggggaaatggacatcagaaacattctccttaaacagttagatcaacaggctatcatctcaggagaatccatttactggagccagaaacctactccatcatcgaacgccagcccttggtctgagcctgcggctgtagatgtggaactcacagcatatgcattgttggcccagcttaccaagcccagcctgactcaaaaggagatagcgaaggccactagcatagtggcttggttggccaagcaacacaatgcatatgggggcttctcttctactcaggatactgtagttgctctccaagctcttgccaaatatgccactaccgcctacatgccatctgaggagatcaacctggttgtaaaatccactgagaatttccagcgcacattcaacatacagtcagttaacagattggtatttcagcaggataccctgcccaatgtccctggaatgtacacgttggaggcctcaggccagggctgtgtctatgtgcagacggtgttgagatacaatattctccctcccacaaatatgaagacctttagtcttagtgtggaaataggaaaagctagatgtgagcaaccgacttcacctcgatccttgactctcactattcacaccagttatgtggggagccgtagctcttccaatatggctattgtggaagtgaagatgctatctgggttcagtcccatggagggcaccaatcagttacttctccagcaacccctggtgaagaaggttgaatttggaactgacacacttaacatttacttggatgagctcattaagaacactcagacttacaccttcaccatcagccaaagtgtgctggtcaccaacttgaaaccagcaaccatcaaggtctatgactactacctaccagatgaacaggcaacaattcagtattctgatccctgtgaatgaggatctggctctgttgcccaggctgcagtgcagtggcgtgatctcagctcactgcagcctctgcctcccaagttcaagcgattcttgtgcctcagcctcctgagtagctgggatgacaggcacgtgccatcacgcccagctaattttttttgtatttttaatagagatggggtttcgccatgttggtcaggctggtctcaaactcctggcctcaggtgatccgcctacttcagcctcccaaagtgctgggattacaggtgtaagccactgtgcccggcctgtcctaaactcttgaaaatagtttacagaagaaaaagctaatgcttggtattaaaacaatacttttttctatcag

SEQ ID NO: 106755 - DNA, 1136 bp, Homo sapiens
  Payload ID: 959
  Gene Symbol: A2ML1
  Gene Name: alpha-2-macroglobulin-like 1
  ENST ID: ENST00000537475
  CDS Start-End: 1-547
gcgcacattcaacatacagtcagttaacagattggtatttcagcaggataccctgcccaatgtccctggaatgtacacgttggaggcctcaggccagggctgtgtctatgtgcagacggtgttgagatacaatattctccctcccacaaatatgaagacctttagtcttagtgtggaaataggaaaagctagatgtgagcaaccgacttcacctcgatccttgactctcactattcacaccagttatgtggggagccgtagctcttccaatatggctattgtggaagtgaagatgctatctgggttcagtcccatggagggcaccaatcagttacttctccagcaacccctggtgaagaaggttgaatttggaactgacacacttaacatttacttggatgagctcattaagaacactcagacttacaccttcaccatcagccaaagtgtgctggtcaccaacttgaaaccagcaaccatcaaggtctatgactactacctaccagatgaacaggcaacaattcagtattctgatccctgtgaatgagaaagatcattctagcagtaatgtgaagaatggggtggagaagaagaaagccgaagtccttgaaaccatttaggagactgctacagttatccaggttcttttaaattatctcagtacacaattgtgtggtccatgaacaatgacagcatagtggactctgtggcacggcacccagaaccaccccctttcaagacagaagcatttattccttcacttcctgggagtgttaacaactgatagctaccagttgtgcccgctctggacttttgcccatagtggcctatcctctgtgattatgcatttgtaactgtgttcttcctcttctgaagacatcagtcacattggattagccacccttatggctgcatttcaccttgattaccactttaaaggccctgtctccaaatacagtcacattgggggttatggctccaacatactcatttggaagccaggtgtggtggctcatgcctgtaatcccagcactttcggaggccaaggcaggaggattgcttgagcccaggagctagagatcagcctgggcaacacagggagactcatctctacaaaaaaatataaataaataaac

SEQ ID NO: 106756 - DNA, 1116 bp, Homo sapiens
  Payload ID: 960
  Gene Symbol:
  Gene Name: alpha-crystallin A chain  [Source:RefSeq peptide
  Acc:NP_001300979]
  ENST ID: ENST00000619537
  CDS Start-End: 70-591
acactgcgctgcccagaggccccgctgactcctgccagcctccaggtccccgtggtaccaaagctgaacatggatgtgaccatccagcacccctggttcaagcgcaccctggggcccttctaccccagccggctgttcgaccagtttttcggcgagggcctttttgagtatgacctgctgcccttcctgtcgtccaccatcagcccctactaccgccagtccctcttccgcaccgtgctggactccggcatctctgaggttcgatccgaccgggacaagttcgtcatcttcctcgatgtgaagcacttctccccggaggacctcaccgtgaaggtgcaggacgactttgtggagatccacggaaagcacaacgagcgccaggacgaccacggctacatttcccgtgagttccaccgccgctaccgcctgccgtccaacgtggaccagtcggccctctcttgctccctgtctgccgatggcatgctgaccttctgtggccccaagatccagactggcctggatgccacccacgccgagcgagccatccccgtgtcgcgggaggagaagcccacctcggctccctcgtcctaagcaggcattgcctcggctggctcccctgcagccctggcccatcatggggggagcaccctgagggcggggtgtctgtcttcctttgcttcccttttttcctttccaccttctcacatggaatgagggtttgagagagcagccaggagagcttagggtctcagggtgtcccagaccccgacaccggccagtggcggaagtgaccgcacctcacactcctttagatagcagcctggctcccctggggtgcaggcgcctcaactctgctgagggtccagaaggagggggtgacctccggccaggtgcctcctgacacacctgcagcctccctccgcggcgggccctgcccacacctcctggggcgcgtgaggcccgtggggccggggcttctgtgcacctgggctctcgcggcctcttctctcagaccgtcttcctccaacccctctatgtagtgccgctcttggggacatgggtcgcccatgagagcgcagcccgcggcaatcaataaacagcaggtgatacaagcaa

SEQ ID NO: 106757 - DNA, 712 bp, Homo sapiens
  Payload ID: 960
  Gene Symbol:
  Gene Name: alpha-crystallin A chain  [Source:RefSeq peptide
  Acc:NP_001300979]
  ENST ID: ENST00000624932
  CDS Start-End: 63-473
ggcccaccagtagcattcagcccctcagctggccctgagggtttggagacaggtcgagggtcatgcctgtctgtccaggagacagtcacaggcccccgaaagctctgccccacttggtgtgtgggagaagaggccggcaggttcgatccgaccgggacaagttcgtcatcttcctcgatgtgaagcacttctccccggaggacctcaccgtgaaggtgcaggacgactttgtggagatccacggaaagcacaacgagcgccaggacgaccacggctacatttcccgtgagttccaccgccgctaccgcctgccgtccaacgtggaccagtcggccctctcttgctccctgtctgccgatggcatgctgaccttctgtggccccaagatccagactggcctggatgccacccacgccgagcgagccatccccgtgtcgcgggaggagaagcccacctcggctccctcgtcctaagcaggcattgcctcggctggctcccctgcagccctggcccatcatggggggagcaccctgagggcggggtgtctgtcttcctttgcttcccttttttcctttccaccttctcacatggaatgagggtttgagagagcagccaggagagcttagggtctcagggtgtcccagaccccgacaccggccagtggcggaagtgaccgcacctcacactcctttagatagcagcctggctcccc

SEQ ID NO: 106758 - DNA, 601 bp, Homo sapiens
  Payload ID: 960
  Gene Symbol:
  Gene Name: alpha-crystallin A chain  [Source:RefSeq peptide
  Acc:NP_001300979]
  ENST ID: ENST00000624019
  CDS Start-End: 204-587
gcatgcgtggtggcgaatgccagctcccgggttcctctggtctcctgagtcccggagacctgggagcaggtgggggtcatagtcctgaaagccagagagcagggcgttcctagcacctcctccaatgagctcggcctgcccacggctagcaaagctcttggcaagtttacttaggtgccctgccaaggctaaaaggacaggcaatggacgccccccccccccacccaaccacaggcctcctctctgagccacgggttcgatccgaccgggacaagttcgtcatcttcctcgatgtgaagcacttctccccggaggacctcaccgtgaaggtgcaggacgactttgtggagatccacggaaagcacaacgagcgccaggacgaccacggctacatttcccgtgagttccaccgccgctaccgcctgccgtccaacgtggaccagtcggccctctcttgctccctgtctgccgatggcatgctgaccttctgtggccccaagatccagactggcctggatgccacccacgccgagcgagccatccccgtgtcgcgggaggagaagcccacctcggctccctcgtcctaagcaggcattgcctc

SEQ ID NO: 106759 - DNA, 1914 bp, Homo sapiens
  Payload ID: 961
  Gene Symbol: AFP
  Gene Name: alpha-fetoprotein
  ENST ID: ENST00000226359
  CDS Start-End: 17-1885
aaaataactagcaaccatgaagtgggtggaatcaatttttttaattttcctactaaattttactgaatccagaacactgcatagaaatgaatatggaatagcttccatattggattcttaccaatgtactgcagagataagtttagctgacctggctaccatattttttgcccagtttgttcaagaagccacttacaaggaagtaagcaaaatggtgaaagatgcattgactgcaattgagaaacccactggagatgaacagtcttcagggtgtttagaaaaccagctacctgcctttctggaagaactttgccatgagaaagaaattttggagaagtacggacattcagactgctgcagccaaagtgaagagggaagacataactgttttcttgcacacaaaaagcccactccagcatcgatcccacttttccaagttccagaacctgtcacaagctgtgaagcatatgaagaagacagggagacattcatgaacaaattcatttatgagatagcaagaaggcatcccttcctgtatgcacctacaattcttctttgggctgctcgctatgacaaaataattccatcttgctgcaaagctgaaaatgcagttgaatgcttccaaacaaaggcagcaacagttacaaaagaattaagagaaagcagcttgttaaatcaacatgcatgtgcagtaatgaaaaattttgggacccgaactttccaagccataactgttactaaactgagtcagaagtttaccaaagttaattttactgaaatccagaaactagtcctggatgtggcccatgtacatgagcactgttgcagaggagatgtgctggattgtctgcaggatggggaaaaaatcatgtcctacatatgttctcaacaagacactctgtcaaacaaaataacagaatgctgcaaactgaccacgctggaacgtggtcaatgtataattcatgcagaaaatgatgaaaaacctgaaggtctatctccaaatctaaacaggtttttaggagatagagattttaaccaattttcttcaggggaaaaaaatatcttcttggcaagttttgttcatgaatattcaagaagacatcctcagcttgctgtctcagtaattctaagagttgctaaaggataccaggagttattggagaagtgtttccagactgaaaaccctcttgaatgccaagataaaggagaagaagaattacagaaatacatccaggagagccaagcattggcaaagcgaagctgcggcctcttccagaaactaggagaatattacttacaaaatgcgtttctcgttgcttacacaaagaaagccccccagctgacctcgtcggagctgatggccatcaccagaaaaatggcagccacagcagccacttgttgccaactcagtgaggacaaactattggcctgtggcgagggagcggctgacattattatcggacacttatgtatcagacatgaaatgactccagtaaaccctggtgttggccagtgctgcacttcttcatatgccaacaggaggccatgcttcagcagcttggtggtggatgaaacatatgtccctcctgcattctctgatgacaagttcattttccataaggatctgtgccaagctcagggtgtagcgctgcaaacaatgaagcaagagtttctcattaaccttgtgaagcaaaagccacaaataacagaggaacaacttgaggctgtcattgcagatttctcaggcctgttggagaaatgctgccaaggccaggaacaggaagtctgctttgctgaagaggggaagagaagacaaaacgagtctttcattcggtgtgaacttttctctttaattttaactgatttaacactttttgtgaattaatgaaatgataaagacttttatgtgagatt

SEQ ID NO: 106760 - DNA, 2484 bp, Homo sapiens
  Payload ID: 961
  Gene Symbol: AFP
  Gene Name: alpha-fetoprotein
  Uniprot ID: P02771
  ENST ID: ENST00000395792
  CDS Start-End: 101-1930
actagttaacaggcattgcctgaaaagagtataaaagaatttcagcatgattttccatattgtgcttccaccactgccaataacaaaataactagcaaccatgaagtgggtggaatcaatttttttaattttcctactaaattttactgaatccagaacactgcatagaaatgaatatggaatagcttccatattggattcttaccaatgtactgcagagataagtttagctgacctggctaccatattttttgcccagtttgttcaagaagccacttacaaggaagtaagcaaaatggtgaaagatgcattgactgcaattgagaaacccactggagatgaacagtcttcagggtgtttagaaaaccagctacctgcctttctggaagaactttgccatgagaaagaaattttggagaagtacggacattcagactgctgcagccaaagtgaagagggaagacataactgttttcttgcacacaaaaagcccactccagcatcgatcccacttttccaagttccagaacctgtcacaagctgtgaagcatatgaagaagacagggagacattcatgaacaaattcatttatgagatagcaagaaggcatcccttcctgtatgcacctacaattcttctttgggctgctcgctatgacaaaataattccatcttgctgcaaagctgaaaatgcagttgaatgcttccaaacaaaggcagcaacagttacaaaagaattaagagaaagcagcttgttaaatcaacatgcatgtgcagtaatgaaaaattttgggacccgaactttccaagccataactgttactaaactgagtcagaagtttaccaaagttaattttactgaaatccagaaactagtcctggatgtggcccatgtacatgagcactgttgcagaggagatgtgctggattgtctgcaggatggggaaaaaatcatgtcctacatatgttctcaacaagacactctgtcaaacaaaataacagaatgctgcaaactgaccacgctggaacgtggtcaatgtataattcatgcagaaaatgatgaaaaacctgaaggtctatctccaaatctaaacaggtttttaggagatagagattttaaccaattttcttcaggggaaaaaaatatcttcttggcaagttttgttcatgaatattcaagaagacatcctcagcttgctgtctcagtaattctaagagttgctaaaggataccaggagttattggagaagtgtttccagactgaaaaccctcttgaatgccaagataaaggagaagaagaattacagaaatacatccaggagagccaagcattggcaaagcgaagctgcggcctcttccagaaactaggagaatattacttacaaaatgcgtttctcgttgcttacacaaagaaagccccccagctgacctcgtcggagctgatggccatcaccagaaaaatggcagccacagcagccacttgttgccaactcagtgaggacaaactattggcctgtggcgagggagcggctgacattattatcggacacttatgtatcagacatgaaatgactccagtaaaccctggtgttggccagtgctgcacttcttcatatgccaacaggaggccatgcttcagcagcttggtggtggatgaaacatatgtccctcctgcattctctgatgacaagttcattttccataaggatctgtgccaagctcagggtgtagcgctgcaaacaatgaagcaagagtttctcattaaccttgtgaagcaaaagccacaaataacagaggaacaacttgaggctgtcattgcagatttctcaggcctgttggagaaatgctgccaaggccaggaacaggaagtctgctttgctgaagagggacaaaaactgatttcaaaaactcgtgctgctttgggagtttaaattacttcaggggaagagaagacaaaacgagtctttcattcggtgtgaacttttctctttaattttaactgatttaacactttttgtgaattaatgaaatgataaagacttttatgtgagatttccttatcacagaaataaaatatctccaaatgtttccttttccaagtttgcttatttatgaaaagttatcgataatttctttagttttgtataccattgtctgaagcagattctgttaaaatagcattaagtgttggttattataggagattaaagctatccaaggatggatttacagcactagatcacttggtgaactgaaaaatgttcccaagttaaacactatttgatgctaccagggcattttgtttattaaatgaccatcactgaagtattctaacagataatctggagatgagaaaagaaattattattcttctatgggatctaagaaaatttaacatctactttttttctcaatcttgttcagttctctattcacagacattttaaaacataagaatattacagttttgattgaatataattaa

SEQ ID NO: 106761 - DNA, 4537 bp, Homo sapiens
  Payload ID: 962
  Gene Symbol: ALPK1
  Gene Name: alpha-kinase 1
  Uniprot ID: Q96QP1
  ENST ID: ENST00000177648
  CDS Start-End: 201-3935
tttatgagaaacagtgtgtttcagagaggctgtaccagaattaactctgctcagagttagatttgctggtcttaaagtacttttcctctttaagataaaagaagttcttctaaatcaggaatggattgaaatctaatgaaccgaaactttgggtaattgatcaccctagacccagggacacccaattcatcgtaatcatcatgaataatcaaaaagtggtagctgtgctactgcaagagtgcaagcaagtgctggatcagctcttgttggaagcgccagatgtgtcggaagaggacaagagcgaggaccagcgctgcagagctttactccccagcgagttaaggaccctgatccaggaggcaaaggaaatgaagtggcccttcgtgcctgaaaagtggcagtacaaacaagccgtgggcccagaggacaaaacaaacctgaaggatgtgattggcgccgggttgcagcagttactggcgtccctgagggcctccatcctcgctcgggactgtgcggctgcggcggctattgtgttcttggtggaccggttcctgtatgggctcgacgtctctggaaaacttctgcaggtcgccaaaggtctccacaagttgcagccagccacgccaattgccccgcaggtggttattcgccaagcccgaatctccgtgaactcaggaaaacttttaaaagcagagtatattctgagcagtctaataagcaacaatggagcaacgggtacctggctgtacagaaatgaaagtgacaaggtcctggtgcagtcggtctgtatacagatcagagggcagattctgcaaaagctggggatgtggtacgaagcagcagagttaatatgggcctccattgtaggatatttggcacttcctcagccggataaaaagggcctctccacgtcgctaggtatactggcagacatctttgtttccatgagcaagaacgattatgaaaagtttaaaaacaatccacaaattaatttgagcctgctgaaggagtttgaccaccatttgctgtccgctgcagaagcctgcaagctggcagctgccttcagtgcctatacgccgctcttcgtgctcacagctgtgaatatccgtggcacgtgtttattgtcctacagtagttcaaatgactgtcctccagaattgaaaaacttacatctgtgtgaagccaaagaggcctttgagattggcctcctcaccaagagagatgatgagcctgttactggaaaacaggagcttcacagctttgtcaaagctgctttcggtctcaccacagtgcacagaaggctccatggggagacagggacggtccatgcagcaagtcagctctgtaaggaagcaatggggaagctgtacaatttcagcacttcctccagaagtcaggacagagaagctctgtctcaagaagttatgtctgtgattgcccaggtgaaggaacatttacaagttcaaagcttctcaaatgtagatgacagatcttatgttcccgagagtttcgagtgcaggttggataaacttatcttgcatgggcaaggggatttccaaaaaatccttgacacctattcacagcaccatacttcggtgtgtgaagtatttgaaagtgattgtggaaacaacaaaaatgaacagaaagatgcaaaaacaggagtctgcatcactgctctaaaaacagaaataaaaaacatagatactgtgagtactactcaagaaaagccacattgtcaaagagacacaggaatatcttcctccctaatgggtaagaatgttcagagggaactcagaaggggaggaaggagaaactggacccattctgatgcatttcgagtctccttggatcaagatgtggagactgagactgagccatcggactacagcaatggtgagggagctgttttcaacaagtctctgagtggcagccagacttccagtgcttggagcaacttatcagggtttagttcctctgcaagctgggaggaagtgaattatcacgttgacgacaggtcagccagaaaagagcctggcaaagaacatctggtggacactcagtgttccactgccttgtctgaggagctagagaatgacagggaaggcagagctatgcattcattgcattcacagcttcatgatctctctcttcaggaacccaacaatgacaatttggagccttctcaaaatcagccacagcaacagatgcccttgacacccttctcgcctcataataccccaggcattttcttggcccctggtgcagggcttctagaaggagctccagaaggtatccaggaagtcagaaatatgggacccagaaatacttctgctcactccagaccctcatatcgttctgcttcttggtcttctgattctggtaggcccaagaatatgggcacacatccttcagtccaaaaagaagaagcctttgaaataattgttgagtttccagaaaccaactgcgatgtcaaagacaggcaggggaaagagcagggagaagaaattagtgaaagaggcgcaggccctacatttaaagctagtccctcctgggttgacccagaaggagaaacagcagaaagcactgaagatgcacccttagactttcacagggtcctgcacaattctctgggaaacatttccatgctgccatgtagctccttcacccctaattggcctgttcaaaatcctgactccagaaaaagtggtggcccagtcgcagagcagggcatcgaccctgatgcctccacagtggatgaggaggggcaactgctcgacagcatggatgttccctgcacaaatgggcacggctctcatagactgtgcattctgagacagccgcctggtcagagggcggagacccccaattcctctgtaagcggtaacatcctcttccctgtcctcagcgaggactgcactaccacagaggaaggaaatcagcctggaaacatgctaaactgcagccagaactccagctcatcctcagtgtggtggctgaaatcacctgcattttccagtggttcttctgagggggacagcccttggtcctatctgaattccagtgggagttcttgggtttcattgccgggaaagatgaggaaagagatccttgaggctcgcaccttgcaacctgatgactttgaaaagctgttggcaggagtgaggcatgattggctgtttcagagactagagaatacgggggtttttaagcccagtcaactccaccgagcacatagtgctcttttgttaaaatattcaaaaaaatctgaactgtggacggcccaggaaactattgtctatttgggggactacttgactgtgaagaaaaaaggcagacaaagaaatgctttttgggttcatcatcttcatcaagaagaaattctggggaggtatgttgggaaagactataaggagcagaaggggctctggcaccacttcactgatgtggagcgacagatgaccgcacagcactatgtgacagaatttaacaagagactctatgaacaaaacattcccacccagatattctacatcccatccacaatactactgattttagaggacaagacaataaagggatgtatcagtgtggagccttacatactgggagaatttgtaaaattgtcaaataacacgaaagtggtgaaaacagaatacaaagccacagaatatggcttggcctatggccatttttcttatgagttttctaatcatagagatgttgtggtcgatttacaaggttgggtaaccggtaatggaaaaggactcatctacctcacagatccccagattcactccgttgatcagaaagttttcactaccaattttggaaagagaggaattttttacttctttaataaccagcatgtggaatgtaatgaaatctgccatcgtctttctttgactagaccttcaatggagaaaccatgcacatagaatacggcacagtctggtcctttggggcttgggcagggccgtgacacaggttctggccaatgatttgcaagaggaattgatcagtatcactttaagtcctgcatttaattggcagcacaagatcctgcagagcctctttccctctgccacagttatcaagaatgggtcaggagaccgctgcttctgggcataagtcctgcaaggaaagcaacatggaaaacagccccaactcacccatgagggatgaaaagcactcttgagaaaggcatgtgttgtttaagccattgagattttagagctttttgtcactatctgtcaagactgatactactggggcttttcctattgatttgggagttctttacatattaaaaaaatgtgagcctttgtgatacgaattcaatttgttttcctgtcttttgacatttgactttgcataaaagtttatctgtgcataattttatatgtagttgaattcatcaatcttttattttgtatggctttttggttatgtataatacttagatcctccttatactctgagtttctttctttttaattctcctgtatttccttctagtataattaaatctgtaaaaagt

SEQ ID NO: 106762 - DNA, 5410 bp, Homo sapiens
  Payload ID: 962
  Gene Symbol: ALPK1
  Gene Name: alpha-kinase 1
  Uniprot ID: Q96QP1
  ENST ID: ENST00000458497
  CDS Start-End: 280-4014
aattcctacttcctgaaactgaagccgtttatgagaaacagtgtgtttcagagaggctgtaccagaattaactctgctcagagttagatttgctggtcttaaagtacttttcctctttaagataaaagaagttcttctaaatcaggaatggattgaaatctaatgaaccgaaactttgggtacttcggccttcaaggggctcctttattgagaatcaatgtcttctcctaggtaattgatcaccctagacccagggacacccaattcatcgtaatcatcatgaataatcaaaaagtggtagctgtgctactgcaagagtgcaagcaagtgctggatcagctcttgttggaagcgccagatgtgtcggaagaggacaagagcgaggaccagcgctgcagagctttactccccagcgagttaaggaccctgatccaggaggcaaaggaaatgaagtggcccttcgtgcctgaaaagtggcagtacaaacaagccgtgggcccagaggacaaaacaaacctgaaggatgtgattggcgccgggttgcagcagttactggcgtccctgagggcctccatcctcgctcgggactgtgcggctgcggcggctattgtgttcttggtggaccggttcctgtatgggctcgacgtctctggaaaacttctgcaggtcgccaaaggtctccacaagttgcagccagccacgccaattgccccgcaggtggttattcgccaagcccgaatctccgtgaactcaggaaaacttttaaaagcagagtatattctgagcagtctaataagcaacaatggagcaacgggtacctggctgtacagaaatgaaagtgacaaggtcctggtgcagtcggtctgtatacagatcagagggcagattctgcaaaagctggggatgtggtacgaagcagcagagttaatatgggcctccattgtaggatatttggcacttcctcagccggataaaaagggcctctccacgtcgctaggtatactggcagacatctttgtttccatgagcaagaacgattatgaaaagtttaaaaacaatccacaaattaatttgagcctgctgaaggagtttgaccaccatttgctgtccgctgcagaagcctgcaagctggcagctgccttcagtgcctatacgccgctcttcgtgctcacagctgtgaatatccgtggcacgtgtttattgtcctacagtagttcaaatgactgtcctccagaattgaaaaacttacatctgtgtgaagccaaagaggcctttgagattggcctcctcaccaagagagatgatgagcctgttactggaaaacaggagcttcacagctttgtcaaagctgctttcggtctcaccacagtgcacagaaggctccatggggagacagggacggtccatgcagcaagtcagctctgtaaggaagcaatggggaagctgtacaatttcagcacttcctccagaagtcaggacagagaagctctgtctcaagaagttatgtctgtgattgcccaggtgaaggaacatttacaagttcaaagcttctcaaatgtagatgacagatcttatgttcccgagagtttcgagtgcaggttggataaacttatcttgcatgggcaaggggatttccaaaaaatccttgacacctattcacagcaccatacttcggtgtgtgaagtatttgaaagtgattgtggaaacaacaaaaatgaacagaaagatgcaaaaacaggagtctgcatcactgctctaaaaacagaaataaaaaacatagatactgtgagtactactcaagaaaagccacattgtcaaagagacacaggaatatcttcctccctaatgggtaagaatgttcagagggaactcagaaggggaggaaggagaaactggacccattctgatgcatttcgagtctccttggatcaagatgtggagactgagactgagccatcggactacagcaatggtgagggagctgttttcaacaagtctctgagtggcagccagacttccagtgcttggagcaacttatcagggtttagttcctctgcaagctgggaggaagtgaattatcacgttgacgacaggtcagccagaaaagagcctggcaaagaacatctggtggacactcagtgttccactgccttgtctgaggagctagagaatgacagggaaggcagagctatgcattcattgcattcacagcttcatgatctctctcttcaggaacccaacaatgacaatttggagccttctcaaaatcagccacagcaacagatgcccttgacacccttctcgcctcataataccccaggcattttcttggcccctggtgcagggcttctagaaggagctccagaaggtatccaggaagtcagaaatatgggacccagaaatacttctgctcactccagaccctcatatcgttctgcttcttggtcttctgattctggtaggcccaagaatatgggcacacatccttcagtccaaaaagaagaagcctttgaaataattgttgagtttccagaaaccaactgcgatgtcaaagacaggcaggggaaagagcagggagaagaaattagtgaaagaggcgcaggccctacatttaaagctagtccctcctgggttgacccagaaggagaaacagcagaaagcactgaagatgcacccttagactttcacagggtcctgcacaattctctgggaaacatttccatgctgccatgtagctccttcacccctaattggcctgttcaaaatcctgactccagaaaaagtggtggcccagtcgcagagcagggcatcgaccctgatgcctccacagtggatgaggaggggcaactgctcgacagcatggatgttccctgcacaaatgggcacggctctcatagactgtgcattctgagacagccgcctggtcagagggcggagacccccaattcctctgtaagcggtaacatcctcttccctgtcctcagcgaggactgcactaccacagaggaaggaaatcagcctggaaacatgctaaactgcagccagaactccagctcatcctcagtgtggtggctgaaatcacctgcattttccagtggttcttctgagggggacagcccttggtcctatctgaattccagtgggagttcttgggtttcattgccgggaaagatgaggaaagagatccttgaggctcgcaccttgcaacctgatgactttgaaaagctgttggcaggagtgaggcatgattggctgtttcagagactagagaatacgggggtttttaagcccagtcaactccaccgagcacatagtgctcttttgttaaaatattcaaaaaaatctgaactgtggacggcccaggaaactattgtctatttgggggactacttgactgtgaagaaaaaaggcagacaaagaaatgctttttgggttcatcatcttcatcaagaagaaattctggggaggtatgttgggaaagactataaggagcagaaggggctctggcaccacttcactgatgtggagcgacagatgaccgcacagcactatgtgacagaatttaacaagagactctatgaacaaaacattcccacccagatattctacatcccatccacaatactactgattttagaggacaagacaataaagggatgtatcagtgtggagccttacatactgggagaatttgtaaaattgtcaaataacacgaaagtggtgaaaacagaatacaaagccacagaatatggcttggcctatggccatttttcttatgagttttctaatcatagagatgttgtggtcgatttacaaggttgggtaaccggtaatggaaaaggactcatctacctcacagatccccagattcactccgttgatcagaaagttttcactaccaattttggaaagagaggaattttttacttctttaataaccagcatgtggaatgtaatgaaatctgccatcgtctttctttgactagaccttcaatggagaaaccatgcacatagaatacggcacagtctggtcctttggggcttgggcagggccgtgacacaggttctggccaatgatttgcaagaggaattgatcagtatcactttaagtcctgcatttaattggcagcacaagatcctgcagagcctctttccctctgccacagttatcaagaatgggtcaggagaccgctgcttctgggcataagtcctgcaaggaaagcaacatggaaaacagccccaactcacccatgagggatgaaaagcactcttgagaaaggcatgtgttgtttaagccattgagattttagagctttttgtcactatctgtcaagactgatactactggggcttttcctattgatttgggagttctttacatattaaaaaaatgtgagcctttgtgatacgaattcaatttgttttcctgtcttttgacatttgactttgcataaaagtttatctgtgcataattttatatgtagttgaattcatcaatcttttattttgtatggctttttggttatgtataatacttagatcctccttatactctgagtttctttctttttaattctcctgtatttccttctagtataattaaatctgtaaaaagtaagatggaagagtggtacagttttctttatccagtctgtccttgatgggcatttaggtagactggataaagaaaatgtggtacatatacaccatggaacactatgtgtattaatccactctcacactgctatgaagagatacctgagactgggtaatttagaaagaaaagaggtttaattaactcacagttccacatggctggggagacctcaggaaacttacaatcatggcagaaggcacctcttcatagggtagcaggagagagaatgagtgccagcaggggaaatgccagatgcttataaagccatcagatcttgtgagaattcattcactctcacgagaacagcatgggaaaaactgcctcaattacctcctaccaggtccttcccatgacacatgggaattatgggactacaattcgagatgagatttgggtggggacacaaagccaaaccatatcacaatgtaaccataaaaaagaatgagatcatgtcctttgcagggacatggatagagctggaggccattatttttagcaaactaatgcaagaacagaaaactaaataccacttgttctcacttataggtgagagctaagtgatgagagtaggtggacacatagagggaacaacacacaccagggcttatcagagggtggacagtgggaggagggagaggatcaggaaaaataactaatgggtactaggctgaatacctgggtgatgaagtaattcgcacaacaaacccccatgacacaaacctgcacatgtacccctgaacttaaaataaaagt

SEQ ID NO: 106763 - DNA, 1008 bp, Homo sapiens
  Payload ID: 962
  Gene Symbol: ALPK1
  Gene Name: alpha-kinase 1
  ENST ID: ENST00000515330
  CDS Start-End: 227-733
aggctgtaccagaattaactctgctcagagttagatttgctggtcttaaagtacttttcctctttaagataaaagaagttcttctaaatcaggaatggattgaaatctaatgaaccgaaactttgggtacttcggccttcaaggggctcctttattgagaatcaatgtcttctcctaggtaattgatcaccctagacccagggacacccaattcatcgtaatcatcatgaataatcaaaaagtggtagctgtgctactgcaagagtgcaagcaagtgctggatcagctcttgttggaagcgccagatgtgtcggaagaggacaagagcgaggaccagcgctgcagagctttactccccagcgagttaaggaccctgatccaggaggcaaaggaaatgaagtggcccttcgtgcctgaaaagtggcagtacaaacaagccgtgggcccagaggacaaaacaaacctgaaggatgtgattggcgccgggttgcagcagttactggcgtccctgagggcctccatcctcgctcgggactgtgcggctgcggcggctattgtgttcttggtggaccggttcctgtatgggctcgacgtctctggaaaacttctgcaggtcgccaaaggtctccacaagttgcagccagccacgccaattgccccgcaggtggttattcgccaagcccgaatctccgtgaactcagatactgtccaacttcccaccttaccaacttaggaaaacttcatctttcttttcagttttatagatgatgtcattgttgattttaaattataaaatggaatgcttccaaaggaggttacagttcctgctgcaatatatcagtcttagaacatgaacaacttgtaattgttaagtgcatgttcaaagctaattgtgtggcatttggttgctgcttttcaggaaaacttttaaaagcagagtatattctgagcagtctaataagcaacaatggagcaacgggtacctggctgtacagaaatgaaagtgac

SEQ ID NO: 106764 - DNA, 3931 bp, Homo sapiens
  Payload ID: 962
  Gene Symbol: ALPK1
  Gene Name: alpha-kinase 1
  ENST ID: ENST00000509722
  CDS Start-End: 191-592
acagtgtgtttcagagaggctgtaccagaattaactctgctcagagttagatttgctggtcttaaagtacttttcctctttaagataaaagaagttcttctaaatcaggaatggattgaaatctaatgaaccgaaactttgggtaattgatcaccctagacccagggacacccaattcatcgtaatcatcatgaataatcaaaaagtggtagctgtgctactgcaagagtgcaagcaagtgctggatcagctcttgttggaagcgccagatgtgtcggaagaggacaagagcgaggaccagcgctgcagaggcgtccctgagggcctccatcctcgctcgggactgtgcggctgcggcggctattgtgttcttggtggaccggttcctgtatgggctcgacgtctctggaaaacttctgcaggtcgccaaaggtctccacaagttgcagccagccacgccaattgccccgcaggtggttattcgccaagcccgaatctccgtgaactcaggaaaacttttaaaagcagagtatattctgagcagtctaataagcaacaatggagcaacgggtacctggctgtacagaaatgaaagtgacaaggtcctggtgcagtcggtctgtatacagatcagagggcagattctgcaaaagctggggatgtggtacgaagcagcagagttaatatgggcctccattgtaggatatttggcacttcctcagccggataaaaagggcctctccacgtcgctaggtatactggcagacatctttgtttccatgagcaagaacgattatgaaaagtttaaaaacaatccacaaattaatttgagcctgctgaaggagtttgaccaccatttgctgtccgctgcagaagcctgcaagctggcagctgccttcagtgcctatacgccgctcttcgtgctcacagctgtgaatatccgtggcacgtgtttattgtcctacagtagttcaaatgactgtcctccagaattgaaaaacttacatctgtgtgaagccaaagaggcctttgagattggcctcctcaccaagagagatgatgagcctgttactggaaaacaggagcttcacagctttgtcaaagctgctttcggtctcaccacagtgcacagaaggctccatggggagacagggacggtccatgcagcaagtcagctctgtaaggaagcaatggggaagctgtacaatttcagcacttcctccagaagtcaggacagagaagctctgtctcaagaagttatgtctgtgattgcccaggtgaaggaacatttacaagttcaaagcttctcaaatgtagatgacagatcttatgttcccgagagtttcgagtgcaggttggataaacttatcttgcatgggcaaggggatttccaaaaaatccttgacacctattcacagcaccatacttcggtgtgtgaagtatttgaaagtgattgtggaaacaacaaaaatgaacagaaagatgcaaaaacaggagtctgcatcactgctctaaaaacagaaataaaaaacatagatactgtgagtactactcaagaaaagccacattgtcaaagagacacaggaatatcttcctccctaatgggtaagaatgttcagagggaactcagaaggggaggaaggagaaactggacccattctgatgcatttcgagtctccttggatcaagatgtggagactgagactgagccatcggactacagcaatggtgagggagctgttttcaacaagtctctgagtggcagccagacttccagtgcttggagcaacttatcagggtttagttcctctgcaagctgggaggaagtgaattatcacgttgacgacaggtcagccagaaaagagcctggcaaagaacatctggtggacactcagtgttccactgccttgtctgaggagctagagaatgacagggaaggcagagctatgcattcattgcattcacagcttcatgatctctctcttcaggaacccaacaatgacaatttggagccttctcaaaatcagccacagcaacagatgcccttgacacccttctcgcctcataataccccaggcattttcttggcccctggtgcagggcttctagaaggagctccagaaggtatccaggaagtcagaaatatgggacccagaaatacttctgctcactccagaccctcatatcgttctgcttcttggtcttctgattctggtaggcccaagaatatgggcacacatccttcagtccaaaaagaagaagcctttgaaataattgttgagtttccagaaaccaactgcgatgtcaaagacaggcaggggaaagagcagggagaagaaattagtgaaagaggcgcaggccctacatttaaagctagtccctcctgggttgacccagaaggagaaacagcagaaagcactgaagatgcacccttagactttcacagggtcctgcacaattctctgggaaacatttccatgctgccatgtagctccttcacccctaattggcctgttcaaaatcctgactccagaaaaagtggtggcccagtcgcagagcagggcatcgaccctgatgcctccacagtggatgaggaggggcaactgctcgacagcatggatgttccctgcacaaatgggcacggctctcatagactgtgcattctgagacagccgcctggtcagagggcggagacccccaattcctctgtaagcggtaacatcctcttccctgtcctcagcgaggactgcactaccacagaggaaggaaatcagcctggaaacatgctaaactgcagccagaactccagctcatcctcagtgtggtggctgaaatcacctgcattttccagtggttcttctgagggggacagcccttggtcctatctgaattccagtgggagttcttgggtttcattgccgggaaagatgaggaaagagatccttgaggctcgcaccttgcaacctgatgactttgaaaagctgttggcaggagtgaggcatgattggctgtttcagagactagagaatacgggggtttttaagcccagtcaactccaccgagcacatagtgctcttttgttaaaatattcaaaaaaatctgaactgtggacggcccaggaaactattgtctatttgggggactacttgactgtgaagaaaaaaggcagacaaagaaatgctttttgggttcatcatcttcatcaagaagaaattctggggaggtatgttgggaaagactataaggagcagaaggggctctggcaccacttcactgatgtggagcgacagatgaccgcacagcactatgtgacagaatttaacaagagactctatgaacaaaacattcccacccagatattctacatcccatccacaatactactgattttagaggacaagacaataaagggatgtatcagtgtggagccttacatactgggagaatttgtaaaattgtcaaataacacgaaagtggtgaaaacagaatacaaagccacagaatatggcttggcctatggccatttttcttatgagttttctaatcatagagatgttgtggtcgatttacaaggttgggtaaccggtaatggaaaaggactcatctacctcacagatccccagattcactccgttgatcagaaagttttcactaccaattttggaaagagaggaattttttacttctttaataaccagcatgtggaatgtaatgaaatctgccatcgtctttctttgactagaccttcaatggagaaaccatgcacatagaatacggcacagtctggtcctttggggcttgggcagggccgtgacacaggttctggccaatgatttgcaagaggaattgatcagtatcactttaagtcctgcatttaattggcagcacaagatcctgcagagcctctttccctctgccacagttatcaaga

SEQ ID NO: 106765 - DNA, 569 bp, Homo sapiens
  Payload ID: 962
  Gene Symbol: ALPK1
  Gene Name: alpha-kinase 1
  ENST ID: ENST00000515106
  CDS Start-End: 222-551
gtaccagaattaactctgctcagagttagatttgctggtcttaaagtacttttcctctttaagataaaagaagttcttctaaatcaggaatggattgaaatctaatgaaccgaaactttgggtacttcggccttcaaggggctcctttattgagaatcaatgtcttctcctaggtaattgatcaccctagacccagggacacccaattcatcgtaatcatcatgaataatcaaaaagtggtagctgtgctactgcaagagtgcaagcaagtgctggatcagctcttgttggaagcgccagatgtgtcggaagaggacaagagcgaggaccagcgctgcagaggcgtccctgagggcctccatcctcgctcgggactgtgcggctgcggcggctattgtgttcttggtggaccggttcctgtatgggctcgacgtctctggaaaacttctgcaggtcgccaaaggtctccacaagttgcagccagccacgccaattgccccgcaggtggttattcgccaagcccgaatctccgtgaactcaggaccacttgactaagctgacaatagagc

SEQ ID NO: 106766 - DNA, 2295 bp, Homo sapiens
  Payload ID: 962
  Gene Symbol: ALPK1
  Gene Name: alpha-kinase 1
  ENST ID: ENST00000505127
  CDS Start-End: 241-1155
agtgtgtttcagagaggctgtaccagaattaactctgctcagagttagatttgctggtcttaaagtacttttcctctttaagataaaagaagttcttctaaatcaggaatggattgaaatctaatgaaccgaaactttgggtacttcggccttcaaggggctcctttattgagaatcaatgtcttctcctaggtaattgatcaccctagacccagggacacccaattcatcgtaatcatcatgaataatcaaaaagtggtagctgtgctactgcaagagtgcaagcaagtgctggatcagctcttgttggaagcgccagatgtgtcggaagaggacaagagcgaggaccagcgctgcagagctttactccccagcgagttaaggaccctgatccaggaggcaaaggaaatgaagtggcccttcgtgcctgaaaagtggcagtacaaacaagccgtgggcccagaggacaaaacaaacctgaaggatgtgattggcgccgggttgcagcagttactggcgtccctgagggcctccatcctcgctcgggactgtgcggctgcggcggctattgtgttcttggtggaccggttcctgtatgggctcgacgtctctggaaaacttctgcaggtcgccaaaggtctccacaagttgcagccagccacgccaattgccccgcaggtggttattcgccaagcccgaatctccgtgaactcaggaaaacttttaaaagcagagtatattctgagcagtctaataagcaacaatggagcaacgggtacctggctgtacagaaatgaaagtgacaaggtcctggtgcagtcggtctgtatacagatcagagggcagattctgcaaaagctggggatgtggtacgaagcagcagagttaatatgggcctccattgtaggatatttggcacttcctcagccggataaaaagggcctctccacgtcgctaggtatactggcagacatctttgtttccatgagcaagaacgattatgaaaagtttaaaaacaatccacaaattaatttgagcctgctgaaggagtttgaccaccatttgctgtccgctgcagaagcctgcaagctggcagctgccttcagtgcctatacgccgctcttcgtgctcacagctgtggtgctcttttgttaaaatattcaaaaaaatctgaactgtggacggcccaggaaactattgtctatttgggggactacttgactgtgaagaaaaaaggcagacaaagaaatgctttttgggttcatcatcttcatcaagaagaaattctggggaggtatgttgggaaagactataaggagcagaaggggctctggcaccacttcactgatgtggagcgacagatgaccgcacagcactatgtgacagaatttaacaagagactctatgaacaaaacattcccacccagatattctacatcccatccacaatactactgattttagaggacaagacaataaagggatgtatcagtgtggagccttacatactgggagaatttgtaaaattgtcaaataacacgaaagtggtgaaaacagaatacaaagccacagaatatggcttggcctatggccatttttcttatgagttttctaatcatagagatgttgtggtcgatttacaaggttgggtaaccggtaatggaaaaggactcatctacctcacagatccccagattcactccgttgatcagaaagttttcactaccaattttggaaagagaggaattttttacttctttaataaccagcatgtggaatgtaatgaaatctgccatcgtctttctttgactagaccttcaatggagaaaccatgcacatagaatacggcacagtctggtcctttggggcttgggcagggccgtgacacaggttctggccaatgatttgcaagaggaattgatcagtatcactttaagtcctgcatttaattggcagcacaagatcctgcagagcctctttccctctgccacagttatcaagaatgggtcaggagaccgctgcttctgggcataagtcctgcaaggaaagcaacatggaaaacagccccaactcacccatgagggatgaaaagcactcttgagaaaggcatgtgttgtttaagccattgagattttagagctttttgtcactatctgtcaagactgatactactggggcttttcctattgatttgggagttctttacatattaaaaaaatgtgagcctttgtgatacgaattcaatttgttttcctgtcttttgacatttgactttgcataaaagtttatctgtgc

SEQ ID NO: 106767 - DNA, 5203 bp, Homo sapiens
  Payload ID: 962
  Gene Symbol: ALPK1
  Gene Name: alpha-kinase 1
  Uniprot ID: Q96QP1
  ENST ID: ENST00000504176
  CDS Start-End: 307-3807
aattcctacttcctgaaactgaagccgtttatgagaaacagtgtgtttcagagaggctgtaccagaattaactctgctcagagttagatttgctggtcttaaagtacttttcctctttaagataaaagaagttcttctaaatcaggaatggattgaaatctaatgaaccgaaactttgggtaattgatcaccctagacccagggacacccaattcatcgtaatcatcatgaataatcaaaaagtggtagctgtgctactgcaagagtgcaagcaagtgctggatcagctcttgttggaagcgccagatgtgtcggaagaggacaagagcgaggaccagcgctgcagaggcgtccctgagggcctccatcctcgctcgggactgtgcggctgcggcggctattgtgttcttggtggaccggttcctgtatgggctcgacgtctctggaaaacttctgcaggtcgccaaaggtctccacaagttgcagccagccacgccaattgccccgcaggtggttattcgccaagcccgaatctccgtgaactcaggaaaacttttaaaagcagagtatattctgagcagtctaataagcaacaatggagcaacgggtacctggctgtacagaaatgaaagtgacaaggtcctggtgcagtcggtctgtatacagatcagagggcagattctgcaaaagctggggatgtggtacgaagcagcagagttaatatgggcctccattgtaggatatttggcacttcctcagccggataaaaagggcctctccacgtcgctaggtatactggcagacatctttgtttccatgagcaagaacgattatgaaaagtttaaaaacaatccacaaattaatttgagcctgctgaaggagtttgaccaccatttgctgtccgctgcagaagcctgcaagctggcagctgccttcagtgcctatacgccgctcttcgtgctcacagctgtgaatatccgtggcacgtgtttattgtcctacagtagttcaaatgactgtcctccagaattgaaaaacttacatctgtgtgaagccaaagaggcctttgagattggcctcctcaccaagagagatgatgagcctgttactggaaaacaggagcttcacagctttgtcaaagctgctttcggtctcaccacagtgcacagaaggctccatggggagacagggacggtccatgcagcaagtcagctctgtaaggaagcaatggggaagctgtacaatttcagcacttcctccagaagtcaggacagagaagctctgtctcaagaagttatgtctgtgattgcccaggtgaaggaacatttacaagttcaaagcttctcaaatgtagatgacagatcttatgttcccgagagtttcgagtgcaggttggataaacttatcttgcatgggcaaggggatttccaaaaaatccttgacacctattcacagcaccatacttcggtgtgtgaagtatttgaaagtgattgtggaaacaacaaaaatgaacagaaagatgcaaaaacaggagtctgcatcactgctctaaaaacagaaataaaaaacatagatactgtgagtactactcaagaaaagccacattgtcaaagagacacaggaatatcttcctccctaatgggtaagaatgttcagagggaactcagaaggggaggaaggagaaactggacccattctgatgcatttcgagtctccttggatcaagatgtggagactgagactgagccatcggactacagcaatggtgagggagctgttttcaacaagtctctgagtggcagccagacttccagtgcttggagcaacttatcagggtttagttcctctgcaagctgggaggaagtgaattatcacgttgacgacaggtcagccagaaaagagcctggcaaagaacatctggtggacactcagtgttccactgccttgtctgaggagctagagaatgacagggaaggcagagctatgcattcattgcattcacagcttcatgatctctctcttcaggaacccaacaatgacaatttggagccttctcaaaatcagccacagcaacagatgcccttgacacccttctcgcctcataataccccaggcattttcttggcccctggtgcagggcttctagaaggagctccagaaggtatccaggaagtcagaaatatgggacccagaaatacttctgctcactccagaccctcatatcgttctgcttcttggtcttctgattctggtaggcccaagaatatgggcacacatccttcagtccaaaaagaagaagcctttgaaataattgttgagtttccagaaaccaactgcgatgtcaaagacaggcaggggaaagagcagggagaagaaattagtgaaagaggcgcaggccctacatttaaagctagtccctcctgggttgacccagaaggagaaacagcagaaagcactgaagatgcacccttagactttcacagggtcctgcacaattctctgggaaacatttccatgctgccatgtagctccttcacccctaattggcctgttcaaaatcctgactccagaaaaagtggtggcccagtcgcagagcagggcatcgaccctgatgcctccacagtggatgaggaggggcaactgctcgacagcatggatgttccctgcacaaatgggcacggctctcatagactgtgcattctgagacagccgcctggtcagagggcggagacccccaattcctctgtaagcggtaacatcctcttccctgtcctcagcgaggactgcactaccacagaggaaggaaatcagcctggaaacatgctaaactgcagccagaactccagctcatcctcagtgtggtggctgaaatcacctgcattttccagtggttcttctgagggggacagcccttggtcctatctgaattccagtgggagttcttgggtttcattgccgggaaagatgaggaaagagatccttgaggctcgcaccttgcaacctgatgactttgaaaagctgttggcaggagtgaggcatgattggctgtttcagagactagagaatacgggggtttttaagcccagtcaactccaccgagcacatagtgctcttttgttaaaatattcaaaaaaatctgaactgtggacggcccaggaaactattgtctatttgggggactacttgactgtgaagaaaaaaggcagacaaagaaatgctttttgggttcatcatcttcatcaagaagaaattctggggaggtatgttgggaaagactataaggagcagaaggggctctggcaccacttcactgatgtggagcgacagatgaccgcacagcactatgtgacagaatttaacaagagactctatgaacaaaacattcccacccagatattctacatcccatccacaatactactgattttagaggacaagacaataaagggatgtatcagtgtggagccttacatactgggagaatttgtaaaattgtcaaataacacgaaagtggtgaaaacagaatacaaagccacagaatatggcttggcctatggccatttttcttatgagttttctaatcatagagatgttgtggtcgatttacaaggttgggtaaccggtaatggaaaaggactcatctacctcacagatccccagattcactccgttgatcagaaagttttcactaccaattttggaaagagaggaattttttacttctttaataaccagcatgtggaatgtaatgaaatctgccatcgtctttctttgactagaccttcaatggagaaaccatgcacatagaatacggcacagtctggtcctttggggcttgggcagggccgtgacacaggttctggccaatgatttgcaagaggaattgatcagtatcactttaagtcctgcatttaattggcagcacaagatcctgcagagcctctttccctctgccacagttatcaagaatgggtcaggagaccgctgcttctgggcataagtcctgcaaggaaagcaacatggaaaacagccccaactcacccatgagggatgaaaagcactcttgagaaaggcatgtgttgtttaagccattgagattttagagctttttgtcactatctgtcaagactgatactactggggcttttcctattgatttgggagttctttacatattaaaaaaatgtgagcctttgtgatacgaattcaatttgttttcctgtcttttgacatttgactttgcataaaagtttatctgtgcataattttatatgtagttgaattcatcaatcttttattttgtatggctttttggttatgtataatacttagatcctccttatactctgagtttctttctttttaattctcctgtatttccttctagtataattaaatctgtaaaaagtaagatggaagagtggtacagttttctttatccagtctgtccttgatgggcatttaggtagactggataaagaaaatgtggtacatatacaccatggaacactatgtgtattaatccactctcacactgctatgaagagatacctgagactgggtaatttagaaagaaaagaggtttaattaactcacagttccacatggctggggagacctcaggaaacttacaatcatggcagaaggcacctcttcatagggtagcaggagagagaatgagtgccagcaggggaaatgccagatgcttataaagccatcagatcttgtgagaattcattcactctcacgagaacagcatgggaaaaactgcctcaattacctcctaccaggtccttcccatgacacatgggaattatgggactacaattcgagatgagatttgggtggggacacaaagccaaaccatatcacaatgtaaccataaaaaagaatgagatcatgtcctttgcagggacatggatagagctggaggccattatttttagcaaactaatgcaagaacagaaaactaaataccacttgttctcacttataggtgagagctaagtgatgagagtaggtggacacatagagggaacaacacacaccagggcttatcagagggtggacagtgggaggagggagaggatcaggaaaaataactaatgggtactaggctgaatacctgggtgatgaagtaattcgcacaacaaacccccatgacacaaacctgcacatgtacccctgaacttaaaataaaagt

SEQ ID NO: 106768 - DNA, 7303 bp, Homo sapiens
  Payload ID: 963
  Gene Symbol: ALPK2
  Gene Name: alpha-kinase 2
  Uniprot ID: Q86TB3
  ENST ID: ENST00000361673
  CDS Start-End: 215-6727
aggaagagatgaactttctggaagcagacccatctatgctttgacctgatcatggaagaccctgagccctataaactcctttgaatccctgtcccgggaacagggacacccaatcaatgcctcacacacagcctggggaatccacagctgagccagccctcctacaacatttcttggacaaagagtactgaaaaatttggtgcggcatgaaaggatgaaagactccgaagggccccagaggcccccgctgtgttttttatctacattgctttcccagaaggttcctgagaagtcagacgctgtgcttcgctgcataatatctggtcagcccaagccagaggtaacttggtataagaatggtcaggccatcgatgggagtggcattatttccaactatgaattctttgagaatcagtatattcatgtgttacatctctcttgctgtaccaaaaatgatgctgctgtctatcaaatctcggctaaaaactcttttggaatgatctgttgttctgcttccgttgaggttgagtgctcatcagagaacccacaattgtctcctaacctggaagatgacagggacaggggttggaaacatgaaacagggacacatgaagaagaaagggcaaatcagattgatgagaaggaacatccttataaggaagaagaaagcatctccccgggcactcccaggtcagctgactcctccccctccaaatccaaccattcactctccctccagtcattgggcaatcttgacattagtgtgtccagttctgaaaatcctttgggtgttaaaggaacaaggcacactggagaggcttatgatccaagtaacacagaagaaattgcaaatgggttgctttttcttaattcaagtcatatttatgaaaaacaagacagatgttgccacaagacagtgcattccatggcatcaaagttcacggatggtgacctgaacaatgatggtcctcatgatgaaggcttacgctctagtcagcaaaatcccaaagtacagaaatacattagcttcagcctcccgctatctgaggcaactgcacacatttacccaggtgacagtgccgtggccaacaaacaacccagcccacagctttccagtgaagactctgacagtgactatgaactttgcccagagataaccctaacctacaccgaggagttttcagatgatgacctggagtatctggaatgttctgatgttatgacggattactctaatgcagtttggcaaaggaacctgctggggactgagcatgtttttttattagaaagcgatgacgaagagatggaattcggtgagcattgcctgggtgggtgtgagcatttcctcagtggaatgggttgtgggtctcgggtgtcgggtgacgctgggcctatggttgccactgctggcttctgtggtcatcactcacaaccccaagaagttggggtgaggagcagcagagtctccaagcacggtccctcatccccacaaacagggatgactctcattttgggacctcaccaggatggaacgtcttcagtgacagaacaggggagatataaactccccactgctcccgaggctgctgaaaatgattatccaggaattcaaggagaaaccagagacagccaccaagcaagagaggaatttgccagtgacaatctgctcaacatggatgaatcagtaagagagacagagatgaagctcttgtctggtgagtcagaaaactcagggatgagccagtgttgggagacggcagctgacaagagagtggggggaaaggacttatggagcaagaggggttcaaggaaatctgccagggtgaggcagccgggaatgaagggaaatcccaagaagccgaatgccaacctgagagaaagtacaacagaaggtacccttcatctctgctctgccaaagaatctgctgagcccccactaacccagagtgataaaagagagacttctcacaccacagcagcagcgactggtcggagttcccatgctgatgcaagagaatgtgctatttcaacccaggcagagcaagaagcaaaaacccttcaaacttcaacagactcagtctccaaagaaggcaacacaaattgcaagggagaaggcatgcaagttaatactctatttgaaacaagccaggttccagactggagtgatcctcctcaggtacaagttcaggaaacagtcagagagacaatctcttgcagccagatgccagctttctcagagcctgctggggaggagtccccattcactgggaccacaacaatttccttctcaaacttaggaggggtccacaaggaaaatgcatcattagctcaacactcggaggtcaaaccctgtacctgtggtccacagcatgaagaaaaacaagacagagatggcaacatacctgacaatttcagggaagacctaaaatatgagcagagcatctcagaagccaatgatgagactatgtccccaggtgtgttctcaaggcatctccccaaggatgctcgtgctgacttcagggagcctgtggctgtctctgttgcttcccctgaacccacagatactgccctcaccctggaaaatgtgtgtgatgagccaagggacagagaagcagtgtgtgcaatggagtgttttgaggctggtgaccaaggaacgtgttttgataccatagattctcttgttgggagaccagttgataaatattcgcctcaagaaatttgctctgtagatacggaactggcagaaggtcaaaacaaagtatctgatttatgttcttctaatgacaagacactggaagtcttttttcagacacaagtgtctgagacttcagtgtctacgtgcaaaagcagcaaggacggcaactcagtcatgtcccctctttttaccagtactttcaccttgaacatttcacacacagctagtgaaggtgccacaggagaaaatctagccaaggtggagaattccacctacccactggcctccacagtacatgctggccaggagcagccaagccccagcaactcaggagggcttgatgaaacacagctcctttcttctgagaacaatcctttagtgcaatttaaagaaggaggtgacaagagccccagtcctagtgccgcagacaccacagccacaccagccagttatagttcaattgtgagttttccttgggagaagccaacaacattaactgctaataatgagtgctttcaagcgaccagggagactgaggacacatcaactgttaccattgccaccgaagtccacccagccaaataccttgctgtgtcaattcctgaggacaagcatgcaggtggcactgaggagaggttccctcgtgcatcccatgaaaaggtttcccaatttccttcccaagtgcagttggatcatattttaagtggtgctaccatcaaatctacaaaagagctactttgcagggcacccagtgtgccaggagtcccacaccatgtcctgcagctcccagagggagagggtttctgcagtaattcccctcttcaggttgataacctgtctggagataagagccagactgtggacagagcagactttaggagctatgaagagaatttccaagaaagaggaagtgaaacaaagcagggggtccagcagcagagcctgtcccagcagggttctctttctgcacctgatttccaacaaagtttgcctacgacatctgctgcacaagaggaaagaaacttggtgcccacggcccactcacccgcaagctctagggaaggagcagggcagcgctcaggttgggggacgagggtctccgtggtggctgaaactgctggggaagaagacagtcaggctctgagcaacgttccatctctctctgatatccttttggaagagtctaaagaatatagacctggaaattgggaggcaggcaacaagctgaagattataactctagaggcttccgcttctgaaatctggccaccacgacaactgacaaattctgagagcaaggcatcagacggtggtctcataattcctgacaaggtctgggctgtacctgatagtctaaaggcagatgctgttgtgcctgaattggccccctctgaaatagcagcattggctcacagtccagaggatgctgagtcagcccttgctgatagcagagaaagccataaaggcgaagagcccaccatcagtgtacattggagaagtctttcttcccggggtttcagccaacccagactcctggagtcatccgtggaccctgtagatgaaaaggagttatctgtcacagattcactgtcagcggcttctgaaactggagggaaggaaaatgttaacaatgtgagtcaagaccaggaggaaaaacaactcaagatggatcacactgccttctttaaaaagtttctgacctgccctaaaatcctagagtcctctgtagatcccattgatgagataagtgtgatagagtacaccagggctggaaaaccagagccctctgaaaccacaccacagggcgccagagaagggggtcaatcaaatgacggaaacatgggccacgaagcggaaatccagccggccattttgcaagttccatgtctccagggaaccattctgagtgaaaatagaatcagcagaagccaagaaggcagtatgaagcaggaggctgaacaaattcaacctgaggaggcaaaaactgccatttggcaagtcctgcaacccagcgaaggcggtgaaagaattccaagtggatgtagcataggccaaatacaagaaagcagtgatgggagcttaggggaggctgagcaaagcaaaaaggacaaagcagaattgatttcccccacttcacctctttctagttgtcttccaataatgactcacgcttctcttggggttgacacgcacaactccacaggccaaattcatgacgtccctgaaaatgacatagttgagcccagaaagcgtcagtatgtgtttcctgtttcacagaaaaggggaactattgagaatgagcgtgggaaacctttgccctcttctcctgatcttaccaggttcccttgtacttcatctcctgaaggaaatgtcacagactttttgataagccacaaaatggaggaacctaaaatagaggtgcttcaaattggggaaaccaaacccccaagctcatctagctcctcagcgaagaccttggcatttatttcaggagaacgtgagttagagaaagcccctaaattactgcaggatccatgtcaaaagggcaccctgggctgtgcgaaaaagtccagggagagagagaagtccctggaagcccgagcaggcaaatcgccagggaccctcacagcagtgacggggtcagaggaggtcaagaggaagccagaagccccaggcagtggacatttagctgagggagtaaagaagaaaattttgtccagggtggcagcactgaggctgaaactggaagaaaaggaaaatatcagaaagaactcagcctttcttaaaaagatgcccaaactcgaaacatcattatcacacacagaagagaaacaagacccaaaaaagccatcttgcaaaagagaaggaagagctccagtattactgaaaaagatccaagctgagatgttccctgaacactctggaaatgtaaaattaagctgccaatttgcagaaattcatgaagattctactatctgctggacaaaagattcaaagtccatagcccaagtgcagagaagtgcaggggacaactccactgtttcctttgccatcgtgcaagccagtccgaaggaccagggactctattactgctgcatcaagaacagctacggaaaagtgactgctgaatttaacctcacagctgaagttctcaaacagctgtcaagtcgccaggatactaaaggatgtgaagagattgaattcagccaactcatcttcaaagaagacttcctccatgacagctactttgggggccgcctgcgtggtcagatcgccacggaggagctgcactttggagaaggggttcaccgcaaagccttccgcagcacagtgatgcacggcctcatgcctgtcttcaaacctggccatgcctgtgtgcttaaggtgcacaatgccattgcctatgggaccagaaataatgatgagctcatccaaaggaactacaaactcgctgcccaggaatgctatgttcaaaatactgccaggtattatgccaagatctacgctgctgaagcacagcctctggaaggctttggagaagtacctgagatcattcctatttttcttatccatcggcctgagaacaatatcccgtatgctacagtggaggaggagctgattggagaatttgtgaagtattccatcagggatgggaaagaaataaacttcttgagaagagaatcagaagctggtcagaaatgttgcaccttccagcactgggtgtaccagaaaacaagtggctgcctcctggtgacggacatgcaaggtgtaggaatgaagctaactgacgttggcatagcaacgctggctaaagggtacaagggatttaaaggcaactgttccatgaccttcattgatcagtttaaagcactacaccagtgtaacaagtattgcaaaatgctgggactgaaatcccttcaaaacaacaaccagaaacagaagcagccgagcattgggaaaagcaaagttcaaacaaactctatgacaataaagaaggcagggcctgagaccccaggcgaaaagaaaacctaacgtccctgggtaacctaatggccactggctagcagcacacaatctcgccagggaaaatctgaggccacacaggagagaatatacagcctgcagagagtgcgtggcaatccttactcccagccgactgtgcgccaagatgcttctaaacccatcacctgctgtcttcactcaaatgatttcagaacaggatttgcgaccaggtttatggggagattgaatcaacgattggtctcaaagacagtccattctttatatacatgtttagcatttttaccaacctcacatcatgtgtatatttgtgtatttgcacatggttgtgctgtcgaggacctggtgctgagaagagtctgttcacagccaaaattcttcccactgtcattcctaacctgggatttctagacacatcctgctgtgatgtaaacagaaatcacgaattcgctcactggatcaagttgttccactggtgtctaatacgctattgttgccggaggtgggttctgtgacgtgaagccatttcccatcattcaacagccagttacaattttctgtttaattaaattcatatttaaacaaaaa

SEQ ID NO: 106769 - DNA, 10917 bp, Homo sapiens
  Payload ID: 964
  Gene Symbol: ALPK3
  Gene Name: alpha-kinase 3
  Uniprot ID: Q96L96
  ENST ID: ENST00000258888
  CDS Start-End: 168-5891
gtatcaggactcagcccatttccccctctggtgctgagaaatggaggccgaaggagtgatctagaagtgttaattgagcccctaatctatgctagttactgggggtgttgggggagacaggagagagatcccacggggttccggcctcccagggactcaggtcactaatggaggtggcttggcttgtctatgtgctgggccaacagccactggcgaggcaaggcgagggtcagtcacggctggtgccaggaagagggctggttctttggctccctggtctcccgcggtctagcccaagctggccagcggttgacctggctcccctggccccggccaggcctcgtggacccctcatatgccacacgggacatgagcaggccggccgggagccgggtcccgggagctccacgaaggggcctgtcctccatgaccaggacacccgctgcgccttcctcccgaggcctcccgggcctctccagacgcggcgctactgcagacaccagggccgccaagggagcggactcggagccggccctggggcgggcacatgggccccggcgccccccggcgtctccaagccgcgctgcccgggtcgggccaggccaggggagggacagcagcaggtgacgacggcccggccaccggctataaataggggcgcgcgtcagccgcgggcgggagcggcggcggcgggcaggggcccgggggccggggcctggaggacaggcgaggcagcggcgagtgcggggccggcggtcggggagggcggtgccatggggtcgcggagggcccccagccggggctggggcgcgggtgggcggtcgggggcggggggcgacggtgaggacgacggccccgtgtggatccccagcccagccagccggagctacctgctcagcgtgcggcccgagaccagcttatcaagcaaccggttgtctcaccccagctctggaaggagcaccttctgctccatcattgctcagctcacagaggagacccagccgctatttgagaccacgctcaagtcccggtctgtgtccgaggacagcgacgtcaggttcacctgcatcgtcacaggatacccagagccagaggtgacctggtacaaggatgatacggagctggaccgctactgtggcttgccaaaatatgagatcactcatcagggcaaccgccacacactgcagctgtacaggtgtcgagaagaagatgccgccatctaccaggcctctgcccagaacagcaagggcattgtgtcctgctcaggggtcctggaggtgggcaccatgactgagtacaagatccaccagcgctggttcgccaagttgaagcgcaaggctgcggcaaagctgcgcgagatcgagcagagctggaagcacgagaaggcggtgcctggggaggtcgacactctgcgcaagctcagccccgaccgcttccagcgaaagcggcgattgagcggggctcaagcgccgggcccctcggtccctaccagggagcctgagggtgggaccctggcggcttggcaggagggagagactgagactgctcagcactcaggtttgggcctgatcaacagttttgcttctggagaagtgaccaccaacggggaggctgcccccgagaatggagaggacggagagcatggcttgctgacatacatctgtgacgccatggagctggggcctcagagagccctcaaagaggagagtggggccaagaagaaaaagaaagatgaggaatccaagcaaggcctgcggaagccagagttagagaaggcagcccaaagccgccgttcttcagaaaactgcatccccagctcagacgagcctgactcctgtgggactcaggggcccgtgggcgtggagcaggttcagacccagcccagaggcagggctgcacgggggcctgggtcctctggcacagatagtaccaggaagccagcctctgctgtgggcactccagacaaggcccagaaggcccctggcccaggcccaggccaggaagtgtatttctccttgaaggacatgtacctggagaacacccaggcagtcaggcctcttggggaagagggaccccagaccctgagtgtccgggcgcctggggagagtcccaaggggaaggcacccctcagggctagaagcgagggggtgcctggcgctcctggccagcccacacactccttgaccccccagccgactaggcctttcaacagaaagagatttgcccctccaaagcccaaaggagaggccaccactgacagcaagcccatttcttctctgagtcaagctccagaatgcggggcccagagcttaggaaaggccccacctcaggcctctgtgcaggtgccgacgccccctgcccggcggagacatggcacccgggacagcacgttgcaggggcaagcaggccacaggactccaggagaggtcctggaatgccagacaaccacggctcctaccatgtcggccagcagcagctctgatgtagcctccattggggttagcacttccggaagtcaaggtatcattgaacccatggatatggaaacccaggaggatgggagaacatctgctaaccagagaactggaagcaagaagaatgtgcaggcagatgggaagatacaagtggatggaaggaccaggggagatggaacacagacagcccagaggacacgtgcagataggaagacgcaggtggatgctgggacacaagaaagcaagaggccacagtcagacaggagtgcacagaagggcatgatgacacagggaagggcagagacacagctagaaacaacacaggcaggtgagaagatacaggaagacaggaaggcccaggcagataagggcacacaggaagacagaaggatgcagggagagaaggggatgcagggagagaaggggacgcagtcagaggggagcgcgcccacagccatggaaggtcagtctgagcaagaggtggcaaccagcctcggcccaccatccagaacccccaaactcccacctacagcgggtcctagagctcctctgaatattgaatgttttgtacagaccccagaagggtcttgtttcccaaaaaaacctggttgcctgcccagatctgaggaggcagtagtaacagcctccaggaaccatgagcaaactgtgctgggtcccctgtcagggaacctcatgctcccagcacagccgccccatgaggggagtgtggagcaggtgggaggagagagatgccgagggccacagtcatcaggcccagtcgaggccaagcaggaggacagcccgttccagtgccccaaggaggagcggccagggggagtgccgtgtatggatcagggtggctgtcctctagctggcctgagccaggaggtacccacgatgccttctcttcctggaactgggctgacagctagcccaaaggcggggccgtgtagcaccccgacttctcagcacgggagcacagccaccttcctgccctctgaggatcaggtcctgatgagttctgccccaacactgcacctggggctggggacccccactcagagtcacccaccagaaaccatggccaccagcagtgagggggcctgcgcccaggtaccagatgtggaggggcggaccccaggtccccggagctgtgaccctggcctcatagattccctgaagaactacctgcttctgctgctgaagctgtccagcacagagacaagtggagcagggggagagtcccaggtgggggcagccaccggaggtctggtgccctcagccactctgacacccactgtggaagtggctgggcttagtccccggacatcgaggcgcatcctggagcgtgtggagaacaaccacctggtgcagagtgcacagaccctgctgctgagcccctgtacctcccgccgcctcaccggcctcctggaccgtgaggtgcaggctggccgccaggcccttgctgctgcccgaggctcctggggtcctggtcccagctccctcactgtccctgccattgtggtagacgaggaggaccctgggctggcctcagaaggagccagtgagggtgaaggagaggtttcccctgaggggcctggcctcctgggggcctctcaggagagcagcatggctggtcgactgggggaggcgggtgggcaggcagcccctggacaggggccctcagcagagagcatagcccaggagccctcccaagaggagaagttcccaggggaggctctgacaggtctcccggcagctacacctgaggaactggctctaggggcccggaggaagagatttctccctaaggtcagagcagcaggagacggggaggcaaccacacctgaagaaagggagagccccacggtttccccccgggggcccaggaaaagcctggtgcctgggtccccagggactccagggcgggagagacgctcccctacgcagggcagaaaggcgagcatgctggaggtgcctcgggcagaggaggagctggcggcaggagacctgggccccagccccaaggccggcggtctggacacagaggtggccctggatgaaggcaagcaggagacactggccaagcccaggaaagccaaagacctgctgaaagccccacaggtgatccggaagattcgggtggagcagtttcctgatgcctccggtagcctgaagctgtggtgccagtttttcaacattcttagtgactcagtcttgacatgggccaaggatcagcgcccagtgggcgaggtgggcaggagcgcaggggatgaggggccggcggccttggccatcgtgcaggcctcccccgtagactgcggtgtgtatcggtgcaccatccacaatgagcacggctcggcctccaccgacttctgcctcagccctgaggtgttgtcaggattcatctccagagaagaaggtgaagttggagaagagattgagatgacccctatggtgtttgctaagggtctggctgactctggctgctggggggacaagctctttgggcgactggtaagcgaggagctccgagggggtggatatgggtgtggccttcggaaggcctcccaggccaaggtcatctacgggctggaacccatcttcgagtcgggccgcacgtgcatcatcaaggtgtccagcctgcttgtgtttgggcccagcagtgagacttctcttgtgggcagaaactacgacgtcaccatccaggggtgcaagatccagaacatgagtcgggagtactgcaaaatcttcgcagcagaagcccgggccgcgcctggctttggggaggtgcctgagatcatcccactgtatctgatctaccggcctgcaaacaatatcccatatgctaccctggaggaagacctgggcaagcccctggagtcttactgttctcgggaatggggctgtgctgaggctccgacagcatctggcagctctgaggccatgcagaaatgccagaccttccaacactggctgtatcagtggacaaatggcagcttccttgtcacagacttggcaggggttgactggaagatgactgatgtgcagattgctaccaaactccgaggataccagggcctcaaggaaagctgcttccctgccctgctggaccggttcgcctcctcccaccagtgcaatgcctactgtgagctgctggggctgacacctctcaagggcccggaggcggcccacccccaagccaaagccaaaggctctaagagtccatctgctggcaggaaaggctcccagctgagtcctcagccccagaagaaaggcctccctagtcctcagggcacccggaagagtgctccaagttccaaggccacccctcaggcctcagagccagtcaccactcagttgttgggacagcctcccacccaagaggagggctccaaggcccagggcatgcggtagcctccgcagaggctgggggcctccacccagcagcagaccaaccaggaagcagcttgaactggatggagactttccaaatatggaactaactggagaaggtgcacgaaggagacaccacttggggacctctctgagcaggctctcgtgaatcagctcgtcatcagatggctttggtgcatggcacatagcccactggcctcttctggtgccactgtcacccagggctcccgggcctcaagcagtccccacctccaagtgcctggcaacctaggccctccttgaagtttacactttgccactgctggaggctcccctgagtcctctgcatgagttctgcaccccaagcccttgccccagcccagtccagcagcagatgttacaatctgagtgaggacatgcaggccaacttttaccctcctgcatttgcctggccctgatctcgcctgtcctcagggatccagacttcctctgctggtctggcctggtgactctcagggtatcttctccttccagctactttcgctcactgatctcagcttatcctgcaactaaccatccttgagcccagatggggctcagggcccttccagagcctgtcatgtccttgtgcagtggcctttgatgtgtgttcacgctcttcccccttcactcactcgcctgcttcccatgctcccttgtaccccctcgccacatccctgtcttggggcccagctgcagcctgctgcctgcccttcatggctctgcacatggccctttgcttgagggctccccactccctgcccaccaatacccaggtgaggaacagaccctctggcctctcaccccacttcagtgctctcttccccaacttctctcgggctctttgctcatgaggtgagagctggtgtgagggttgtgtcagcagctgtagccagagagaggtgttgactctgagagaccttgcactccatactgaaaggaggtggggtcacagtgaatttcacatcccctctcaaccaggagtggagggctaggtcccttccccatggggagtacacttgggtgttctaggagggatgcagtctatccatgcacttgggtggaggggagtctctgtgcctgggaattaggacccctgctccaaccatcgctcttgatcctggggccccagctctgggtcctcatgtatgggctcccaaggacccagcagcctggatccttccagagcatccctcctggaggcctgggatggggtaggtctgcagctagcctactccctttggaatgcaataaaggcagcattgtgtgccctgcttgccctcatctggtgtggttggaggtctgtggagtcaaggtccccctctcccaggcaggctctctgagggcattctgtagtcccaggcccactggaaaaatgaatctatattttggttcctggaccgaagttcagtcgcagccttctgtggccacagaaagacagcttgtgctgcttgcacaactgagctgctggtgtgtaccccttagcagggtgtctggggacttacgcctttggaattgctcttcattcagaagaggaacacaaaggaagccacccaggaaggaagcacagagctgggggctctggaaacgccctgtgtctctggctacagcaagaccagcccaggagcccaccagcacctgcctctcagctacttgctgaccatttcctgcttctcaagctgcagagaagcttttcattcccacccccacccggaacctccccttgcctaacatttcccctctatggtaacatctctgacttctctacctcctctgtgctcaggtgactccacatcttctgccccagtgtgtccccacctctcccagcctgtatacccagattactttggtgaactgagagctggagtactgttcattcatttattcattcacccactcattcagcagacatatactgagtgctactttatgccagaccctgggctggcagctgtttggaggcaaagatgtatgaggccatctcaggagagactacttgttaggattcttgagttttgaccaacagaaatgaacttggaccaacttaagcaaggaaaaagcgttcatgggaaggatgctgggatagctcacaaaaccaaaagaatagctgaacaattaattggccctgggaagggtgggagctggggcaactacgaggcttgcctcccaggagctgctgcggttggcagatcaacaccaacttgccattggttctagtgggtccccttccactcaagattcaaattccaagtgaaagaacctggcctggagctcagggcttcatagagtgggaggggggcagtcttccaaaagatgcggactcttgccacatggaatggtggagtacggaagggtggaaagggtttggtaggtaaaccctgaagatgcttctaacacacgtgctgttctcccatctcacgtatgacgactctcccacaggtaaccaaaaccacatttctctctgcttagggaattcaagatcatatctaacttcgaattccaggggtaatgacacggcttctattctccaaagtccagtgtcattagggataatctccctctttcagttttatcacaattccattttgaaattctacaacctgtagattaactggtaaaattaaccatattcaaccaaaattgtataacccagcaagaatggaagaatgggtaaagtctacagtccatttctagaactggtcatgagaactcatgtttatgatgatggacttttgatctggtggagggacccaaaccttcagttctgaagctcattagtggtcctacctgtgtgacaggcatttactattggactggcagtcccaggacaaactccaggaatccccccatgtccatctctactcctgccctcttttacgtagcagcaatcatattttcccttgatagggttcatcattctagatactccgatgacttctttataatgagcctgaagtggcctggtggctgcctcagcttccagttcagttgaatagctactacgtctttgaggatgtgctccttgctgggggactaaactctccacgccagcccagtcccaaacctaaacctcgggtatgagaaaagcattgagatctagcaatagcagggccatgtccacactgcgtcctatccctgaaggagaaacagcgccaggtatggttgccggctccaagcgcatgctgcctcctgcaggcctgacccagcctctcggggtgttgtttctggtgccatagttgaattttcaacaaaccatttcaccaccctctcaagacagctgctgctggtttgtgggttcctgacaagatgagtgaatgcctgcccatcaacccgttactattcttttagctgtaaagtgaattctctggttgggtgcagtatgtgaggaggtcacatgatgtttatggcatttgagaattccatggatattgatggcaggagaggcatgatgggttagaaaagcaaatccaaatccagaacaagggcccaaaagggccaagacaaattactgcccctctcagagccacaggtgtagacaggtgaaaacactggacagtgagtgagctacccacacacgacccactggtgccttcagagccttagcctggagcgacagtgtaccgttgataatggaacgcactggccatgccagactttatggctaggcggtcagataacactacgaggggcagcatggccaccaagtgtgccagggccaagtgttcaggctctcccagagcccagtggtgagccagaagggcattttgtacaaggataatggttactttttggccagagcatcacttggctccaaatcctgggttcccgtatcatattttcttgtcaggacttaccgcaagctatgtatggctccgcggtatgccacccatggaaagacacctcatgcaccattgacctgccaggtcacgtggcctgatggcagcgtcggctgcacaaaagactttcccagctgcaatgccttcgcctgctctaggcccaccccaaagctggcagtcttctaggtcagttggtaaatgggttagaacaagatgccccaaagtggcataaattgcatggaattaggccttagtggcgagggattcgacatacagtcatttgtcctacattgtgaaggaaacattctgacctcaaacagatccctcaaccccagaactttatagaaggggcagaccttggcattttcacatgatttatctcccactctgattcacatatgtttgaccaaggcactgggcagctgccaatttcccgtcccttctgtagtcccagatgaatggatacagacctctttggggaaggctgcaaggaaggttcacaacatgcatctaagtgttaaaataagtttttccttcaaaaatacatttgacttcctctccatttaaggtctggaaatcaagtgggagatcttgactttaccttggcacttgagacagaactgttggcccagaagtctttagttaaggtcattactaggccatatcttaggggcgtctggcctttttcattcctgggacccacagctcgaggtctggtttccatgccctatcccttacgatgagcgccctattttgttccttctgtctatctctgttgctgagatcagggagcccacgttcacagcagctctttcaagcagcctcccaggcctagagaggaaaatcagcagagcctcgtgaatgtatttctcgtggcaagaagggagctcatcttctgggtcctgccagagggcagtgagggggttgatgggctgggtgcatgccagggacccaatcaagcatttttatcttctgaaatctttgaattcctgcctttcttggatgtttggtcttttgatataatttagcatgggccaacatttggtccagatttgtattagccaagccctcctaaaatagtaataacagtatctggcgatttgagcttttacgtagaatgtagaatctctggtgagtgaacatatcaataaagacaacctgaaccaaaatta

SEQ ID NO: 106770 - DNA, 4153 bp, Homo sapiens
  Payload ID: 965
  Gene Symbol: AMACR
  Gene Name: alpha-methylacyl-CoA racemase
  Uniprot ID: Q9UHK6
  ENST ID: ENST00000335606
  CDS Start-End: 90-1238
ggcgccggggattgggagggcttcttgcaggctgctgggctggggctaagggctgctcagtttccttcagcggggcactgggaagcgccatggcactgcagggcatctcggtcgtggagctgtccggcctggccccgggcccgttctgtgctatggtcctggctgacttcggggcgcgtgtggtacgcgtggaccggcccggctcccgctacgacgtgagccgcttgggccggggcaagcgctcgctagtgctggacctgaagcagccgcggggagccgccgtgctgcggcgtctgtgcaagcggtcggatgtgctgctggagcccttccgccgcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaacttccaggcccacggctcaagtgaatttgaatactgcatttacagtgtagagtaacacataacattgtatgcatggaaacatggaggaacagtattacagtgtcctaccactctaatcaagaaaagaattacagactctgattctacagtgatgattgaattctaaaaatggttatcattagggcttttgatttataaaactttgggtacttatactaaattatggtagttattctgccttccagtttgcttgatatatttgttgatattaagattcttgacttatattttgaatgggttctagtgaaaaaggaatgatatattcttgaagacatcgatatacatttatttacactcttgattctacaatgtagaaaatgaggaaatgccacaaattgtatggtgataaaagtcacgtgaaacagagtgattggttgcatccaggccttttgtcttggtgttcatgatctccctctaagcacattccaaactttagcaacagttatcacactttgtaatttgcaaagaaaagtttcacctgtattgaatcagaatgccttcaactgaaaaaaacatatccaaaataatgaggaaatgtgttggctcactacgtagagtccagagggacagtcagttttagggttgcctgtatccagtaactcggggcctgtttccccgtgggtctctgggctgtcagctttcctttctccatgtgtttgatttctcctcaggctggtagcaagttctggatcttatacccaacacacagcaacatccagaaataaagatctcaggaccccccagcaagtcgttttgtgtctccttggactgagttaagttacaagcctttcttatacctgtctttgacaaagaagacgggattgtctttacataaaaccagcctgctcctggagcttccctggactcaacttcctaaaggcatgtgaggaaggggtagattccacaatctaatccgggtgccatcagagtagagggagtagagaatggatgttgggtaggccatcaataaggtccattctgcgcagtatctcaactgccgttcaacaatcgcaagaggaaggtggagcaggtttcttcatcttacagttgagaaaacagagactcagaagggcttcttagttcatgtttcccttagcgcctcagtgattttttcatggtggcttaggccaaaagaaatatctaaccattcaatttataaataattaggtccccaacgaattaaatattatgtcctaccaacttattagctgcttgaaaaatataatacacataaataaaaaaatatatttttcatttctatttcattgttaatcacaactacttactaaggagatgtatgcacctattggacactgtgcaacttctcacctggaatgagattggacactgctgccctcattttctgctccatgttggtgtccatatagtacttgattttttatcagatggcctggaaaacccagtctcacaaaaatatgaaattatcagaaggattatagtgcaatcttatgttgaaagaatgaactacctcactagtagttcacgtgatgtctgacagatgttgagtttcattgtgtttgtgtgttcaaatttttaaatattctgagatactcttgtgaggtcactctaatgccctgggtgccttggcacagttttagaaataccagttgaaaatatttgctcaggaatatgcaactaggaaggggcagaatcagaatttaagctttcatattctagccttcagtcttgttcttcaaccatttttaggaactttcccataaggttatgttttccagcccaggcatggaggatcacttgaggccaagagttcgagaccagcctggggaacttggctggacctccgtttctacgaaataaaaataaaaaaattatccaggtatggtggtgtgtgcctgtagtcctatctactcaagggtggggcaggaggatcacttgagcccaggaatttgaggccacagtgaattaggattgcaccactgcactctagcccaggcaacagaacaagaacctgtctctaaataaataaataaaaataataataataaaaaagatgttttccctacaactcagacttttcatttgaactcggtccagcaaggaaaatataacccactcgaagtctttaaaacagaggaaatttaatataaagaattccactggtgacgaaagagcagagaagcccagaagatagtgaggcaaccctgataggaacataactaggaagccaagaccactcctatggttgcaggggtgatgggaaagctggtgtacttggacccagaagccaaagttgctgcacccaccttggagacatagacactggcagtaatacctcagggagaagaaagaaatctagggaaatatcctggcttctttccttctctctctcccctagtcttcctaccagtgtctcccattagccaaatctacctagaagccagaaaacaagggaaccctggaaatgtagccccataagataaagagcaccaaaggaaatagatctgagcagacaggcagcacaaaatgcagtgtgtatggtttattcactcagtaattcctttagcaaatgtttattgaggatctactaggtgccaggtatcatgatacttgctggggataccataatgaacaaaacagacctgttctccgctcttgaggaaatcaaagacaaacacaggatatggaataaacccagaattatctcattgtaaaatgtgttaagtaccacgaggagaaatatcagggcgatctgacacagctaatgatttgaagaagggtgtgacctgccaccattttaaatctagttatttcactcctgagctgtgtgtgtggaaaacttgtagtaaaaaatagaatgtctatatttataaaaa

SEQ ID NO: 106771 - DNA, 2919 bp, Homo sapiens
  Payload ID: 965
  Gene Symbol: AMACR
  Gene Name: alpha-methylacyl-CoA racemase
  Uniprot ID: Q9UHK6
  ENST ID: ENST00000382072
  CDS Start-End: 13-609
ctgggaagcgccatggcactgcagggcatctcggtcgtggagctgtccggcctggccccgggcccgttctgtgctatggtcctggctgacttcggggcgcgtgtggtacgcgtggaccggcccggctcccgctacgacgtgagccgcttgggccggggcaagcgctcgctagtgctggacctgaagcagccgcggggagccgccgtgctgcggcgtctgtgcaagcggtcggatgtgctgctggagcccttccgccgcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaacttccaggcccacggctcaagtgaatttgaatactgcatttacagtgtagagtaacacataacattgtatgcatggaaacatggaggaacagtattacagtgtcctaccactctaatcaagaaaagaattacagactctgattctacagtgatgattgaattctaaaaatggttatcattagggcttttgatttataaaactttgggtacttatactaaattatggtagttattctgccttccagtttgcttgatatatttgttgatattaagattcttgacttatattttgaatgggttctagtgaaaaaggaatgatatattcttgaagacatcgatatacatttatttacactcttgattctacaatgtagaaaatgaggaaatgccacaaattgtatggtgataaaagtcacgtgaaacagagtgattggttgcatccaggccttttgtcttggtgttcatgatctccctctaagcacattccaaactttagcaacagttatcacactttgtaatttgcaaagaaaagtttcacctgtattgaatcagaatgccttcaactgaaaaaaacatatccaaaataatgaggaaatgtgttggctcactacgtagagtccagagggacagtcagttttagggttgcctgtatccagtaactcggggcctgtttccccgtgggtctctgggctgtcagctttcctttctccatgtgtttgatttctcctcaggctggtagcaagttctggatcttatacccaacacacagcaacatccagaaataaagatctcaggaccccccagcaagtcgttttgtgtctccttggactgagttaagttacaagcctttcttatacctgtctttgacaaagaagacgggattgtctttacataaaaccagcctgctcctggagcttccctggactcaacttcctaaaggcatgtgaggaaggggtagattccacaatctaatccgggtgccatcagagtagagggagtagagaatggatgttgggtaggccatcaataaggtccattctgcgcagtatctcaactgccgttcaacaatcgcaagaggaaggtggagcaggtttcttcatcttacagttgagaaaacagagactcagaagggcttcttagttcatgtttcccttagcgcctcagtgattttttcatggtggcttaggccaaaagaaatatctaaccattcaatttataaataattaggtccccaacgaattaaatattatgtcctaccaacttattagctgcttgaaaaatataatacacataaataaaaaaatatatttttcatttctatttcattgttaatcacaactacttactaaggagatgtatgcacctattggacactgtgcaacttctcacctggaatgagattggacactgctgccctcattttctgctccatgttggtgtccatatagtacttgattttttatcagatggcctggaaaacccagtctcacaaaaatatgaaattatcagaaggattatagtgcaatcttatgttgaaagaatgaactacctcactagtagttcacgtgatgtctgacagatgttgagtttcattgtgtttgtgtgttcaaatttttaaatattctgagatactcttgtgaggtcactctaatgccctgggtgccttggcacagttttagaaataccagttgaaaatatttgctcaggaatatgcaactaggaaggggcagaatcagaatttaagctttcatattctagccttcagtcttgttcttcaaccatttttaggaactttcccataaggttatgttttccagcccaggcatggaggatcacttgaggccaagagttcgagaccagcctggggaacttggctggacctccgtttctacgaaataaaaataaaaaaattatccagg

SEQ ID NO: 106772 - DNA, 1195 bp, Homo sapiens
  Payload ID: 965
  Gene Symbol: AMACR
  Gene Name: alpha-methylacyl-CoA racemase
  Uniprot ID: Q9UHK6
  ENST ID: ENST00000382085
  CDS Start-End: 10-1194
ggaagcgccatggcactgcagggcatctcggtcgtggagctgtccggcctggccccgggcccgttctgtgctatggtcctggctgacttcggggcgcgtgtggtacgcgtggaccggcccggctcccgctacgacgtgagccgcttgggccggggcaagcgctcgctagtgctggacctgaagcagccgcggggagccgccgtgctgcggcgtctgtgcaagcggtcggatgtgctgctggagcccttccgccgcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggctggtagcaagttctggatcttatacccaacacacagcaacatccagaaataaa

SEQ ID NO: 106773 - DNA, 1598 bp, Homo sapiens
  Payload ID: 965
  Gene Symbol: AMACR
  Gene Name: alpha-methylacyl-CoA racemase
  ENST ID: ENST00000502637
  CDS Start-End: 86-1189
ccggggattgggagggcttcttgcaggctgctgggctggggctaagggctgctcagtttccttcagcggggcactgggaagcgccatggcactgcagggcatctcggtcgtggagctgtccggcctggccccgggcccgttctgtgctatggtcctggctgacttcggggcgcgtgtggtacgcgtggaccggcccggctcccgctacgacgtgagccgcttgggccggggcaagcgctcgctagtgctggacctgaagcagccgcggggagccgccgtgctgcggcgtctgtgcaagcggtcggatgtgctgctggagcccttccgccgcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatgaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaacttccaggcccacggctcaagtgaatttgaatactgcatttacagtgtagagtaacacataacattgtatgcatggaaacatggaggaacagtattacagtgtcctaccactctaatcaagaaaagaattacagactctgattctacagtgatgattgaattctaaaaatggttatcattagggcttttgatttataaaactttgggtacttatactaaattatggtagttattctgccttccagtttgcttgatatatttgttgatattaagattcttgacttatattttgaatgggttctagtgaaaaaggaatgatatattcttgaagacatcgatatacatttatttacactcttgattctacaatgtagaaaatgaggaaatgccacaaattgtatggtgataa

SEQ ID NO: 106774 - DNA, 2182 bp, Homo sapiens
  Payload ID: 965
  Gene Symbol: AMACR
  Gene Name: alpha-methylacyl-CoA racemase
  Uniprot ID: Q9UHK6
  ENST ID: ENST00000506639
  CDS Start-End: 13-702
ctgggaagcgccatggcactgcagggcatctcggtcgtggagctgtccggcctggccccgggcccgttctgtgctatggtcctggctgacttcggggcgcgtgtggtacgcgtggaccggcccggctcccgctacgacgtgagccgcttgggccggggcaagcgctcgctagtgctggacctgaagcagccgcggggagccgccgtgctgcggcgtctgtgcaagcggtcggatgtgctgctggagcccttccgccgcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaagatctttgataccatactttaatctgtatcttcagtttctgaacataagtatgcaaaatctttttaaggtgcatactctgctgcgtccctgctattttctaggacaaaaataatctgaaaacactgagaattttatgacattttgagatagcaagtctcttatagtacaatcaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaacttccaggcccacggctcaagtgaatttgaatactgcatttacagtgtagagtaacacataacattgtatgcatggaaacatggaggaacagtattacagtgtcctaccactctaatcaagaaaagaattacagactctgattctacagtgatgattgaattctaaaaatggttatcattagggcttttgatttataaaactttgggtacttatactaaattatggtagttattctgccttccagtttgcttgatatatttgttgatattaagattcttgacttatattttgaatgggttctagtgaaaaaggaatgatatattcttgaagacatcgatatacatttatttacactcttgattctacaatgtagaaaatgaggaaatgccacaaattgtatggtgataaaagtcacgtgaaacagagtgattggttgcatccaggccttttgtcttggtgttcatgatctccctctaagcacattccaaactttagcaacagttatcacactttgtaatttgcaaagaaaagtttcacctgtattgaatcagaatgccttcaactgaaaaaaacatatccaaaataatgaggaaatgtgttggctcactacgtagagtccagagggacagtcagttttagggttgcctgtatccagtaactcggggcctgtttccccgtgggtctctgggctgtcagctttcctttctccatgtgtttgatttctcctcaggctggtagcaagttctggatcttatacccaacacacagcaacatccagaaataaagatctcaggaccccccagcaagtcgttttgtgtctccttggactgagttaagttacaagcctttcttatacctgtctttgacaaagaagacgggattgtctttacataaaaccagcctgctcctggagcttccctggactcaacttcctaaaggcatgtgaggaaggggtagattccacaatctaatccgggtgccatcagagtagagggagtagagaatgga

SEQ ID NO: 106775 - DNA, 1316 bp, Homo sapiens
  Payload ID: 965
  Gene Symbol: AMACR
  Gene Name: alpha-methylacyl-CoA racemase
  ENST ID: ENST00000426255
  CDS Start-End: 66-932
ttgcaggctgctgggctggggctaagggctgctcagtttccttcagcggggcactgggaagcgccatggcactgcagggcatctcggtcgtggagctgtccggcctggccccgggcccgttctgtgctatggtcctggctgacttcggggcgcgtgtggtacgcgtggaccggcccggctcccgctacgacgtgagccgcttgggccggggcaagcgctcgctagtgctggacctgaagcagccgcggggagccgccgtgctgcggcgtctgtgcaagcggtcggatgtgctgctggagcccttccgccgcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggtctgggagaactgatcttgctgaaaatacaacaggaagcagtatcgtgccaggcaaggcaaaccctcgtcagtgtgaagcaatggccatcgttgcagcccaagtcatggggttttgtgtggcagtaaccgttggaggcggcaatggccattttgagttggatgttttcaagccaatgatgattaaaaatttatgttacactcaggctgctgggggatgcttcagtttccttcacagaaaactaaatagtgggaatccggaccaataaagaaaggatcaagaagctaatgaattagtcgctaatgctggtgacagctctcaaccctcatatagggtatgacaaaacagcagaattgctaagacaacaccccaaaatggatcaaccttaaaggaaactgccgttgaacttggctctctcacagcagagcagtttgatgaatgggtaaaacctaaggacatgctgggtccaaagtgacttaaataagttttaatgaaaataaacgtgtaaaatt

SEQ ID NO: 106776 - DNA, 862 bp, Homo sapiens
  Payload ID: 965
  Gene Symbol: AMACR
  Gene Name: alpha-methylacyl-CoA racemase
  ENST ID: ENST00000382068
  CDS Start-End: 10-855
ggaagcgccatggcactgcagggcatctcggtcgtggagctgtccggcctggccccgggcccgttctgtgctatggtcctggctgacttcggggcgcgtgtggtacgcgtggaccggcccggctcccgctacgacgtgagccgcttgggccggggcaagcgctcgctagtgctggacctgaagcagccgcggggagccgccgtgctgcggcgtctgtgcaagcggtcggatgtgctgctggagcccttccgccgcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggtctgggagaactgatcttgctgaaaatacaacaggaagcagtatcgtgccaggcaaggcaaaccctcgtcagtgtgaagcaatggccatcgttgcagcccaagtcatggggttttgtgtggcagtaaccgttggaggcggcaatggccattttgagttggatgttttcaagccaatgatgattaaaaatttatgttacactcaggctgctgggggatgcttcagtttccttcacagaaaactaaatagtgggaatccggaccaataaagaaagg

SEQ ID NO: 106777 - DNA, 858 bp, Homo sapiens
  Payload ID: 965
  Gene Symbol: AMACR
  Gene Name: alpha-methylacyl-CoA racemase
  ENST ID: ENST00000512079
  CDS Start-End: 10-792
ggaagcgccatggcactgcagggcatctcggtcgtggagctgtccggcctggccccgggcccgttctgtgctatggtcctggctgacttcggggcgcgtgtggtacgcgtggaccggcccggctcccgctacgacgtgagccgcttgggccggggcaagcgctcgctagtgctggacctgaagcagccgcggggagccgccgtgctgcggcgtctgtgcaagcggtcggatgtgctgctggagcccttccgccgcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggctgctgggggatgcttcagtttccttcacagaaaactaaatagtgggaatccggaccaataaagaaaggatcaagaagctaatgaattagtcgctaatgctggtgacag

SEQ ID NO: 106778 - DNA, 5504 bp, Homo sapiens
  Payload ID: 966
  Gene Symbol: AMMECR1
  Gene Name: Alport syndrome, mental retardation, midface hypoplasia and elliptocytosis chromosomal region gene 1
  Uniprot ID: Q9Y4X0
  ENST ID: ENST00000262844
  CDS Start-End: 169-1170
gcgcgcggggcagccgcgtggctaggcagacggggccgggagcggcgcgcgcgcgccccgccagcctctggcgcgcccccggcggcctgagccgcagcgtgctcgcccccgccgccagctcgcctcacttatgggtcggaaacgctgcgtgggggagactgttccaagatggcggcgggttgctgcggggtgaagaagcagaaactgtccagttcgcccccctctggctcgggtggcggtggtggcgcctcctcctcctcccactgcagcggagagagccagtgccgagctggggagctgggactaggaggcgccggtacgcggctcaacgggctgggaggtctaaccggaggaggtagcggcagcggctgtaccctctctcccccccagggctgcggcggcggcggcggggggatcgccctgtcgccacctccgagctgcggagtggggaccctactttctaccccggccgccgccacctcttcctcaccctcctcatcgtccgccgcctcgtcctcatcgccgggctcccggaagatggtggtgtcagcagagatgtgctgcttttgcttcgatgtgctctactgtcacctgtatggataccagcagccccggaccccccgattcaccaacgagccctacccactgtttgtaacatggaagattggtcgagacaaaagattacgtggatgcataggtactttttctgccatgaatttgcattcaggactcagggagtacacacttaccagtgcccttaaagatagccgttttcccccaatgacaagggatgagctgccacggcttttctgctcagtgtctctgctcactaactttgaagatgtctgtgattatttggactgggaggtgggtgtacatggcattagaatagaattcatcaatgaaaaaggatcaaaacgcaccgccacctacctaccggaggttgcaaaggagcaaggatgggaccatatacagaccatagactccttattgaggaaaggaggatacaaagctccgattactaatgaattcaggaaaaccataaaactgaccaggtatcgtagtgaaaagatgaccctgagctatgctgaataccttgctcatcgccagcatcatcatttccaaaatggcattgggcatccccttccgccatacaaccattattcctgacactgagccgcacaaccagtcactgggcctctctgcagacctcttcccaggagaccctacaccttcttggtctagctatctcttttactgtaccattttatgatgatagtttccgttgccatggtgaagcttcgacatcgtcaactaagatcatcatggtaacgggtagaaaaatggcatttgttaagatcctgttttattattttagatcgttgattttttttttgcagcatatataattttgggtttttttttccttataatattatgtagaattttgctttgctgtctcagtcaggtttctgtttttctgtcctccttgcctttcttcccgttttgcttcctgttttccttcttccttcccgttttccttcttccttccctgcctcccttcctttgactgtggatggaagaaagtgtgcagtttttagggattttacttaggttcgtctttagttttcctcagtaagatagttgttttttgatacctgagtttgggattaattcatatcaaattcaggtatttgtatattactcttgatttttgtctgaaattcactttgctatgacagcctagtagttgggtcttcactccttaagtatatgtttttcccatggtgaaaatacatgaactttagttctagtagtgagcattcaaaggtccgtgatagggcttgtcacagagagagagaaatcatttatccctattgtgctggttatcatagaagagactgcctcaccactttatagaaccaatttgcaaactaaaacactgtttggagaaggtacaaactacctttcaaaaaggctacaggaaacattttatgagcagcaaatattaggaagagagcagatacagaatttagtgcctttgagaagaatataattaagtggaattaagaggggttagaaaaaaggcaatttagaaaaatattcttgtaaaactttattgtttctatatgtgaaacagaagattagacaaattccttactcttaagtatttttttaagctgaaaaaaaattattttgagcaaataaccaataagagacatttgtctattttatattaatttaaatttgttagctctaggtttcaataagtcatgattggctagaatccattttagctaccatctaaagatatggtaaagataatttagtaaaacaaaagttcatatttgccatgatttcagatatgtttgtcatggggacaatattagagttttagagatactataaaatagcttgaatttctttctgcactacatacttttgatagaaacacatttactacattgataagatgttatgtcacacctgtgaaaatggagttggcattcagatatgctatagttagagcccagctcatctgcaagtatagtcttcccatgatgcatacaaagataacttactgatgtcgataggaggtccatacatatatccccaggaaaaatgacagattattctggaggaagatgaccttcattttatggttatgtgtgtgtgtctgtgtgtctttggaaaaatatatataattttttcaaataggaagccaacatatcaagtgatgaattaaagtatgctgcagaatatatattctaaaactacaaaaaagtcactgaatatcaaaatgatacagcttatacatatagttactgtgacaagtgacagactgctagttcagaattcaaaaatcctttcctagtttgtgagataatgggctaaattccttctgcctgccactggggcaaagcaaattgctttagtttttgatgagagttcttagaagtttgttggtattccttcatccacagcatccattgttgaaataaccattttcagttgtgatgccttaactaagaagccaattgttagcctgaaatgcaatcttggtagccagtttcaatgaagctagagattagtcagaaaaagttagctgttgggctttagaaagggattttgagtcctgtcatttctacttgggagcattttggagcagattagtctttcagtataaaaacaagtggctacctgatggaaacttttcttacccttatagggaaactgagcacaagctgaatgatattgtctgctgcaaaaaaaaacaaacaaaaaaaaaacaaaacaaaaaacaaaaaaaaggaaaaaaaggtaaataaaacaagcaaactgaagagagacaaaatagaccaatattatcgtgaaatccatcttatccatcatctcatcggttcaacaggctcctcgtcctgggtgagcttatggttagaagtttttttagcaaagatttattacatacatagatgtgtgtgtgtacatatacttacacatacatacatacatatatgtgtgtttatttaacggtgctaatcaatcttgagcaggtcacgtgactggtcatgcggactctaaaatcatatcagattttttaaaatccttgatatatgcagatgttatacagattttcttagcagtgtaataacgttaaactgaagaaataaccatcctgcaggcttcaaaggacgaggtcagcaatatttcccaacatggcttgggggaaaaggatagttttgtctccttttgtattcaagtaatgcaaagtgcatttttgtctctaagtagcttttgactaaaagactttgtagtgtaaagggtgttatacaaactgtaatggtgtgcttcaaacaaatgctagaccctttcacctttgtcgtatatacaaagctgttaattatgtggtatgaattaactttgaacatgttgaaatatgtagcatgtctttaactcagacgaagattctgattgcacaggttgtgttctagccagttgtgatttatttgttcagaaacacaaatgtgaattgcactcttatcatcagaatattgtatgagttcagtgatctttaaacagctcagaagtaatacttgaacttcatttgagtagcacaaagtttacatagccccttttaaatgttaattcgttccatttaagttttccattttcagatgcaactgggtatttttcctcttggaaatagtacgtactttgctttggtatgtagcaaaaggcttccatttctggaagggttttcttgttcttaaacaaggtcagccaggtaccagattctaaaagaacaaattgtcccccacccctcaagtggccttctgactgcacgagaatgtgctactaccctctgtagtctcccctaacacgagaggtcagtgaaattgatggaggaagtgcaaggcttgcttcccctcacccttaaagcttaaagcagttgtaagattttcagtccagcacatacagtcccagtgcccagcacaccggaagtttgtatactggcctcttatcttgtcttcaaatgtgcaggaaatttgaaactgtcatctggaataggttccatctcttatgtgtgttagatcaaaccaaagaagcccccagccatgcccaaatgctgcttcaaaagcctgccttccagtccttacaaaaaccttgcaggattaaatgtgttaacttttttatttttgtacagtttctaagtgatttttgctagtgatgttaaaatgaattaagtttatttgaggggtgtgagcacctcctccatttaaataaactggtgactttccttttattttttaaaagtggaaacccgttgtgtgcctctcgatttaagggtttctgatgacattattcttaagaccagcattgatcctttatatacaaatatatgttttccttgttttttattgctatttcagaagaaaatgaaccttttattttgctctacccagtaactgcgctggtacatagacgcactgagcaaacaaacttttgtaaccacctctgactacttttgtatatcaaagttgattacttttgaaatatttggatctagtttctaagttattttagtgttttatatgttccccaaaattactttgaatctgtcaccagcataatgagttcttggtgatacaatggtgagacttgtaatgagcaaaaagctacctggagtagctcctcttttccttctttcttagtaacctgttttttgattaccgtaagacatcacagattacctgaaaccccttccagtataactaggccctccttccttccacatttaattgcttaatagtttgaagaaactattggaaatgggcattttatatgacatgtatggctttacaatattaaatatgagcaaaaagaaaaaatatgagaaggtttatgtgggtctgtaaggtatggctgtggaaagatattgtagtagttttgacactattgttattacctttaaaatcatttacccaataaaatgttaaaaccga

SEQ ID NO: 106779 - DNA, 3380 bp, Homo sapiens
  Payload ID: 966
  Gene Symbol: AMMECR1
  Gene Name: Alport syndrome, mental retardation, midface hypoplasia and elliptocytosis chromosomal region gene 1
  Uniprot ID: Q9Y4X0
  ENST ID: ENST00000372057
  CDS Start-End: 638-1270
ctctttctctgggctaatcgtttagaggacagtcgctcctgccaacctaatcccatgagcctgactaccttgccgggccacaggctcaaagaagcagtgtggctgccagcaccctcacggtaaggggcacggaggcaccaggcagtctggcaggatgagagacatcctgggggtggtctgagtttggatgtgggctgagaagacaaagcagggggctttcgggggacaagattttccaaacatcttattcttaggatcatcacttcctaatctgatgcaactgactcggcaggcattcgggagcctgtaagctccattttcctgttccaaattcttctgcacctcaccatgagtcctcaccttgaccctaatcaacttgggattctcctcaaagtacttagaaaggaaaaggaagacggtgactaccctgacatgatggccacccacccgagctccaggtatgaagcctgctcctctggaattactctagggctgcggcggcggcggcggggggatcgccctgtcgccacctccgagctgcggagtggggaccctactttctaccccggccgccgccacctcttcctcaccctcctcatcgtccgccgcctcgtcctcatcgccgggctcccggaagatggtggtgtcagcagagatgtgctgcttttgcttcgatgtgctctactgtcacctgtatggataccagcagccccggaccccccgattcaccaacgagccctacccactgtttgtaacatggaagattggtcgagacaaaagattacgtggatgcataggtactttttctgccatgaatttgcattcaggactcagggagtacacacttaccagtgcccttaaagatagccgttttcccccaatgacaagggatgagctgccacggcttttctgctcagtgtctctgctcactaactttgaagatgtctgtgattatttggactgggaggtgggtgtacatggcattagaatagaattcatcaatgaaaaaggatcaaaacgcaccgccacctacctaccggaggttgcaaaggagcaaggatgggaccatatacagaccatagactccttattgaggaaaggaggatacaaagctccgattactaatgaattcaggaaaaccataaaactgaccaggtatcgtagtgaaaagatgaccctgagctatgctgaataccttgctcatcgccagcatcatcatttccaaaatggcattgggcatccccttccgccatacaaccattattcctgacactgagccgcacaaccagtcactgggcctctctgcagacctcttcccaggagaccctacaccttcttggtctagctatctcttttactgtaccattttatgatgatagtttccgttgccatggtgaagcttcgacatcgtcaactaagatcatcatggtaacgggtagaaaaatggcatttgttaagatcctgttttattattttagatcgttgattttttttttgcagcatatataattttgggtttttttttccttataatattatgtagaattttgctttgctgtctcagtcaggtttctgtttttctgtcctccttgcctttcttcccgttttgcttcctgttttccttcttccttcccgttttccttcttccttccctgcctcccttcctttgactgtggatggaagaaagtgtgcagtttttagggattttacttaggttcgtctttagttttcctcagtaagatagttgttttttgatacctgagtttgggattaattcatatcaaattcaggtatttgtatattactcttgatttttgtctgaaattcactttgctatgacagcctagtagttgggtcttcactccttaagtatatgtttttcccatggtgaaaatacatgaactttagttctagtagtgagcattcaaaggtccgtgatagggcttgtcacagagagagagaaatcatttatccctattgtgctggttatcatagaagagactgcctcaccactttatagaaccaatttgcaaactaaaacactgtttggagaaggtacaaactacctttcaaaaaggctacaggaaacattttatgagcagcaaatattaggaagagagcagatacagaatttagtgcctttgagaagaatataattaagtggaattaagaggggttagaaaaaaggcaatttagaaaaatattcttgtaaaactttattgtttctatatgtgaaacagaagattagacaaattccttactcttaagtatttttttaagctgaaaaaaaattattttgagcaaataaccaataagagacatttgtctattttatattaatttaaatttgttagctctaggtttcaataagtcatgattggctagaatccattttagctaccatctaaagatatggtaaagataatttagtaaaacaaaagttcatatttgccatgatttcagatatgtttgtcatggggacaatattagagttttagagatactataaaatagcttgaatttctttctgcactacatacttttgatagaaacacatttactacattgataagatgttatgtcacacctgtgaaaatggagttggcattcagatatgctatagttagagcccagctcatctgcaagtatagtcttcccatgatgcatacaaagataacttactgatgtcgataggaggtccatacatatatccccaggaaaaatgacagattattctggaggaagatgaccttcattttatggttatgtgtgtgtgtctgtgtgtctttggaaaaatatatataattttttcaaataggaagccaacatatcaagtgatgaattaaagtatgctgcagaatatatattctaaaactacaaaaaagtcactgaatatcaaaatgatacagcttatacatatagttactgtgacaagtgacagactgctagttcagaattcaaaaatcctttcctagtttgtgagataatgggctaaattccttctgcctgccactggggcaaagcaaattgctttagtttttgatgagagttcttagaagtttgttggtattccttcatccacagcatccattgttgaaataaccattttcagttgtgatgccttaactaagaagccaattgttagcctgaaatgcaatcttggtagccagtttcaatgaagctagagattagtcagaaaaagttagctgttgggctttagaaagggattttgagtcctgtcatttctacttgggagcattttggagcagattagtctttcagtataaaaacaagtggctacctgatggaaacttttcttacccttatagggaaactgagcacaagctgaatgatattgtctgctgcaaaaaaaaacaaac

SEQ ID NO: 106780 - DNA, 3052 bp, Homo sapiens
  Payload ID: 966
  Gene Symbol: AMMECR1
  Gene Name: Alport syndrome, mental retardation, midface hypoplasia and elliptocytosis chromosomal region gene 1
  Uniprot ID: Q9Y4X0
  ENST ID: ENST00000372059
  CDS Start-End: 14-904
agactgttccaagatggcggcgggttgctgcggggtgaagaagcagaaactgtccagttcgcccccctctggctcgggtggcggtggtggcgcctcctcctcctcccactgcagcggagagagccagtgccgagctggggagctgggactaggaggcgccggtacgcggctcaacgggctgggaggtctaaccggaggaggtagcggcagcggctgtaccctctctcccccccagggctgcggcggcggcggcggggggatcgccctgtcgccacctccgagctgcggagtggggaccctactttctaccccggccgccgccacctcttcctcaccctcctcatcgtccgccgcctcgtcctcatcgccgggctcccggaagatggtggtgtcagcagagatgtgctgcttttgcttcgatgtgctctactgtcacctgtatggataccagcagccccggaccccccgattcaccaacgagccctatgcccttaaagatagccgttttcccccaatgacaagggatgagctgccacggcttttctgctcagtgtctctgctcactaactttgaagatgtctgtgattatttggactgggaggtgggtgtacatggcattagaatagaattcatcaatgaaaaaggatcaaaacgcaccgccacctacctaccggaggttgcaaaggagcaaggatgggaccatatacagaccatagactccttattgaggaaaggaggatacaaagctccgattactaatgaattcaggaaaaccataaaactgaccaggtatcgtagtgaaaagatgaccctgagctatgctgaataccttgctcatcgccagcatcatcatttccaaaatggcattgggcatccccttccgccatacaaccattattcctgacactgagccgcacaaccagtcactgggcctctctgcagacctcttcccaggagaccctacaccttcttggtctagctatctcttttactgtaccattttatgatgatagtttccgttgccatggtgaagcttcgacatcgtcaactaagatcatcatggtaacgggtagaaaaatggcatttgttaagatcctgttttattattttagatcgttgattttttttttgcagcatatataattttgggtttttttttccttataatattatgtagaattttgctttgctgtctcagtcaggtttctgtttttctgtcctccttgcctttcttcccgttttgcttcctgttttccttcttccttcccgttttccttcttccttccctgcctcccttcctttgactgtggatggaagaaagtgtgcagtttttagggattttacttaggttcgtctttagttttcctcagtaagatagttgttttttgatacctgagtttgggattaattcatatcaaattcaggtatttgtatattactcttgatttttgtctgaaattcactttgctatgacagcctagtagttgggtcttcactccttaagtatatgtttttcccatggtgaaaatacatgaactttagttctagtagtgagcattcaaaggtccgtgatagggcttgtcacagagagagagaaatcatttatccctattgtgctggttatcatagaagagactgcctcaccactttatagaaccaatttgcaaactaaaacactgtttggagaaggtacaaactacctttcaaaaaggctacaggaaacattttatgagcagcaaatattaggaagagagcagatacagaatttagtgcctttgagaagaatataattaagtggaattaagaggggttagaaaaaaggcaatttagaaaaatattcttgtaaaactttattgtttctatatgtgaaacagaagattagacaaattccttactcttaagtatttttttaagctgaaaaaaaattattttgagcaaataaccaataagagacatttgtctattttatattaatttaaatttgttagctctaggtttcaataagtcatgattggctagaatccattttagctaccatctaaagatatggtaaagataatttagtaaaacaaaagttcatatttgccatgatttcagatatgtttgtcatggggacaatattagagttttagagatactataaaatagcttgaatttctttctgcactacatacttttgatagaaacacatttactacattgataagatgttatgtcacacctgtgaaaatggagttggcattcagatatgctatagttagagcccagctcatctgcaagtatagtcttcccatgatgcatacaaagataacttactgatgtcgataggaggtccatacatatatccccaggaaaaatgacagattattctggaggaagatgaccttcattttatggttatgtgtgtgtgtctgtgtgtctttggaaaaatatatataattttttcaaataggaagccaacatatcaagtgatgaattaaagtatgctgcagaatatatattctaaaactacaaaaaagtcactgaatatcaaaatgatacagcttatacatatagttactgtgacaagtgacagactgctagttcagaattcaaaaatcctttcctagtttgtgagataatgggctaaattccttctgcctgccactggggcaaagcaaattgctttagtttttgatgagagttcttagaagtttgttggtattccttcatccacagcatccattgttgaaataaccattttcagttgtgatgccttaactaagaagccaattgttagcctgaaatgcaatcttggtagccagtttcaatgaagctagagattagtcagaaaaagttagctgttgggctttagaaagggattttgagtcctgtcatttctacttgggagcattttggagcagattagtctttcagtataaaaacaagtggctacctgatggaaacttttcttacccttatagggaaactgagcacaagctgaatgatattgtctgctgcaaaaaaaaacaaacaaaaaaaaaacaaaacaaaaaacaaaaaaaaggaaaaa

SEQ ID NO: 106781 - DNA, 4741 bp, Homo sapiens
  Payload ID: 967
  Gene Symbol: ALS2CL
  Gene Name: ALS2 C-terminal like
  Uniprot ID: Q60I27
  ENST ID: ENST00000318962
  CDS Start-End: 85-2946
gggggtgcgagcgaggagccgcacaggcagtcccggcgcggggcaaccacagcgctcaggaggccctgagtccggcacctggccatgtgcaaccctgaggaggcagctctgctgcggctggaggaggtcttctcagccaccctcgcccatgtcaacagccttgtcctccagcccctgctcccagccgccccagatccctcggatccctggggcagagagtgcctgcggctcttgcaacagctgcacaagagctcccagcaactctgggaggtgacggaggaaagcctgcactcactgcaggagaggctgcgttacccggactccaccggtctggagtccctgctgctgctgcgaggtgctgaccgtgtactgcaggcccacatagagtacattgagtcctacacaagctgcatggtggtgcaggccttccagaaggcagcaaagaggagaagcgagtactggcggggccagcggaaggcgctgcggcagctgctttcaggtgtgagctcagagggctcggtgggcgcatcgctgggccaggccctccaccagccactcgcccatcacgtgcaacagtacgtgctcctcctgctgagcctcggggacaccattggggagcatcacccaacccgggagctggtggtgaacgcagtcaccctctttgggaacctgcagtccttcatgaagcaggagttggaccaggctgtggccacacaggctctctggcacaccctgagaggccggctgagggatgtgctctgcacccctgctcacagactccttcaggacagccaggacgtacccgtgacggtcgcaccgttgcgggctgagcgtgtgctgctctttgatgatgccctcgtcctgctgcagggccacaatgtccacacctttgatctgaagctggtgtgggtggatcctgggcaggacgggtgcacgtttcacctcctcacgcccgaagaagagttctccttttgtgccaaggactcccagggccaggcagtctggcagtggaaggtgacctgggctgttcaccaggccctgcatgggaagaaggacttccccgtgctgggggctggcctggagccctcccagcctcccgactgccgctgcgcagaatataccttccaggcagagggccggctctgccaggccacctacgagggcgagtggtgcaggggccggccccacggcaagggaaccctgaaatggccggatgggcggaatcacgtggggaatttctgccagggcctggagcatggcttcggcatccgcctgctgccccaggcctctgaggacaagttcgactgttacaagtgtcactggcgagaaggcagcatgtgtggctacggcatctgtgagtacagcaccgacgaggtgtacaagggctacttccaggagggcctgcggcacggatttggggtccttgagagtggtccgcaggccccccagcccttcaggtacacgggccactgggagaggggccagaggagcggctatggcattgaggaggatggtgacagaggtgagcgctacattggcatgtggcaggctggtcagcgccacggcccaggggtcatggtcacccaggcaggtgtctgctaccagggcaccttccaggcggacaagacggtgggcccgggcatcctcctctctgaagacgactccctgtatgagggcaccttcaccagggacctgaccctcatggggaagggcaaggtcaccttccccaatggcttcaccctggagggctcgttcggcagtggggcagggagaggactgcacacacagggtgtgctggacacggctgccctcccaccagacccgagcagtacctgcaagaggcagctgggcgtgggtgccttccccgtggaaagccgctggcagggagtctacagccccttccgggactttgtgtgtgctggctgccccagggacctgcaggaggccctgctgggcttcgacgtgcagagctccagggagctgcgtaggtctcaggattacctgtcctgcgagaggacccaccctgaggacagtgtgggcagtatggaagacatcctggaggagctgctgcagcaccgggagcccaaggccctgcagctgtacctcaggaaggctctgagcaactcactgcaccccctgggaaagctgctccggacactgatgctgaccttccaggctacctacgcaggtgtcggggccaacaagcacctgcaggagctggcccaggaggaggtgaagcagcatgcccaggaactctgggctgcctacaggggtctgctgcgagttgccttagagcgcaagggccaggccctggaggaggatgaagacacagagacaagggacctccaggtgcatggattggtgctgcccctcatgctgcccagcttctactcagagctcttcacgctctacctgctgcttcatgagcgggaggacagcttctacagccagggcattgccaacttgagcctctttcctgatacccaactgctcgagttcctggatgtgcagaagcacttgtggcccctcaaggacctcacgctgacgagcaatcagaggtactccctggtcagggacaagtgtttcctgtcagccaccgagtgcctgcagaagatcatgaccacggtggacccacgggagaagctggaggtgctggagaggacatacggggaaattgagggcacggtgtcgagggtattgggccgggagtacaagctgcccatggacgacctgctgccacttctcatctacgtggtgtcgcgcgcccgaattcagcacctgggagccgagatccacctgatccgtgacatgatggaccccaaccacacaggaggcctgtatgacttcctgctcacagccctggagtcctgttacgagcacatccagaaagaagacatgaggctgcaccgcttacctggccactggcactccagggagctctggtagcctggcctttcctggacagactgaagagctgagcagggcactgccagcctgtccctcattacccaaggcaaggggcaggacaggccctcagaagcagctcttggaggagatgagcattttgttttgcacaggaagatgctgctgctgccctgactgggatgagggtgaggggtgacgggtgtggccctggatgtggtggttttcccttggccactagcccatcttcaatgaccccttaatctgcagcagctcacaggctgggggtgaggagtccctggcttctcttagcctgagcctttctcccaagttccagagcctctccgggcctcagtgctgccatctgtacaatggtggagtgagtacgctgtaaaggaccttccattcattttgctgaattccagagtccttttggaaaactgactttagtctgctgggctgtattgacctctggcaggctcgaagcctcactgggtatgcagtcaacaggatgggcctggagatccgtgaactgcaggccacgtacccatgacgtaaacggcggcactggagcaagctggggcggggggtgggtaaaccctcactgccagcaggccccaagtggcttgtaaatcattctcctgtgatgtctgtgggcctgcgtggggacaacaggggcacatgacatctgcctgggccctgaccaataaaccctcagacccaggacccaggaccctgctgtagttggggagcaggagtacctttgggaggggaggactttatttaaacagtggttctagtgtgggaccaagagaggcaggagctgggtcttggggcagctttattcctgttgggcctcagtttctcttccccacacagtttatcttccgtcacattgtgccgggtgacgtgcacggtctccctctgccctagccggagatgcatgatgacaggcagtgtgatgtgttctgaaagtgtccagggcaaagcgtagggagagggtggatttgtgcagggtgcagctctggagaagaagctggatcactcttggtcccattccctaggccctgagcaagtcaggctcctggctctgggtgtggctcccccaaacgaagtactgacttcagcctgtgaggggagggttgagggaggctctggaaagcccagccacacctgagtccctggcagtagccttggggcagagggcacccgcagagtcccagagatgatgtgggcagtgggcagagagagccttggcgcctctgtttgccaccacttccccaggaaggagggacagcatttctctggctggttccactaaatgtgccagcccaaatgcagggcatgggctctggttctgccaggagcctgtgacacccccaggaagggggtggaactgaggaagagcgaggatatgcaggcactcatgcttaccgggactggggcagctcactaggattctatcctttccaatcggcatcagccagctcttgtcccctgataagtgaggacagcctgaccctggcctcaaatgcagccatccctgagttcatgcgatgctgacgggaccccagcacacttccctgcctcctttgagatctgcgagcccttgctgcagttcagattcaacaaggccctctgcccaccctctcactaggcctcacccaacaccagtggaactggagcctctggctgggcacagtggctcactttgggaggctgaggcaggaaggctgctggaaactgagagttcaagaccagcctgggcaacatagtgagaccctgtctctacaaatacaaaataaaataattagctggg

SEQ ID NO: 106782 - DNA, 1747 bp, Homo sapiens
  Payload ID: 967
  Gene Symbol: ALS2CL
  Gene Name: ALS2 C-terminal like
  Uniprot ID: Q60I27
  ENST ID: ENST00000383742
  CDS Start-End: 433-1335
aggaaggaaccagctgtaagggagggcagagggggatgtcttggaggggaatcccagactttggacactggtctctcttggaccaagaccccctctctggcttggcctccagatctgcccacctttctgtctccgtctttccaggattccatatgcttctgtctgtcttctcgtcgcagggtagattctctgtccctttctctgctgctcttcctcctggagccgtggaggcagctgggcgtgggtgccttccccgtggaaagccgctggcagggagtctacagccccttccgggactttgtgtgtgctggctgccccagggacctgcaggaggccctgctgggcttcgacgtgcagagctccagggagctgcgtaggtctcaggattacctgtcctgcgagaggacccaccctgaggacagtgtgggcagtatggaagacatcctggaggagctgctgcagcaccgggagcccaaggccctgcagctgtacctcaggaaggctctgagcaactcactgcaccccctgggaaagctgctccggacactgatgctgaccttccaggctacctacgcaggtgtcggggccaacaagcacctgcaggagctggcccaggaggaggtgaagcagcatgcccaggaactctgggctgcctacaggggtctgctgcgagttgccttagagcgcaagggccaggccctggaggaggatgaagacacagagacaagggacctccaggtgcatggattggtgctgcccctcatgctgcccagcttctactcagagctcttcacgctctacctgctgcttcatgagcgggaggacagcttctacagccagggcattgccaacttgagcctctttcctgatacccaactgctcgagttcctggatgtgcagaagcacttgtggcccctcaaggacctcacgctgacgagcaatcagaggtactccctggtcagggacaagtgtttcctgtcagccaccgagtgcctgcagaagatcatgaccacggtggacccacgggagaagctggaggtgctggagaggacatacggggaaattgagggcacggtgtcgagggtattgggccgggagtacaagctgcccatggacgacctgctgccacttctcatctacgtggtgtcgcgcgcccgaattcagcacctgggagccgagatccacctgatccgtgacatgatggaccccaaccacacaggaggcctgtatgacttcctgctcacagccctggagtcctgttacgagcacatccagaaagaagacatgaggctgcaccgcttacctggccactggcactccagggagctctggtagcctggcctttcctggacagactgaagagctgagcagggcactgccagcctgtccctcattacccaaggcaaggggcaggacaggccctcagaagcagctcttggaggagatgagcattttgttttgcacaggaagatgctgctgctgccctgactgggatgagggtgaggggtgacgggtgtggccctggatgtggtggttttcccttggccactagcccatcttcaatgaccccttaatctgcagcagctcacaggctgggggtgaggagtccctggcttctcttagcctgagcctttctcccaagttccagagcctctccgggcctcagtgctgccatctgtacaatggtggagtgagtacgctgtaaaggaccttccattcattttgctgaattccagagtccttttgg

SEQ ID NO: 106783 - DNA, 4470 bp, Homo sapiens
  Payload ID: 967
  Gene Symbol: ALS2CL
  Gene Name: ALS2 C-terminal like
  ENST ID: ENST00000423707
  CDS Start-End: 1-908
cactgcaggagaggctgcgttacccggactccaccggtctggagtccctgctgctgctgcgaggtgctgaccgtgtactgcaggcccacatagagtacattgagtcctacacaagctgcatggtggtgcaggccttccagaaggcagcaaagaggagaagcgagtactggcggggccagcggaaggcgctgcggcagctgctttcaggtgtgagctcagagggctcggtgggcgcatcgctgggccaggccctccaccagccactcgcccatcacgtgcaacagtacgtgctcctcctgctgagcctcggggacaccattggggagcatcacccaacccgggagctggtggtgaacgcagtcaccctctttgggaacctgcagtccttcatgaagcaggagttggaccaggctgtggccacacaggctctctggcacaccctgagaggccggctgagggatgtgctctgcacccctgctcacagactccttcaggacagccaggacgtacccgtgacggtcgcaccgttgcgggctgagcgtgtgctgctctttgatgatgccctcgtcctgctgcagggccacaatgtccacacctttgatctgaagctggtgtgggtggatcctgggcaggacgggtgcacgtttcacctcctcacgcccgaagaagagttctccttttgtgccaaggactcccagggccaggcagtctggcagtggaaggtgacctgggctgttcaccaggccctgcatgggaagaaggacttccccgtgctgggggctggcctggagccctcccagcctcccgactgccgctgcgcagaatataccttccaggcagagggccggctctgccaggccacctacgagggcgagtggtgcaggggccggccccacggggaaccctgaaatggccggatgggcggaatcacgtggggaatttctgccagggcctggagcatggcttcggcatccgcctgctgccccaggcctctgaggacaagttcgactgttacaagtgtcactggcgagaaggcagcatgtgtggctacggcatctgtgagtacagcaccgacgaggtgtacaagggctacttccaggagggcctgcggcacggatttggggtccttgagagtggtccgcaggccccccagcccttcaggtacacgggccactgggagaggggccagaggagcggctatggcattgaggaggatggtgacagaggtgagcgctacattggcatgtggcaggctggtcagcgccacggcccaggggtcatggtcacccaggcaggtgtctgctaccagggcaccttccaggcggacaagacggtgggcccgggcatcctcctctctgaagacgactccctgtatgagggcaccttcaccagggacctgaccctcatggggaagggcaaggtcaccttccccaatggcttcaccctggagggctcgttcggcagtggggcagggagaggactgcacacacagggtgtgctggacacggctgccctcccaccagacccgagcagtacctgcaagaggcagctgggcgtgggtgccttccccgtggaaagccgctggcagggagtctacagccccttccgggactttgtgtgtgctggctgccccagggacctgcaggaggccctgctgggcttcgacgtgcagagctccagggagctgcgtaggtctcaggattacctgtcctgcgagaggacccaccctgaggacagtgtgggcagtatggaagacatcctggaggagctgctgcagcaccgggagcccaaggccctgcagctgtacctcaggaaggctctgagcaactcactgcaccccctgggaaagctgctccggacactgatgctgaccttccaggctacctacgcaggtgtcggggccaacaagcacctgcaggagctggcccaggaggaggtgaagcagcatgcccaggaactctgggctgcctacaggtgggctcggtggcaaacgggacagctactgccctgtgacactagtgtgccctttccaggcatcagttctgccttgcatttgggaggaatgccaagtgtctgattcaacaatgaaccagaggcttggtcagtgtgcagctgctgagcaaaagggttagagggtggggaggtgagagcaaaggcccagctgcagccctcagctagagtccaagacccaaccaggcgctgggctgactctgaccgcaggtgcactctcaccccactgtaggctgagcttggccctggactcggaacacacctgcagtcccaggctgggctgtgaccccatgaaacactgcaaatagaagccttagatgctatagttccttctgctgctggattctcaggctaacatcctggagctccaaccttctaacttctgtggtttgagaggatgaaccctgcaggccatgtccacagttctgagaggccacctgcttttgcctttgttgactggtggtagaactccagttctgtggcaaggggcagccacaccatttctctctcattgactcacaggggtctgctgcgagttgccttagagcgcaagggccaggccctggaggaggatgaagacacagagacaaggtgactggcgcaggtctccttggggcctgccgtgtccagggaggcctcatgcgtctgctcctaggacctcccttggggaaagaggtgcttctggggaagtgctgggcattcactctattgaccaaacattgtgcattgatcgtttgtggattagaatgacccatgacctctgttctgtgaggaaccagggagggggcactgctacaatgcattgaatgcatctttgttctaaatgtatgatcccaatctcatctttcgcatgcagaaggtgagtagctccccgaggcaccctcctctccctgcacacagatggggaaaccgagggctggtagggatgagcctgaggttatacaggagttaggtgggcatgaaatttgtttcccccagtccctggagcaaaccttacaatttgcctttagattctagacctgaaagtgttcctgatcagagaggccttcctgtcactgccttgcaggaggcaagggaaatggggttagacattagggaggattccccgcccggagtcctagcacagcaaaccaggaggtggaactgaatcagcctggaatggctgctgagagctcagctgcaagttgctggtccatctggggccctggttttgctttcagtcaaatggggatccaactcctgccccacctgccatcttggttgtcaaagtcaaaggagggaatgaagttatgaattgaattgggcaaatgatgactgagaacaggcttggaaaaggttttctggggaggaggaggctggaggccaggacactgtttgttgtggaactaggagctctttgagacgagactccaagtagtaatcccagaccccaccttgctcatcccaacctgttccggtctccccatcagggacctccaggtgcatggattggtgctgcccctcatgctgcccagcttctactcagagctcttcacgctctacctgctgcttcatgagcgggaggacagcttctacagccagggcattgccaacttgagcctctttcctgatacccaactgctcgagttcctggatgtgcagaagcacttgtggcccctcaaggacctcacgctgacgagcaatcagaggtactccctggtcagggacaagtgtttcctgtcagccaccgagtgcctgcagaagatcatgaccacggtggacccacgggagaagctggaggtgctggagaggacatacggggaaattgagggcacggtgtcgagggtattgggccgggagtacaagctgcccatggacgacctgctgccacttctcatctacgtggtgtcgcgcgcccgaattcagcacctgggagccgagatccacctgatccgtgacatgatggaccccaaccacacaggaggcctgtatgacttcctgctcacagccctggagtcctgttacgagcacatccagaaagaagacatgaggctgcaccgcttacctggccactggcactccagggagctctggtagcctggcctttcctggacagactgaagagctgagcagggcactgccagcctgtccctcattacccaaggcaaggggcaggacaggccctcagaagcagctcttggaggagatgagcattttgttttgcacaggaagatgctgctgctgccctgactgggatgagggtgaggggtgacgggtgtggccctggatgtggtggttttcccttggccactagcccatcttcaatgaccccttaatctgcagcagctcacaggctgggggtgaggagtccctggcttctcttagcctgagcctttctcccaagttccagagcctctccgggcctcagtgctgccatctgtacaatggtggagtgagtacgctgtaaaggaccttccattc

SEQ ID NO: 106784 - DNA, 3937 bp, Homo sapiens
  Payload ID: 967
  Gene Symbol: ALS2CL
  Gene Name: ALS2 C-terminal like
  ENST ID: ENST00000434140
  CDS Start-End: 88-1695
ggtgggggtgcgagcgaggagccgcacaggcagtcccggcgcggggcaaccacagcgctcaggaggccctgagtccggcacctggccatgtgcaaccctgaggaggcagctctgctgcggctggaggaggtcttctcagccaccctcgcccatgtcaacagccttgtcctccagcccctgctcccagccgccccagatccctcggatccctggggcagagagtgcctgcggctcttgcaacagctgcacaagagctcccagcaactctgggaggtgacggaggaaagcctgcactcactgcaggagaggctgcgttacccggactccaccggtctggagtccctgctgctgctgcgaggtgctgaccgtgtactgcaggcccacatagagtacattgagtcctacacaagctgcatggtggtgcaggccttccagaaggcagcaaagaggagaagcgagtactggcggggccagcggaaggcgctgcggcagctgctttcaggtgtgagctcagagggctcggtgggcgcatcgctgggccaggccctccaccagccactcgcccatcacgtgcaacagtacgtgctcctcctgctgagcctcggggacaccattggggagcatcacccaacccgggagctggtggtgaacgcagtcaccctctttgggaacctgcagtccttcatgaagcaggagttggaccaggctgtggccacacaggctctctggcacaccctgagaggccggctgagggatgtgctctgcacccctgctcacagactccttcaggacagccaggacgtacccgtgacggtcgcaccgttgcgggctgagcgtgtgctgctctttgatgatgccctcgtcctgctgcagggccacaatgtccacacctttgatctgaagctggtgtgggtggatcctgggcaggacgggtgcacgtttcacctcctcacgcccgaagaagagttctccttttgtgccaaggactcccagggccaggcagtctggcagtggaaggtgacctgggctgttcaccaggccctgcatgggaagaaggacttccccgtgctgggggctggcctggagccctcccagcctcccgactgccgctgcgcagaatataccttccaggcagagggccggctctgccaggccacctacgagggcgagtggtgcaggggccggccccacggcaagggaaccctgaaatggccggatgggcggaatcacgtggggaatttctgccagggcctggagcatggcttcggcatccgcctgctgccccaggcctctgaggacaagttcgactgttacaagtgtcactggcgagaaggcagcatgtgtggctacggcatctgtacagcaccgacgaggtgtacaagggctacttccaggagggcctgcggcacggatttggggtccttgagagtggtccgcaggccccccagcccttcaggtacacgggccactgggagaggggccagaggagcggctatggcattgaggaggatggtgacagaggtgagcgctacattggcatgtggcaggctggtcagcgccacggcccaggggtcatggtcacccaggcaggtgtctgctaccagggcaccttccaggcggacaagacggtgggcccgggcatcctcctctctgaagacgactccctgtatgagggcaccttcaccagggacctgaccctcatggggaagggcaaggtcaccttccccaatggcttcaccctggagggctcgttcggcagtggggcagggagaggactgcacacacagggtgtgctggacacggctgccctcccaccagacccgagcagtacctgcaagaggcagctgggcgtgggtgccttccccgtggaaagccgctggcagggagtctacagccccttccgggactttgtgtgtgctggctgccccagggacctgcaggaggccctgctgggcttcgacgtgcagagctccagggagctgcgtaggtctcaggattacctgtcctgcgagaggacccaccctgaggacagtgtgggcagtatggaagacatcctggaggagctgctgcagcaccgggagcccaaggccctgcagctgtacctcaggaaggctctgagcaactcactgcaccccctgggaaagctgctccggacactgatgctgaccttccaggctacctacgcaggtgtcggggccaacaagcacctgcaggagctggcccaggaggaggtgaagcagcatgcccaggaactctgggctgcctacaggctgagcttggccctggactcggaacacacctgcagtcccaggctgggctgtgaccccatgaaacactgcaaatagaagccttagatgctatagttccttctgctgctggattctcaggctaacatcctggagctccaaccttctaacttctgtggtttgagaggatgaaccctgcaggccatgtccacagttctgagaggccacctgcttttgcctttgttgactggtggtagaactccagttctgtggcaaggggcagccacaccatttctctctcattgactcacaggggtctgctgcgagttgccttagagcgcaagggccaggccctggaggaggatgaagacacagagacaagggacctccaggtgcatggattggtgctgcccctcatgctgcccagcttctactcagagctcttcacgctctacctgctgcttcatgagcgggaggacagcttctacagccagggcattgccaacttgagcctctttcctgatacccaactgctcgagttcctggatgtgcagaagcacttgtggcccctcaaggacctcacgctgacgagcaatcagaggtactccctggtcagggacaagtgtttcctgtcagccaccgagtgcctgcagaagatcatgaccacggtggacccacgggagaagctggaggtgctggagaggacatacggggaaattgagggcacggtgtcgagggtattgggccgggagtacaagctgcccatggacgacctgctgccacttctcatctacgtggtgtcgcgcgcccgaattcagcacctgggagccgagatccacctgatccgtgacatgatggaccccaaccacacaggaggcctgtatgacttcctgctcacagccctggagtcctgttacgagcacatccagaaagaagacatgaggctgcaccgcttacctggccactggcactccagggagctctggtagcctggcctttcctggacagactgaagagctgagcagggcactgccagcctgtccctcattacccaaggcaaggggcaggacaggccctcagaagcagctcttggaggagatgagcattttgttttgcacaggaagatgctgctgctgccctgactgggatgagggtgaggggtgacgggtgtggccctggatgtggtggttttcccttggccactagcccatcttcaatgaccccttaatctgcagcagctcacaggctgggggtgaggagtccctggcttctcttagcctgagcctttctcccaagttccagagcctctccgggcctcagtgctgccatctgtacaatggtggagtgagtacgctgtaaaggaccttccattcattttgctgaattccagagtccttttggaaaactgactttagtctgctgggctgtattgacctctggcaggctcgaagcctcactgggtatgcagtcaacaggatgggcctggagatccgtgaactgcaggccacgtacccatgacgtaaacggcggcactggagcaagctggggcggggggtgggtaaaccctcactgccagcaggccccaagtggcttgtaaatcattctcctgtgatgtctgtgggcctgcgtggggacaacaggggcacatgacatctgcctgggccctgaccaataaaccctcagacccagga

SEQ ID NO: 106785 - DNA, 3471 bp, Homo sapiens
  Payload ID: 967
  Gene Symbol: ALS2CL
  Gene Name: ALS2 C-terminal like
  Uniprot ID: Q60I27
  ENST ID: ENST00000415953
  CDS Start-End: 191-3052
acagcgctcaggtaagggcgcgacgaagggcgcgcgtctgcggacgggtgtctgcgctccacgcttagctcgtccaggtgggggctcccgcctcctcggctgctgcggtccccgcccagctccttggtcccggcggcagtcatcccccggccgtccgagtccctcgaggccctgagtccggcacctggccatgtgcaaccctgaggaggcagctctgctgcggctggaggaggtcttctcagccaccctcgcccatgtcaacagccttgtcctccagcccctgctcccagccgccccagatccctcggatccctggggcagagagtgcctgcggctcttgcaacagctgcacaagagctcccagcaactctgggaggtgacggaggaaagcctgcactcactgcaggagaggctgcgttacccggactccaccggtctggagtccctgctgctgctgcgaggtgctgaccgtgtactgcaggcccacatagagtacattgagtcctacacaagctgcatggtggtgcaggccttccagaaggcagcaaagaggagaagcgagtactggcggggccagcggaaggcgctgcggcagctgctttcaggtgtgagctcagagggctcggtgggcgcatcgctgggccaggccctccaccagccactcgcccatcacgtgcaacagtacgtgctcctcctgctgagcctcggggacaccattggggagcatcacccaacccgggagctggtggtgaacgcagtcaccctctttgggaacctgcagtccttcatgaagcaggagttggaccaggctgtggccacacaggctctctggcacaccctgagaggccggctgagggatgtgctctgcacccctgctcacagactccttcaggacagccaggacgtacccgtgacggtcgcaccgttgcgggctgagcgtgtgctgctctttgatgatgccctcgtcctgctgcagggccacaatgtccacacctttgatctgaagctggtgtgggtggatcctgggcaggacgggtgcacgtttcacctcctcacgcccgaagaagagttctccttttgtgccaaggactcccagggccaggcagtctggcagtggaaggtgacctgggctgttcaccaggccctgcatgggaagaaggacttccccgtgctgggggctggcctggagccctcccagcctcccgactgccgctgcgcagaatataccttccaggcagagggccggctctgccaggccacctacgagggcgagtggtgcaggggccggccccacggcaagggaaccctgaaatggccggatgggcggaatcacgtggggaatttctgccagggcctggagcatggcttcggcatccgcctgctgccccaggcctctgaggacaagttcgactgttacaagtgtcactggcgagaaggcagcatgtgtggctacggcatctgtgagtacagcaccgacgaggtgtacaagggctacttccaggagggcctgcggcacggatttggggtccttgagagtggtccgcaggccccccagcccttcaggtacacgggccactgggagaggggccagaggagcggctatggcattgaggaggatggtgacagaggtgagcgctacattggcatgtggcaggctggtcagcgccacggcccaggggtcatggtcacccaggcaggtgtctgctaccagggcaccttccaggcggacaagacggtgggcccgggcatcctcctctctgaagacgactccctgtatgagggcaccttcaccagggacctgaccctcatggggaagggcaaggtcaccttccccaatggcttcaccctggagggctcgttcggcagtggggcagggagaggactgcacacacagggtgtgctggacacggctgccctcccaccagacccgagcagtacctgcaagaggcagctgggcgtgggtgccttccccgtggaaagccgctggcagggagtctacagccccttccgggactttgtgtgtgctggctgccccagggacctgcaggaggccctgctgggcttcgacgtgcagagctccagggagctgcgtaggtctcaggattacctgtcctgcgagaggacccaccctgaggacagtgtgggcagtatggaagacatcctggaggagctgctgcagcaccgggagcccaaggccctgcagctgtacctcaggaaggctctgagcaactcactgcaccccctgggaaagctgctccggacactgatgctgaccttccaggctacctacgcaggtgtcggggccaacaagcacctgcaggagctggcccaggaggaggtgaagcagcatgcccaggaactctgggctgcctacaggggtctgctgcgagttgccttagagcgcaagggccaggccctggaggaggatgaagacacagagacaagggacctccaggtgcatggattggtgctgcccctcatgctgcccagcttctactcagagctcttcacgctctacctgctgcttcatgagcgggaggacagcttctacagccagggcattgccaacttgagcctctttcctgatacccaactgctcgagttcctggatgtgcagaagcacttgtggcccctcaaggacctcacgctgacgagcaatcagaggtactccctggtcagggacaagtgtttcctgtcagccaccgagtgcctgcagaagatcatgaccacggtggacccacgggagaagctggaggtgctggagaggacatacggggaaattgagggcacggtgtcgagggtattgggccgggagtacaagctgcccatggacgacctgctgccacttctcatctacgtggtgtcgcgcgcccgaattcagcacctgggagccgagatccacctgatccgtgacatgatggaccccaaccacacaggaggcctgtatgacttcctgctcacagccctggagtcctgttacgagcacatccagaaagaagacatgaggctgcaccgcttacctggccactggcactccagggagctctggtagcctggcctttcctggacagactgaagagctgagcagggcactgccagcctgtccctcattacccaaggcaaggggcaggacaggccctcagaagcagctcttggaggagatgagcattttgttttgcacaggaagatgctgctgctgccctgactgggatgagggtgaggggtgacgggtgtggccctggatgtggtggttttcccttggccactagcccatcttcaatgaccccttaatctgcagcagctcacaggctgggggtgaggagtccctggcttctcttagcctgagcctttctcccaagttccagagcctctccgggcctcagtgctgccatctgtacaatggtggagtgagtacgctgtaaaggaccttccattcattttgctgaattccagagtccttttggaaaactg

SEQ ID NO: 106786 - DNA, 5194 bp, Homo sapiens
  Payload ID: 968
  Gene Symbol: ALMS1
  Gene Name: Alstrom syndrome protein 1
  ENST ID: ENST00000423048
  CDS Start-End: 1-3072
caggccctgccagacagtgagctaactcaagaagctctgaaagtttcagctgttcctcaaccagctgaccagaagactgggttatctactgtaacttcctctttctattcacatacagagaagcctaatatttcttaccagcaagagttgccagatagtcatctaactgaagaggctctgaaagtttcaaatgttcctggaccagctgaccagaagactggggtatcaacagtaacctctacttcctactcacacagagagaagcccattgtttcctaccagcgagagttgccgcattttactgaagcaggtttgaaaattttaagagttcctggaccagctgaccagaagactggaataaacatcctgccctctaattcctacccacagagagagcactctgtcatttcttatgagcaggagttgccagatcttactgaagtaactttgaaagcaataggggttcctgggcctgctgaccagaagactgggatacaaatagcatcctctagttcctactcaaatagagagaaggccagtatttttcatcagcaggagttgccagatgttactgaagaagctttaaatgtttttgttgttcctggacaaggtgaccggaagactgagataccaacagtacctttaagttactactcacgtagagagaagcccagtgttatctctcaacaggagttgccagacagtcatctcacagaagaggctctgaaagtttcacctgtttctataccagcagagcagaagactgggataccaataggactgtctagttcctactcacattcacataaagagaaactcaagatttcaactgtgcatataccagatgaccagaaaactgagtttccagcagctacccttagttcctactcacaaatagagaagcccaagatttcaactgtgattggaccaaatgaccagaagactccatcccagacagcttttcatagttcctattctcaaacagtaaagcccaatattttatttcaacagcagttgccagatagagatcaaagtaaaggtattctaaagatttcagctgtccctgaactaactgatgtgaatactggaaaaccagtatctctctctagttcttattttcacagagagaaatcgaatattttcagtccacaggaattgccaggtagtcatgtaactgaagatgtgctgaaggtttcaacaattcctggaccagctggccagaaaacagtattaccaacagctcttcctagttccttttcacatcgagagaaaccagatattttctatcaaaaggatttgccagatagacatctaactgaagatgctctaaagatctcaagtgctcttgggcaagctgatcaaattaccggattacaaacagttccctctggtacttactcacatggtgagaatcacaagcttgtttcagaacatgtccaaaggctaatagataatttgaattcttctgactccagtgttagctcaaataatgtgcttttaaattctcaggctgatgacagagttgtaataaataaaccagaatctgcaggttttagagatgttggctctgaagaaatccaggatgcagaaaatagtgctaaaactcttaaggaaattcggacacttttgatggaggcagaaaatatggcactgaaacgatgcaattttcctgctccccttgcccgtttcagagatattagtgatatttcatttatacaatctaagaaggtggtttgcttcaaagaaccctcttccacgggtgtatctaatggtgatttgcttcacagacagccattcacagaggaaagcccaagcagcaggtgcatacagaaggatattggcacacagacgaatttgaaatgccggagaggcattgaaaattgggagtttattagttcaactacagttagaagtcctctacaggaagcagagagcaaagtcagtatggcattagaagaaactcttaggcaatatcaagcagccaaatctgtaatgaggtctgaacctgaagggtgtagtggaaccattgggaataaaattattatccctatgatgactgtcataaaaagtgattcaagtagtgatgccagtgatggaaatggttcctgctcgtgggacagtaatttaccagagtctttggaatcagtttctgatgttcttctaaacttctttccatatgtttcacccaagacaagtataacagatagcagggaggaagagggtgtgtcagagagtgaggatggtggtggtagcagtgtagattcactggctgcacatgtgaaaaaccttctgcaatgtgaatcctcactgaatcatgctaaagaaatactcagaaatgcagaggaagaggaaagccgggtacgagcacatgcctggaatatgaagttcaatttagcacatgattgtggatactccatttcagaattaaatgaagatgacaggaggaaagtagaagagatcaaggcagagttatttggtcatggaagaacaactgacttgtccaagggtttacagagtccacggggaatgggatgcaagccagaagctgtatgtagtcacattattattgagagccatgaaaagggatgtttccggactctaacttctgaacatccacaactagatagacacccttgtgctttcagatctgctggaccctcagaaatgaccagaggacggcagaacccatcatcatgcagagccaagcatgtcaacctttctgcatccttagaccagaacaactcccatttcaaagtttggaattccttgcagttaaaaagtcattccccatttcagaactttatacctgatgaattcaaaatcagcaaaggtcttcgaatgccattcgatgaaaagatggacccttggctgtcagaattagtagaacctgcttttgtgccacctaaagaagtggattttcattcttcatcacaaatgccgtccccagaacccatgaaaaagtttactacctccatcactttttcatctcaccgacattctaaatgcatttccaattcctctgttgttaagattaccagagaagatgaagaccccactttctgctttctctgaaaaattgtcatctgatgcagtcactcagataacaacagaaagtccagaaaagaccctattttcatctgagatttttattaatgctgaagatcgtggacatgaaattatagagcctggtaaccagaagctacgcaaagctcctgtcaagtttgcctcatcatcttcagtccaacaggttactttttctcgcggcacagatggccagcctttattattgccatataagccttctggtagtaccaagatgtattatgttccacaattaagacaaattcctccatctccggattccaaatcagataccaccgttgaaagctcccattcaggatccaatgatgccattgctccagacttcccagctcaggtgctaggcacaagagatgatgacctctcagccactgttaacattaaacataaagaaggaatctacagtaagagggtagtgactaaggcatccttgccagtgggagaaaaacccttgcagaatgaaaatgcagatgcctcagttcaagtgctaatcactggggatgagaacctctcagacaaaaaacagcaagagattcacagtacaagggcagtgactgaggctgcccaggctaaagaaaaagaatctttgcagaaagatactgcagattccagtgctgctgctgctgcagagcactcagctcaagtaggagacccagaaatgaagaacttgccagacactaaagccattacacagaaagaggagatccataggaagaagacagttcccgaggaagcctggccaaacaataaagaatccctacagatcaatattgaagagtccgaatgtcattcagaatttgaaaatactacccgttctgtcttcaggtcagcaaagttttacattcatcatcccgtacacctaccaagtgatcaagatatttgccatgaatctttgggaaagagtgttttcatgagacattcttggaaagatttctttcagcatcatccagacaaacatagagaacacatgtgtcttcctcttccttatcaaaacatggacaagactaagacagattataccagaataaagagcctcagcatcaatgtgaatttgggaaacaaagaagtgatggatactactaaaagtcaagttagagattatccaaaacataatggacaaattagtgatccacaaagggatcagaaggtcaccccagagcaaacaactcagcacactgtgagtttgaatgaactgtggaacaagtatcgggagcgacagaggcaacagagacagcctgagttgggtgacaggaaagaactgtccttggtggaccgacttgatcgtttggctaaaattcttcagaatccaatcacacattctctccaggtctcagaaagtacacatgatgatagcagaggggaacgaagtgtgaaggaatggagtggtagacaacagcagagaaataagcttcagaaaaagaagcggtttaaaagcctagagaaaagccataaaaatacaggcgagcttaaaaaaagcaaggtgctttctcatcatcgagctgggaggtctaatcaaattaaaattgaacagattaaatttgataaatatattctgagtaaacagccaggttttaattatataagcaacacttcttcggattgtcggccctcagaggagagtgagctgctcacagatactaccaccaacatcctttccggcaccacttctactgtcgaatcagatatattgacccaaacagatagagaggtggctctgcacgaaaggagtagctctgtttccactattgacactgcccggctgattcaagcttttggccatgaaagagtatgcttgtcacccagacgaattaaattatatagcagcatcaccaaccaacagaggagataccttgagaagcggagcaaacacagcaagaaagtgctgaatacaggtcatcccctagtgacttctgagcacaccagaaggagacacatccaggtacatggctacagattccatctggcaatgtgactgccctcttcatggactttttagttaagctttgcacacaggtgaaaaaaacaagccatttgccctttcctctctataccatttcttaccaactggaaaagagtgagaaagtgtagtacagtg

SEQ ID NO: 106787 - DNA, 12595 bp, Homo sapiens
  Payload ID: 968
  Gene Symbol: ALMS1
  Gene Name: Alstrom syndrome protein 1
  ENST ID: ENST00000484298
  CDS Start-End: 112-12492
aggcgggcggcactgcgcctaagctgggccacaaccgccagtcagggctctccccttcccctccctccccccctcctcctcctcctctgccgcccagagcgagacaccaacatggagcccgaggatctgccatggccgggcgagctggaggaggaggaggaggaggaggaggaggaggaggaggaagaggaggaggctgcagcggcggcggcggcgaacgtggacgacgtagtggtcgtggaggaggtggaggaagaggcggggcgggagttggactccgactctcactacgggccccagcatctggaaagtatagacgacgaggaggacgaggaggccaaggcctggctgcaggcgcaccccggcaggattttgcctccgctgtcgcccccgcagcaccgctactcggagggcgagcggacctccctggagaagaaaacagaatcttggcattgtcttcctcaagaaatggactcttcccaaaccttggatacatcccagactaggtttaatgtgagaacggaagatactgaagtgacagacttcccctctctggaggagggcatattgacgcaatcagaaaatcaagtaaaggaacccaacagagatctcttctgttctccactgctagtcatacaagatagctttgcttctcctgatttgcctttgctgacctgtttgacacaagaccaagaatttgcgcctgattctttatttcatcaaagtgaactaagttttgcacctctgaggggaattcctgataagtctgaagatactgaatggtcttctcgaccatcggaagttagtgaagctttattccaggctactgcagaagtagcttcagacttagcaagcagtcgctttagtgtatctcagcacccgcttataggcagcacagctgttgggtctcagtgcccttttttaccttctgaacaagggaataatgaagagactatttcgtctgttgatgaactgaaaattcccaaagactgtgatcgttatgatgatctttgttcatatatgtcatggaagacacgaaaagatacacagtggcctgaaaacaatttagctgataaagatcaagtttcagttgcaacttcatttgacataactgatgaaaacatagctactaaaagaagtgaccattttgatgctgctcgttcatatgggcagtattggacacaggaagattcatctaagcaggcagaaacatatttaaccaagggcctgcaggggaaggttgagtctgacgtcattactctggatggcctaaatgaaaatgctgttgtatgcagtgaaagagttgctgaactacaaagaaagccaacaagagagtcggaatatcactcttcagatctcagaatgttgaggatgtctcctgacactgtgccaaaggctcctaaacatttaaaagcaggagacacttctaaaggaggcatagctaaagttactcaatccaacttgaagtcaggcatcactaccactcctgttgattcagacattggatctcatttatccttgtcccttgaggacctgtctcagttggctgtaagttctcctctagaaactactactggtcaacacactgatactctcaaccaaaagacattagcagatactcatctaactgaagagactctgaaagtcacagctattcctgaaccagctgaccagaagactgcaacaccaacagtactctctagttcccactcacatagggggaagcccagcattttctaccagcagggcttgccagacagtcatctaactgaagaggctttgaaagtttcagctgctcctggactagctgaccagacaactggcatgtcaactctaacctctacttcctactcacatagagagaagcctggtactttttaccaacaagagttaccagagagtaacttaaccgaagagcctttggaagtttcagctgctcctggcccagtggagcagaagacgggaatacctacagtatcctctacatcccactcacatgtagaggacctcctctttttctatcgacagaccttgccagatggtcatctaactgatcaggctctgaaagtctcagctgtgtctggaccagctgaccagaagactgggacagcaacagtactctctactccccactcacatagagagaagcctggtattttttaccaacaagagttcgcagacagtcatcaaactgaagagactcttactaaagtttcagccactcctggaccagctgaccagaagactgagataccagcagtacagtctagttcttactcacaaagagaaaagcctagtattttgtacccacaggacttagcagacagtcatctacctgaagagggtctgaaagtttcagctgttgctggaccagctgaccagaagactggcctaccaacagtaccctctagtgcatactcacacagagagaagctccttgttttctaccaacaggccttgctggacagccatctacccgaagaggctctgaaagtttcagctgtttctggaccagctgacggaaagactgggacaccagctgtaacctctacttcctctgcgtcctcttcacttggagaaaagcccagtgctttctatcagcagaccttacccaatagtcatctaactgaagaggctctgaaagtatcaattgttcctggaccaggtgatcagaagactgggataccctcagcaccatctagtttctactcacacagagagaagcccattattttttcccagcagaccctgccagactttcttttccctgaagaagctctgaaggtttcagctgtttctgtattggctgcccagaagactgggacaccaacagtgtcctctaattctcactcacatagcgagaaatctagtgttttctaccagcaagagttgccagacagtgatctacctagagaatctctgaaaatgtctgctattcctggactgactgaccagaagactgtcccaacaccaacagtaccttcaggttccttctcacatagagagaagcccagtattttctatcaacaggagtggccagatagttatgcaactgaaaaggctctgaaagtttcaactggccctggaccagctgaccagaagactgagataccagcagtacagtctagttcttacccacagagggagaagcctagtgttttgtacccacaggtgttatcagacagtcatctacctgaagagagtctgaaagtttcagccttccctggaccagctgaccagatgactgacacaccagcagtaccgtctactttctactcacaaagagagaagcctggtattttctaccaacagaccttgccagagagtcatctgcctaaagaggctctgaaaatttcagtagctcctggactagcagaccagaagactggcacaccaactgtaacctcaacttcctactcacaacatagagaaaagcccagcattttccaccagcaggccttgccaggtactcatatacctgaagaggctcagaaagtttcagctgttactggaccaggtaaccagaagacttggataccaagagtactttctaccttctactcacaaagagagaaacctggtattttctatcaacagaccttgccaggtagtcacatacctgaagaggcacagaaagtttcacctgttcttggaccagctgaccagaagactgggacaccaactccaacctctgcttcttactcacacacagagaagcctggtattttctaccaacaggtcttgccagataatcatccaactgaagaggctctgaaaatttcagttgcctctgaaccagttgaccagacaactggcacaccagctgtaacctctacttcctactcacaatatagagagaagcccagcattttctaccaacagtcgttgccaagtagtcatctaactgaagaggctaagaatgtttcagcggttcctggaccagctgaccagaagactgtgataccaattttaccctctactttctactcacacacagagaagcctggtgttttctaccaacaggtcttgccacatagtcatccaactgaagaggctctgaaaatttcagttgcctctgaaccagttgaccagacaactggcacaccaactgtaacctctacttcttactcacaacatacagagaagccgagtattttctaccaacagtcgttgccaggtagtcatctaactgaagaggctaagaacgtttcagcggttcctggaccaggtgaccggaagactgggataccaactttaccctctactttctactcacacacagagaagcctggtagtttctaccaacaggtcttgccacatagtcatctacctgaagaggctttggaagtttcagttgctcctggaccagttgaccagacgattggcacaccaactgtaacctccccttccagctcatttggagagaagcccattgttatctacaaacaggcctttccagagggtcatctacctgaagagtctctgaaagtttcagttgctcctggaccagttggccagacaactggcgcaccaactataacctctccttcctactcacaacatagagcaaagtctggcagtttctaccaactggcattgctaggtagtcaaatacctgaagaggctctcagagtttcttctgctcctggaccagctgaccagacaactggcataccaaccataacctctacttcctactcatttggagagaagccgattgttaactacaaacaggcctttccagatggtcatctacctgaagaggctctgaaagtttccattgtttctggacctactgaaaaaaagactgacataccagcaggacctttaggttccagtgcacttggagagaagcccattactttctaccggcaggctctgctagacagtcctctaaataaagaggttgtgaaagtttcagctgctcctggaccagctgaccagaagactgagacattaccagtacattctactagctactcaaatagggggaagcctgtcattttctaccagcagaccctatcagacagtcatttacctgaagaagctctgaaagttccacctgttcctggaccagatgcccagaagactgagacaccatcagtatcctctagtttatactcatatagagagaagcccattgtcttctaccaacaggccctgccagacagtgagctaactcaagaagctctgaaagtttcagctgttcctcaaccagctgaccagaagactgggttatctactgtaacttcctctttctattcacatacagagaagcctaatatttcttaccagcaagagttgccagatagtcatctaactgaagaggctctgaaagtttcaaatgttcctggaccagctgaccagaagactggggtatcaacagtaacctctacttcctactcacacagagagaagcccattgtttcctaccagcgagagttgccgcattttactgaagcaggtttgaaaattttaagagttcctggaccagctgaccagaagactggaataaacatcctgccctctaattcctacccacagagagagcactctgtcatttcttatgagcaggagttgccagatcttactgaagtaactttgaaagcaataggggttcctgggcctgctgaccagaagactgggatacaaatagcatcctctagttcctactcaaatagagagaaggccagtatttttcatcagcaggagttgccagatgttactgaagaagctttaaatgtttttgttgttcctggacaaggtgaccggaagactgagataccaacagtacctttaagttactactcacgtagagagaagcccagtgttatctctcaacaggagttgccagacagtcatctcacagaagaggctctgaaagtttcacctgtttctataccagcagagcagaagactgggataccaataggactgtctagttcctactcacattcacataaagagaaactcaagatttcaactgtgcatataccagatgaccagaaaactgagtttccagcagctacccttagttcctactcacaaatagagaagcccaagatttcaactgtgattggaccaaatgaccagaagactccatcccagacagcttttcatagttcctattctcaaacagtaaagcccaatattttatttcaacagcagttgccagatagagatcaaagtaaaggtattctaaagatttcagctgtccctgaactaactgatgtgaatactggaaaaccagtatctctctctagttcttattttcacagagagaaatcgaatattttcagtccacaggaattgccaggtagtcatgtaactgaagatgtgctgaaggtttcaacaattcctggaccagctggccagaaaacagtattaccaacagctcttcctagttccttttcacatcgagagaaaccagatattttctatcaaaaggatttgccagatagacatctaactgaagatgctctaaagatctcaagtgctcttgggcaagctgatcaaattaccggattacaaacagttccctctggtacttactcacatggtgagaatcacaagcttgtttcagaacatgtccaaaggctaatagataatttgaattcttctgactccagtgttagctcaaataatgtgcttttaaattctcaggctgatgacagagttgtaataaataaaccagaatctgcaggttttagagatgttggctctgaagaaatccaggatgcagaaaatagtgctaaaactcttaaggaaattcggacacttttgatggaggcagaaaatatggcactgaaacgatgcaattttcctgctccccttgcccgtttcagagatattagtgatatttcatttatacaatctaagaaggtggtttgcttcaaagaaccctcttccacgggtgtatctaatggtgatttgcttcacagacagccattcacagaggaaagcccaagcagcaggtgcatacagaaggatattggcacacagacgaatttgaaatgccggagaggcattgaaaattgggagtttattagttcaactacagttagaagtcctctacaggaagcagagagcaaagtcagtatggcattagaagaaactcttaggcaatatcaagcagccaaatctgtaatgaggtctgaacctgaagggtgtagtggaaccattgggaataaaattattatccctatgatgactgtcataaaaagtgattcaagtagtgatgccagtgatggaaatggttcctgctcgtgggacagtaatttaccagagtctttggaatcagtttctgatgttcttctaaacttctttccatatgtttcacccaagacaagtataacagatagcagggaggaagagggtgtgtcagagagtgaggatggtggtggtagcagtgtagattcactggctgcacatgtgaaaaaccttctgcaatgtgaatcctcactgaatcatgctaaagaaatactcagaaatgcagaggaagaggaaagccgggtacgagcacatgcctggaatatgaagttcaatttagcacatgattgtggatactccatttcagaattaaatgaagatgacaggaggaaagtagaagagatcaaggcagagttatttggtcatggaagaacaactgacttgtccaagggtttacagagtccacggggaatgggatgcaagccagaagctgtatgtagtcacattattattgagagccatgaaaagggatgtttccggactctaacttctgaacatccacaactagatagacacccttgtgctttcagatctgctggaccctcagaaatgaccagaggacggcagaacccatcatcatgcagagccaagcatgtcaacctttctgcatccttagaccagaacaactcccatttcaaagtttggaattccttgcagttaaaaagtcattccccatttcagaactttatacctgatgaattcaaaatcagcaaaggtcttcgaatgccattcgatgaaaagatggacccttggctgtcagaattagtagaacctgcttttgtgccacctaaagaagtggattttcattcttcatcacaaatgccgtccccagaacccatgaaaaagtttactacctccatcactttttcatctcaccgacattctaaatgcatttccaattcctctgttgttaaggttggtgttactgaaggtagccagtgtactggagcatctgtgggggtatttaattctcatttcactgaagaacaaaatcctcccagagatcttaaacagaaaacctcttccccttcatcatttaaaatgcatagtaattcacaagataaagaagtgactattttagcagaaggtagaaggcaaagccaaaaattacctgttgattttgagcgttcttttcaagaagaaaaacccttagaaagatcagattttacaggcagtcattctgagcccagtaccagggcaaattgtagcaatttcaaggaaattcagatttctgataaccatacccttattagcatgggcagaccaagttccaccctaggagtaaacagatcgagttccagactaggagtaaaagagaagaatgtaactataactccagatcttccttcttgcatttttcttgaacaacgagagctctttgaacaaagcaaagccccacgtgcagatgaccatgtgaggaaacaccattctccctctcctcaacatcaggattatgtagctccagaccttccttcttgcatttttcttgaacaacgagaactctttgaacagtgcaaagccccatatgtagatcatcaaatgagagaaaaccattctccccttcctcaaggtcaggattctatagcttcagaccttccgtctcccatttctcttgaacaatgccaaagcaaagcgccaggtgtagatgaccaaatgaataaacaccattttccccttcctcaaggtcaggattgtgtagtggaaaagaataatcaacataagcctaaatcacacatttctaatataaatgttgaagccaagttcaatactgtggtctcccagtcagccccaaatcactgtacattagcagcatctgcatctactcctccttcaaatagaaaagcactttcttgtgttcatataactctttgtcccaagacttcttccaagttggatagtggaactttagatgaaagattccattcattggatgctgcttctaaagcgaggatgaatagtgagtttaactttgacttacatactgtatcttcgagatcactggaaccaacctccaaattattgaccagtaaacctgtagcacaggatcaagaatctttaggttttctaggacctaaatcttcactggatttccaagtcgtacagccttctcttccagacagtaacactattactcaggacttgaaaaccataccttctcagaatagccagatagtaacctccaggcaaatacaagtgaacatttcagatttcgaaggacattccaatccagaggggaccccagtatttgcagatcgattaccagagaagatgaagaccccactttctgctttctctgaaaaattgtcatctgatgcagtcactcagataacaacagaaagtccagaaaagaccctattttcatctgagatttttattaatgctgaagatcgtggacatgaaattatagagcctggtaaccagaagctacgcaaagctcctgtcaagtttgcctcatcatcttcagtccaacaggttactttttctcgcggcacagatggccagcctttattattgccatataagccttctggtagtaccaagatgtattatgttccacaattaagacaaattcctccatctccggattccaaatcagataccaccgttgaaagctcccattcaggatccaatgatgccattgctccagacttcccagctcaggtgctaggcacaagagatgatgacctctcagccactgttaacattaaacataaagaaggaatctacagtaagagggtagtgactaaggcatccttgccagtgggagaaaaacccttgcagaatgaaaatgcagatgcctcagttcaagtgctaatcactggggatgagaacctctcagacaaaaaacagcaagagattcacagtacaagggcagtgactgaggctgcccaggctaaagaaaaagaatctttgcagaaagatactgcagattccagtgctgctgctgctgcagagcactcagctcaagtaggagacccagaaatgaagaacttgccagacactaaagccattacacagaaagaggagatccataggaagaagacagttcccgaggaagcctggccaaacaataaagaatccctacagatcaatattgaagagtccgaatgtcattcagaatttgaaaatactacccgttctgtcttcaggtcagcaaagttttacattcatcatcccgtacacctaccaagtgatcaagatatttgccatgaatctttgggaaagagtgttttcatgagacattcttggaaagatttctttcagcatcatccagacaaacatagagaacacatgtgtcttcctcttccttatcaaaacatggacaagactaagacagattataccagaataaagagcctcagcatcaatgtgaatttgggaaacaaagaagtgatggatactactaaaagtcaagttagagattatccaaaacataatggacaaattagtgatccacaaagggatcagaaggtcaccccagagcaaacaactcagcacactgtgagtttgaatgaactgtggaacaagtatcgggagcgacagaggcaacagagacagcctgagttgggtgacaggaaagaactgtccttggtggaccgacttgatcgtttggctaaaattcttcagaatccaatcacacattctctccaggtctcagaaagtacacatgatgatagcagaggggaacgaagtgtgaaggaatggagtggtagacaacagcagagaaataagcttcagaaaaagaagcggtttaaaagcctagagaaaagccataaaaatacaggcgagcttaaaaaaagcaaggtgctttctcatcatcgagctgggaggtctaatcaaattaaaattgaacagattaaatttgataaatatattctgagtaaacagccaggttttaattatataagcaacacttcttcggattgtcggccctcagaggagagtgagctgctcacagatactaccaccaacatcctttccggcaccacttctactgtcgaatcagatatattgacccaaacagatagagaggtggctctgcacgaaaggagtagctctgtttccactattgacactgcccggctgattcaagcttttggccatgaaagagtatgcttgtcacccagacgaattaaattatatagcagcatcaccaaccaacagaggagataccttgagaagcggagcaaacacagcaagaaagtgctgaatacaggtcatcccctagtgacttctgagcacaccagaaggagacacatccaggtagcaaaccatgtgatttcttctgactctatttcctcttctgccagtagtttcctgagctcaaactctactttttgcaacaagcagaatgtacacatgttaaacaagggcatacaagcaggtaacttggagattgtgaacggtgccaaaaaacacactcgagatgttgggataactttcccaactccaagttccagcgaggctaaattggaagagaacagtgatgtgacttcttggtcagaagaaaaacgtgaagagaaaatgctctttaccggttatcctgaggacagaaagttaaaaaagaacaagaagaattcccatgaaggagtttcctggtttgttcctgtggaaaatgtggagtctagatcaaagaaggaaaacgtgcctaacacttgtggccctggcatctcctggtttgaaccaataaccaagaccagaccctggagggagccactgcgggagcagaactgtcaggggcagcacctggacggtcggggctacctggcaggcccaggcagagaggctggcagagacctactgaggccatttgtgagagcaacccttcaggaatcgcttcagtttcacagacctgacttcatctcccgctctggggagcggataaagcgcctgaagttaatagtccaggagaggaagctgcagagcatgttacagaccgagcgggatgcactattcaacattgacagggaacggcagggccaccagaatcgcatgtgcccgctgcccaagagagtcttcctggctatccagaagaacaagcctatcagcaagaaggaaatgattcagaggtccaaacggatttatgagcagcttccagaagtacagaaaaagagagaagaagagaagagaaaatcagaatataagtcataccggctgcgagcccagctatataaaaagagagtgaccaatcaacttctggggagaaaagttccctgggactgacacaagtttattttcctcagagccttggaattctattttatgaacctagagaagcagaatccttacttttgtgagtctggttgaataaagcttattctttgtc

SEQ ID NO: 106788 - DNA, 11700 bp, Homo sapiens
  Payload ID: 968
  Gene Symbol: ALMS1
  Gene Name: Alstrom syndrome protein 1
  ENST ID: ENST00000614410
  CDS Start-End: 1-11580
atggagcccgaggatctgccatggccgggcgagctggaggaggaggaggaggaggaggaggaggaggaggaggaagaggaggaggctgcagcggcggcggcggcgaacgtggacgacgtagtggtcgtggaggaggtggaggaagaggcggggcgggagttggactccgactctcactacgggccccagcatctggaaagtatagacgacgaggaggacgaggaggccaaggcctggctgcaggcgcaccccggcaggattttgcctccgctgtcgcccccgcagcaccgctactcggagggcgagcggacctccctggagaagattgttccattgacctgtcatgtatggcaacagatagtatatcaaggcaatagtagaacacaaatttctgatactaatgtggtctgtttggaaacaacagctcagcggggttctggggatgatcagaaaacagaatcttggcattgtcttcctcaagaaatggactcttcccaaaccttggatacatcccagactaggtttaatgtgagaacggaagatactgaagtgacagacttcccctctctggaggagggcatattgacgcaatcagaaaatcaagtaaaggaacccaacagagatctcttctgttctccactgctagtcatacaagatagctttgcttctcctgatttgcctttgctgacctgtttgacacaagaccaagaatttgcgcctgattctttatttcatcaaagtgaactaagttttgcacctctgaggggaattcctgataagtctgaagatactgaatggtcttctcgaccatcggaagttagtgaagctttattccaggctactgcagaagtagcttcagacttagcaagcagtcgctttagtgtatctcagcacccgcttataggcagcacagctgttgggtctcagtgcccttttttaccttctgaacaagggaataatgaagagactatttcgtctgttgatgaactgaaaattcccaaagactgtgatcgttatgatgatctttgttcatatatgtcatggaagacacgaaaagatacacagtggcctgaaaacaatttagctgataaagatcaagtttcagttgcaacttcatttgacataactgatgaaaacatagctactaaaagaagtgaccattttgatgctgctcgttcatatgggcagtattggacacaggaagattcatctaagcaggcagaaacatatttaaccaagggcctgcaggggaaggttgagtctgacgtcattactctggatggcctaaatgaaaatgctgttgtatgcagtgaaagagttgctgaactacaaagaaagccaacaagagagtcggaatatcactcttcagatctcagaatgttgaggatgtctcctgacactgtgccaaaggctcctaaacatttaaaagcaggagacacttctaaaggaggcatagctaaagttactcaatccaacttgaagtcaggcatcactaccactcctgttgattcagacattggatctcatttatccttgtcccttgaggacctgtctcagttggctgtaagttctcctctagaaactactactggtcaacacactgatactctcaaccaaaagacattagcagatactcatctaactgaagagactctgaaagtcacagctattcctgaaccagctgaccagaagactgcaacaccaacagtactctctagttcccactcacatagggggaagcccagcattttctaccagcagggcttgccagacagtcatctaactgaagaggctttgaaagtttcagctgctcctggactagctgaccagacaactggcatgtcaactctaacctctacttcctactcacatagagagaagcctggtactttttaccaacaagagttaccagagagtaacttaaccgaagagcctttggaagtttcagctgctcctggcccagtggagcagaagacgggaatacctacagtatcctctacatcccactcacatgtagaggacctcctctttttctatcgacagaccttgccagatggtcatctaactgatcaggctctgaaagtctcagctgtgtctggaccagctgaccagaagactgggacagcaacagtactctctactccccactcacatagagagaagcctggtattttttaccaacaagagttcgcagacagtcatcaaactgaagagactcttactaaagtttcagccactcctggaccagctgaccagaagactgagataccagcagtacagtctagttcttactcacaaagagaaaagcctagtattttgtacccacaggacttagcagacagtcatctacctgaagagggtctgaaagtttcagctgttgctggaccagctgaccagaagactggcctaccaacagtaccctctagtgcatactcacacagagagaagctccttgttttctaccaacaggccttgctggacagccatctacccgaagaggctctgaaagtttcagctgtttctggaccagctgacggaaagactgggacaccagctgtaacctctacttcctctgcgtcctcttcacttggagaaaagcccagtgctttctatcagcagaccttacccaatagtcatctaactgaagaggctctgaaagtatcaattgttcctggaccaggtgatcagaagactgggataccctcagcaccatctagtttctactcacacagagagaagcccattattttttcccagcagaccctgccagactttcttttccctgaagaagctctgaaggtttcagctgtttctgtattggctgcccagaagactgggacaccaacagtgtcctctaattctcactcacatagcgagaaatctagtgttttctaccagcaagagttgccagacagtgatctacctagagaatctctgaaaatgtctgctattcctggactgactgaccagaagactgtcccaacaccaacagtaccttcaggttccttctcacatagagagaagcccagtattttctatcaacaggagtggccagatagttatgcaactgaaaaggctctgaaagtttcaactggccctggaccagctgaccagaagactgagataccagcagtacagtctagttcttacccacagagggagaagcctagtgttttgtacccacaggtgttatcagacagtcatctacctgaagagagtctgaaagtttcagccttccctggaccagctgaccagatgactgacacaccagcagtaccgtctactttctactcacaaagagagaagcctggtattttctaccaacagaccttgccagagagtcatctgcctaaagaggctctgaaaatttcagtagctcctggactagcagaccagaagactggcacaccaactgtaacctcaacttcctactcacaacatagagaaaagcccagcattttccaccagcaggccttgccaggtactcatatacctgaagaggctcagaaagtttcagctgttactggaccaggtaaccagaagacttggataccaagagtactttctaccttctactcacaaagagagaaacctggtattttctatcaacagaccttgccaggtagtcacatacctgaagaggcacagaaagtttcacctgttcttggaccagctgaccagaagactgggacaccaactccaacctctgcttcttactcacacacagagaagcctggtattttctaccaacaggtcttgccagataatcatccaactgaagaggctctgaaaatttcagttgcctctgaaccagttgaccagacaactggcacaccagctgtaacctctacttcctactcacaatatagagagaagcccagcattttctaccaacagtcgttgccaagtagtcatctaactgaagaggctaagaatgtttcagcggttcctggaccagctgaccagaagactgtgataccaattttaccctctactttctactcacacacagagaagcctggtgttttctaccaacaggtcttgccacatagtcatccaactgaagaggctctgaaaatttcagttgcctctgaaccagttgaccagacaactggcacaccaactgtaacctctacttcttactcacaacatacagagaagccgagtattttctaccaacagtcgttgccaggtagtcatctaactgaagaggctaagaacgtttcagcggttcctggaccaggtgaccggaagactgggataccaactttaccctctactttctactcacacacagagaagcctggtagtttctaccaacaggtcttgccacatagtcatctacctgaagaggctttggaagtttcagttgctcctggaccagttgaccagacgattggcacaccaactgtaacctccccttccagctcatttggagagaagcccattgttatctacaaacaggcctttccagagggtcatctacctgaagagtctctgaaagtttcagttgctcctggaccagttggccagacaactggcgcaccaactataacctctccttcctactcacaacatagagcaaagtctggcagtttctaccaactggcattgctaggtagtcaaatacctgaagaggctctcagagtttcttctgctcctggaccagctgaccagacaactggcataccaaccataacctctacttcctactcatttggagagaagccgattgttaactacaaacaggcctttccagatggtcatctacctgaagaggctctgaaagtttccattgtttctggacctactgaaaaaaagactgacataccagcaggacctttaggttccagtgcacttggagagaagcccattactttctaccggcaggctctgctagacagtcctctaaataaagaggttgtgaaagtttcagctgctcctggaccagctgaccagaagactgagacattaccagtacattctactagctactcaaatagggggaagcctgtcattttctaccagcagaccctatcagacagtcatttacctgaagaagctctgaaagttccacctgttcctggaccagatgcccagaagactgagacaccatcagtatcctctagtttatactcatatagagagaagcccattgtcttctaccaacaggccctgccagacagtgagctaactcaagaagctctgaaagtttcagctgttcctcaaccagctgaccagaagactgggttatctactgtaacttcctctttctattcacatacagagaagcctaatatttcttaccagcaagagttgccagatagtcatctaactgaagaggctctgaaagtttcaaatgttcctggaccagctgaccagaagactggggtatcaacagtaacctctacttcctactcacacagagagaagcccattgtttcctaccagcgagagttgccgcattttactgaagcaggtttgaaaattttaagagttcctggaccagctgaccagaagactggaataaacatcctgccctctaattcctacccacagagagagcactctgtcatttcttatgagcaggagttgccagatcttactgaagtaactttgaaagcaataggggttcctgggcctgctgaccagaagactgggatacaaatagcatcctctagttcctactcaaatagagagaaggccagtatttttcatcagcaggagttgccagatgttactgaagaagctttaaatgtttttgttgttcctggacaaggtgaccggaagactgagataccaacagtacctttaagttactactcacgtagagagaagcccagtgttatctctcaacaggagttgccagacagtcatctcacagaagaggctctgaaagtttcacctgtttctataccagcagagcagaagactgggataccaataggactgtctagttcctactcacattcacataaagagaaactcaagatttcaactgtgcatataccagatgaccagaaaactgagtttccagcagctacccttagttcctactcacaaatagagaagcccaagatttcaactgtgattggaccaaatgaccagaagactccatcccagacagcttttcatagttcctattctcaaacagtaaagcccaatattttatttcaacagcagttgccagatagagatcaaagtaaaggtattctaaagatttcagctgtccctgaactaactgatgtgaatactggaaaaccagtatctctctctagttcttattttcacagagagaaatcgaatattttcagtccacaggaattgccaggtagtcatgtaactgaagatgtgctgaaggtttcaacaattcctggaccagctggccagaaaacagtattaccaacagctcttcctagttccttttcacatcgagagaaaccagatattttctatcaaaaggatttgccagatagacatctaactgaagatgctctaaagatctcaagtgctcttgggcaagctgatcaaattaccggattacaaacagttccctctggtacttactcacatggtgagaatcacaagcttgtttcagaacatgtccaaaggctaatagataatttgaattcttctgactccagtgttagctcaaataatgtgcttttaaattctcaggctgatgacagagttgtaataaataaaccagaatctgcaggttttagagatgttggctctgaagaaatccaggatgcagaaaatagtgctaaaactcttaaggaaattcggacacttttgatggaggcagaaaatatggcactgaaacgatgcaattttcctgctccccttgcccgtttcagagatattagtgatatttcatttatacaatctaagaaggtggtttgcttcaaagaaccctcttccacgggtgtatctaatggtgatttgcttcacagacagccattcacagaggaaagcccaagcagcaggtgcatacagaaggatattggcacacagacgaatttgaaatgccggagaggcattgaaaattgggagtttattagttcaactacagttagaagtcctctacaggaagcagagagcaaagtcagtatggcattagaagaaactcttaggcaatatcaagcagccaaatctgtaatgaggtctgaacctgaagggtgtagtggaaccattgggaataaaattattatccctatgatgactgtcataaaaagtgattcaagtagtgatgccagtgatggaaatggttcctgctcgtgggacagtaatttaccagagtctttggaatcagtttctgatgttcttctaaacttctttccatatgtttcacccaagacaagtataacagatagcagggaggaagagggtgtgtcagagagtgaggatggtggtggtagcagtgtagattcactggctgcacatgtgaaaaaccttctgcaatgtgaatcctcactgaatcatgctaaagaaatactcagaaatgcagaggaagaggaaagccgggtacgagcacatgcctggaatatgaagttcaatttagcacatgattgtggatactccatttcagaattaaatgaagatgacaggaggaaagtagaagagatcaaggcagagttatttggtcatggaagaacaactgacttgtccaagggtttacagagtccacggggaatgggatgcaagccagaagctgtatgtagtcacattattattgagagccatgaaaagggatgtttccggactctaacttctgaacatccacaactagatagacacccttgtgctttcagatctgctggaccctcagaaatgaccagaggacggcagaacccatcatcatgcagagccaagcatgtcaacctttctgcatccttagaccagaacaactcccatttcaaagtttggaattccttgcagttaaaaagtcattccccatttcagaactttatacctgatgaattcaaaatcagcaaaggtcttcgaatgccattcgatgaaaagatggacccttggctgtcagaattagtagaacctgcttttgtgccacctaaagaagtggattttcattcttcatcacaaatgccgtccccagaacccatgaaaaagtttactacctccatcactttttcatctcaccgacattctaaatgcatttccaattcctctgttgttaaggttggtgttactgaaggtagccagtgtactggagcatctgtgggggtatttaattctcatttcactgaagaacaaaatcctcccagagatcttaaacagaaaacctcttccccttcatcatttaaaatgcatagtaattcacaagataaagaagtgactattttagcagaaggtagaaggcaaagccaaaaattacctgttgattttgagcgttcttttcaagaagaaaaacccttagaaagatcagattttacaggcagtcattctgagcccagtaccagggcaaattgtagcaatttcaaggaaattcagatttctgataaccatacccttattagcatgggcagaccaagttccaccctaggagtaaacagatcgagttccagactaggagtaaaagagaagaatgtaactataactccagatcttccttcttgcatttttcttgaacaacgagagctctttgaacaaagcaaagccccacgtgcagatgaccatgtgaggaaacaccattctccctctcctcaacatcaggattatgtagctccagaccttccttcttgcatttttcttgaacaacgagaactctttgaacagtgcaaagccccatatgtagatcatcaaatgagagaaaaccattctccccttcctcaaggtcaggattctatagcttcagaccttccgtctcccatttctcttgaacaatgccaaagcaaagcgccaggtgtagatgaccaaatgaataaacaccattttccccttcctcaaggtcaggattgtgtagtggaaaagaataatcaacataagcctaaatcacacatttctaatataaatgttgaagccaagttcaatactgtggtctcccagtcagccccaaatcactgtacattagcagcatctgcatctactcctccttcaaatagaaaagcactttcttgtgttcatataactctttgtcccaagacttcttccaagttggatagtggaactttagatgaaagattccattcattggatgctgcttctaaagcgaggatgaatagtgagtttaactttgacttacatactgtatcttcgagatcactggaaccaacctccaaattattgaccagtaaacctgtagcacaggatcaagaatctttaggttttctaggacctaaatcttcactggatttccaagtcgtacagccttctcttccagacagtaacactattactcaggacttgaaaaccataccttctcagaatagccagatagtaacctccaggcaaatacaagtgaacatttcagatttcgaaggacattccaatccagaggggaccccagtatttgcagatcgattaccagagaagatgaagaccccactttctgctttctctgaaaaattgtcatctgatgcagtcactcagataacaacagaaagtccagaaaagaccctattttcatctgagatttttattaatgctgaagatcgtggacatgaaattatagagcctggtaaccagaagctacgcaaagctcctgtcaagtttgcctcatcatcttcagtccaacaggttactttttctcgcggcacagatggccagcctttattattgccatataagccttctggtagtaccaagatgtattatgttccacaattaagacaaattcctccatctccggattccaaatcagataccaccgttgaaagctcccattcaggatccaatgatgccattgctccagacttcccagctcaggtgctaggcacaagagatgatgacctctcagccactgttaacattaaacataaagaaggaatctacagtaagagggtagtgactaaggcatccttgccagtgggagaaaaacccttgcagaatgaaaatgcagatgcctcagttcaagtgctaatcactggggatgagaacctctcagacaaaaaacagcaagagattcacagtacaagggcagtgactgaggctgcccaggctaaagaaaaagaatctttgcagaaagatactgcagattccagtgctgctgctgctgcagagcactcagctcaagtaggagacccagaaatgaagaacttgccagacactaaagccattacacagaaagaggagatccataggaagaagacagttcccgaggaagcctggccaaacaataaagaatccctacagatcaatattgaagagtccgaatgtcattcagaatttgaaaatactacccgttctgtcttcaggtcagcaaagttttacattcatcatcccgtacacctaccaagtgatcaagatatttgccatgaatctttgggaaagagtgttttcatgagacattcttggaaagatttctttcagcatcatccagacaaacatagagaacacatgtgtcttcctcttccttatcaaaacatggacaagactaagacagattataccagaataaagagcctcagcatcaatgtgaatttgggaaacaaagaagtgatggatactactaaaagtcaagttagagattatccaaaacataatggacaaattagtgatccacaaagggatcagaaggtcaccccagagcaaacaactcagcacactgtgagtttgaatgaactgtggaacaagtatcgggagcgacagaggcaacagagacagcctgagttgggtgacaggaaagaactgtccttggtggaccgacttgatcgtttggctaaaattcttcagaatccaatcacacattctctccaggtctcagaaagtacacatgatgatagcagaggggaacgaagtgtgaaggaatggagtggtagacaacagcagagaaataagcttcagaaaaagaagcggtttaaaagcctagagaaaagccataaaaatacaggcgagcttaaaaaaagcaaggtgctttctcatcatcgagctgggaggtctaatcaaattaaaattgaacagattaaatttgataaatatattctgagtaaacagccaggttttaattatataagcaacacttcttcggattgtcggccctcagaggagagtgagctgctcacagatactaccaccaacatcctttccggcaccacttctactgtcgaatcagatatattgacccaaacagatagagaggtggctctgcacgaaaggagtagctctgtttccactattgacactgcccggctgattcaagcttttggccatgaaagagtatgcttgtcacccagacgaattaaattatatagcagcatcaccaaccaacagaggagataccttgagaagcggagcaaacacagcaagaaagtgctgaatacaggtcatcccctagtgacttctgagcacaccagaaggagacacatccaggtacatggctacagattccatctggcaatgtgactgccctcttcatggactttttagttaagctttgcacacaggtgaaaaaaacaagccatttgccctttcctctctataccatttcttaccaactggaaaagagtgagaaagtgtagtaca

SEQ ID NO: 106789 - DNA, 12925 bp, Homo sapiens
  Payload ID: 968
  Gene Symbol: ALMS1
  Gene Name: Alstrom syndrome protein 1
  ENST ID: ENST00000613296
  CDS Start-End: 112-12618
aggcgggcggcactgcgcctaagctgggccacaaccgccagtcagggctctccccttcccctccctccccccctcctcctcctcctctgccgcccagagcgagacaccaacatggagcccgaggatctgccatggccgggcgagctggaggaggaggaggaggaggaggaggaggaggaggaggaagaggaggaggctgcagcggcggcggcggcgaacgtggacgacgtagtggtcgtggaggaggtggaggaagaggcggggcgggagttggactccgactctcactacgggccccagcatctggaaagtatagacgacgaggaggacgaggaggccaaggcctggctgcaggcgcaccccggcaggattttgcctccgctgtcgcccccgcagcaccgctactcggagggcgagcggacctccctggagaagattgttccattgacctgtcatgtatggcaacagatagtatatcaaggcaatagtagaacacaaatttctgatactaatgtggtctgtttggaaacaacagctcagcggggttctggggatgatcagaaaacagaatcttggcattgtcttcctcaagaaatggactcttcccaaaccttggatacatcccagactaggtttaatgtgagaacggaagatactgaagtgacagacttcccctctctggaggagggcatattgacgcaatcagaaaatcaagtaaaggaacccaacagagatctcttctgttctccactgctagtcatacaagatagctttgcttctcctgatttgcctttgctgacctgtttgacacaagaccaagaatttgcgcctgattctttatttcatcaaagtgaactaagttttgcacctctgaggggaattcctgataagtctgaagatactgaatggtcttctcgaccatcggaagttagtgaagctttattccaggctactgcagaagtagcttcagacttagcaagcagtcgctttagtgtatctcagcacccgcttataggcagcacagctgttgggtctcagtgcccttttttaccttctgaacaagggaataatgaagagactatttcgtctgttgatgaactgaaaattcccaaagactgtgatcgttatgatgatctttgttcatatatgtcatggaagacacgaaaagatacacagtggcctgaaaacaatttagctgataaagatcaagtttcagttgcaacttcatttgacataactgatgaaaacatagctactaaaagaagtgaccattttgatgctgctcgttcatatgggcagtattggacacaggaagattcatctaagcaggcagaaacatatttaaccaagggcctgcaggggaaggttgagtctgacgtcattactctggatggcctaaatgaaaatgctgttgtatgcagtgaaagagttgctgaactacaaagaaagccaacaagagagtcggaatatcactcttcagatctcagaatgttgaggatgtctcctgacactgtgccaaaggctcctaaacatttaaaagcaggagacacttctaaaggaggcatagctaaagttactcaatccaacttgaagtcaggcatcactaccactcctgttgattcagacattggatctcatttatccttgtcccttgaggacctgtctcagttggctgtaagttctcctctagaaactactactggtcaacacactgatactctcaaccaaaagacattagcagatactcatctaactgaagagactctgaaagtcacagctattcctgaaccagctgaccagaagactgcaacaccaacagtactctctagttcccactcacatagggggaagcccagcattttctaccagcagggcttgccagacagtcatctaactgaagaggctttgaaagtttcagctgctcctggactagctgaccagacaactggcatgtcaactctaacctctacttcctactcacatagagagaagcctggtactttttaccaacaagagttaccagagagtaacttaaccgaagagcctttggaagtttcagctgctcctggcccagtggagcagaagacgggaatacctacagtatcctctacatcccactcacatgtagaggacctcctctttttctatcgacagaccttgccagatggtcatctaactgatcaggctctgaaagtctcagctgtgtctggaccagctgaccagaagactgggacagcaacagtactctctactccccactcacatagagagaagcctggtattttttaccaacaagagttcgcagacagtcatcaaactgaagagactcttactaaagtttcagccactcctggaccagctgaccagaagactgagataccagcagtacagtctagttcttactcacaaagagaaaagcctagtattttgtacccacaggacttagcagacagtcatctacctgaagagggtctgaaagtttcagctgttgctggaccagctgaccagaagactggcctaccaacagtaccctctagtgcatactcacacagagagaagctccttgttttctaccaacaggccttgctggacagccatctacccgaagaggctctgaaagtttcagctgtttctggaccagctgacggaaagactgggacaccagctgtaacctctacttcctctgcgtcctcttcacttggagaaaagcccagtgctttctatcagcagaccttacccaatagtcatctaactgaagaggctctgaaagtatcaattgttcctggaccaggtgatcagaagactgggataccctcagcaccatctagtttctactcacacagagagaagcccattattttttcccagcagaccctgccagactttcttttccctgaagaagctctgaaggtttcagctgtttctgtattggctgcccagaagactgggacaccaacagtgtcctctaattctcactcacatagcgagaaatctagtgttttctaccagcaagagttgccagacagtgatctacctagagaatctctgaaaatgtctgctattcctggactgactgaccagaagactgtcccaacaccaacagtaccttcaggttccttctcacatagagagaagcccagtattttctatcaacaggagtggccagatagttatgcaactgaaaaggctctgaaagtttcaactggccctggaccagctgaccagaagactgagataccagcagtacagtctagttcttacccacagagggagaagcctagtgttttgtacccacaggtgttatcagacagtcatctacctgaagagagtctgaaagtttcagccttccctggaccagctgaccagatgactgacacaccagcagtaccgtctactttctactcacaaagagagaagcctggtattttctaccaacagaccttgccagagagtcatctgcctaaagaggctctgaaaatttcagtagctcctggactagcagaccagaagactggcacaccaactgtaacctcaacttcctactcacaacatagagaaaagcccagcattttccaccagcaggccttgccaggtactcatatacctgaagaggctcagaaagtttcagctgttactggaccaggtaaccagaagacttggataccaagagtactttctaccttctactcacaaagagagaaacctggtattttctatcaacagaccttgccaggtagtcacatacctgaagaggcacagaaagtttcacctgttcttggaccagctgaccagaagactgggacaccaactccaacctctgcttcttactcacacacagagaagcctggtattttctaccaacaggtcttgccagataatcatccaactgaagaggctctgaaaatttcagttgcctctgaaccagttgaccagacaactggcacaccagctgtaacctctacttcctactcacaatatagagagaagcccagcattttctaccaacagtcgttgccaagtagtcatctaactgaagaggctaagaatgtttcagcggttcctggaccagctgaccagaagactgtgataccaattttaccctctactttctactcacacacagagaagcctggtgttttctaccaacaggtcttgccacatagtcatccaactgaagaggctctgaaaatttcagttgcctctgaaccagttgaccagacaactggcacaccaactgtaacctctacttcttactcacaacatacagagaagccgagtattttctaccaacagtcgttgccaggtagtcatctaactgaagaggctaagaacgtttcagcggttcctggaccaggtgaccggaagactgggataccaactttaccctctactttctactcacacacagagaagcctggtagtttctaccaacaggtcttgccacatagtcatctacctgaagaggctttggaagtttcagttgctcctggaccagttgaccagacgattggcacaccaactgtaacctccccttccagctcatttggagagaagcccattgttatctacaaacaggcctttccagagggtcatctacctgaagagtctctgaaagtttcagttgctcctggaccagttggccagacaactggcgcaccaactataacctctccttcctactcacaacatagagcaaagtctggcagtttctaccaactggcattgctaggtagtcaaatacctgaagaggctctcagagtttcttctgctcctggaccagctgaccagacaactggcataccaaccataacctctacttcctactcatttggagagaagccgattgttaactacaaacaggcctttccagatggtcatctacctgaagaggctctgaaagtttccattgtttctggacctactgaaaaaaagactgacataccagcaggacctttaggttccagtgcacttggagagaagcccattactttctaccggcaggctctgctagacagtcctctaaataaagaggttgtgaaagtttcagctgctcctggaccagctgaccagaagactgagacattaccagtacattctactagctactcaaatagggggaagcctgtcattttctaccagcagaccctatcagacagtcatttacctgaagaagctctgaaagttccacctgttcctggaccagatgcccagaagactgagacaccatcagtatcctctagtttatactcatatagagagaagcccattgtcttctaccaacaggccctgccagacagtgagctaactcaagaagctctgaaagtttcagctgttcctcaaccagctgaccagaagactgggttatctactgtaacttcctctttctattcacatacagagaagcctaatatttcttaccagcaagagttgccagatagtcatctaactgaagaggctctgaaagtttcaaatgttcctggaccagctgaccagaagactggggtatcaacagtaacctctacttcctactcacacagagagaagcccattgtttcctaccagcgagagttgccgcattttactgaagcaggtttgaaaattttaagagttcctggaccagctgaccagaagactggaataaacatcctgccctctaattcctacccacagagagagcactctgtcatttcttatgagcaggagttgccagatcttactgaagtaactttgaaagcaataggggttcctgggcctgctgaccagaagactgggatacaaatagcatcctctagttcctactcaaatagagagaaggccagtatttttcatcagcaggagttgccagatgttactgaagaagctttaaatgtttttgttgttcctggacaaggtgaccggaagactgagataccaacagtacctttaagttactactcacgtagagagaagcccagtgttatctctcaacaggagttgccagacagtcatctcacagaagaggctctgaaagtttcacctgtttctataccagcagagcagaagactgggataccaataggactgtctagttcctactcacattcacataaagagaaactcaagatttcaactgtgcatataccagatgaccagaaaactgagtttccagcagctacccttagttcctactcacaaatagagaagcccaagatttcaactgtgattggaccaaatgaccagaagactccatcccagacagcttttcatagttcctattctcaaacagtaaagcccaatattttatttcaacagcagttgccagatagagatcaaagtaaaggtattctaaagatttcagctgtccctgaactaactgatgtgaatactggaaaaccagtatctctctctagttcttattttcacagagagaaatcgaatattttcagtccacaggaattgccaggtagtcatgtaactgaagatgtgctgaaggtttcaacaattcctggaccagctggccagaaaacagtattaccaacagctcttcctagttccttttcacatcgagagaaaccagatattttctatcaaaaggatttgccagatagacatctaactgaagatgctctaaagatctcaagtgctcttgggcaagctgatcaaattaccggattacaaacagttccctctggtacttactcacatggtgagaatcacaagcttgtttcagaacatgtccaaaggctaatagataatttgaattcttctgactccagtgttagctcaaataatgtgcttttaaattctcaggctgatgacagagttgtaataaataaaccagaatctgcaggttttagagatgttggctctgaagaaatccaggatgcagaaaatagtgctaaaactcttaaggaaattcggacacttttgatggaggcagaaaatatggcactgaaacgatgcaattttcctgctccccttgcccgtttcagagatattagtgatatttcatttatacaatctaagaaggtggtttgcttcaaagaaccctcttccacgggtgtatctaatggtgatttgcttcacagacagccattcacagaggaaagcccaagcagcaggtgcatacagaaggatattggcacacagacgaatttgaaatgccggagaggcattgaaaattgggagtttattagttcaactacagttagaagtcctctacaggaagcagagagcaaagtcagtatggcattagaagaaactcttaggcaatatcaagcagccaaatctgtaatgaggtctgaacctgaagggtgtagtggaaccattgggaataaaattattatccctatgatgactgtcataaaaagtgattcaagtagtgatgccagtgatggaaatggttcctgctcgtgggacagtaatttaccagagtctttggaatcagtttctgatgttcttctaaacttctttccatatgtttcacccaagacaagtataacagatagcagggaggaagagggtgtgtcagagagtgaggatggtggtggtagcagtgtagattcactggctgcacatgtgaaaaaccttctgcaatgtgaatcctcactgaatcatgctaaagaaatactcagaaatgcagaggaagaggaaagccgggtacgagcacatgcctggaatatgaagttcaatttagcacatgattgtggatactccatttcagaattaaatgaagatgacaggaggaaagtagaagagatcaaggcagagttatttggtcatggaagaacaactgacttgtccaagggtttacagagtccacggggaatgggatgcaagccagaagctgtatgtagtcacattattattgagagccatgaaaagggatgtttccggactctaacttctgaacatccacaactagatagacacccttgtgctttcagatctgctggaccctcagaaatgaccagaggacggcagaacccatcatcatgcagagccaagcatgtcaacctttctgcatccttagaccagaacaactcccatttcaaagtttggaattccttgcagttaaaaagtcattccccatttcagaactttatacctgatgaattcaaaatcagcaaaggtcttcgaatgccattcgatgaaaagatggacccttggctgtcagaattagtagaacctgcttttgtgccacctaaagaagtggattttcattcttcatcacaaatgccgtccccagaacccatgaaaaagtttactacctccatcactttttcatctcaccgacattctaaatgcatttccaattcctctgttgttaaggttggtgttactgaaggtagccagtgtactggagcatctgtgggggtatttaattctcatttcactgaagaacaaaatcctcccagagatcttaaacagaaaacctcttccccttcatcatttaaaatgcatagtaattcacaagataaagaagtgactattttagcagaaggtagaaggcaaagccaaaaattacctgttgattttgagcgttcttttcaagaagaaaaacccttagaaagatcagattttacaggcagtcattctgagcccagtaccagggcaaattgtagcaatttcaaggaaattcagatttctgataaccatacccttattagcatgggcagaccaagttccaccctaggagtaaacagatcgagttccagactaggagtaaaagagaagaatgtaactataactccagatcttccttcttgcatttttcttgaacaacgagagctctttgaacaaagcaaagccccacgtgcagatgaccatgtgaggaaacaccattctccctctcctcaacatcaggattatgtagctccagaccttccttcttgcatttttcttgaacaacgagaactctttgaacagtgcaaagccccatatgtagatcatcaaatgagagaaaaccattctccccttcctcaaggtcaggattctatagcttcagaccttccgtctcccatttctcttgaacaatgccaaagcaaagcgccaggtgtagatgaccaaatgaataaacaccattttccccttcctcaaggtcaggattgtgtagtggaaaagaataatcaacataagcctaaatcacacatttctaatataaatgttgaagccaagttcaatactgtggtctcccagtcagccccaaatcactgtacattagcagcatctgcatctactcctccttcaaatagaaaagcactttcttgtgttcatataactctttgtcccaagacttcttccaagttggatagtggaactttagatgaaagattccattcattggatgctgcttctaaagcgaggatgaatagtgagtttaactttgacttacatactgtatcttcgagatcactggaaccaacctccaaattattgaccagtaaacctgtagcacaggatcaagaatctttaggttttctaggacctaaatcttcactggatttccaagtcgtacagccttctcttccagacagtaacactattactcaggacttgaaaaccataccttctcagaatagccagatagtaacctccaggcaaatacaagtgaacatttcagatttcgaaggacattccaatccagaggggaccccagtatttgcagatcgattaccagagaagatgaagaccccactttctgctttctctgaaaaattgtcatctgatgcagtcactcagataacaacagaaagtccagaaaagaccctattttcatctgagatttttattaatgctgaagatcgtggacatgaaattatagagcctggtaaccagaagctacgcaaagctcctgtcaagtttgcctcatcatcttcagtccaacaggttactttttctcgcggcacagatggccagcctttattattgccatataagccttctggtagtaccaagatgtattatgttccacaattaagacaaattcctccatctccggattccaaatcagataccaccgttgaaagctcccattcaggatccaatgatgccattgctccagacttcccagctcaggtgctaggcacaagagatgatgacctctcagccactgttaacattaaacataaagaaggaatctacagtaagagggtagtgactaaggcatccttgccagtgggagaaaaacccttgcagaatgaaaatgcagatgcctcagttcaagtgctaatcactggggatgagaacctctcagacaaaaaacagcaagagattcacagtacaagggcagtgactgaggctgcccaggctaaagaaaaagaatctttgcagaaagatactgcagattccagtgctgctgctgctgcagagcactcagctcaagtaggagacccagaaatgaagaacttgccagacactaaagccattacacagaaagaggagatccataggaagaagacagttcccgaggaagcctggccaaacaataaagaatccctacagatcaatattgaagagtccgaatgtcattcagaatttgaaaatactacccgttctgtcttcaggtcagcaaagttttacattcatcatcccgtacacctaccaagtgatcaagatatttgccatgaatctttgggaaagagtgttttcatgagacattcttggaaagatttctttcagcatcatccagacaaacatagagaacacatgtgtcttcctcttccttatcaaaacatggacaagactaagacagattataccagaataaagagcctcagcatcaatgtgaatttgggaaacaaagaagtgatggatactactaaaagtcaagttagagattatccaaaacataatggacaaattagtgatccacaaagggatcagaaggtcaccccagagcaaacaactcagcacactgtgagtttgaatgaactgtggaacaagtatcgggagcgacagaggcaacagagacagcctgagttgggtgacaggaaagaactgtccttggtggaccgacttgatcgtttggctaaaattcttcagaatccaatcacacattctctccaggtctcagaaagtacacatgatgatagcagaggggaacgaagtgtgaaggaatggagtggtagacaacagcagagaaataagcttcagaaaaagaagcggtttaaaagcctagagaaaagccataaaaatacaggcgagcttaaaaaaagcaaggtgctttctcatcatcgagctgggaggtctaatcaaattaaaattgaacagattaaatttgataaatatattctgagtaaacagccaggttttaattatataagcaacacttcttcggattgtcggccctcagaggagagtgagctgctcacagatactaccaccaacatcctttccggcaccacttctactgtcgaatcagatatattgacccaaacagatagagaggtggctctgcacgaaaggagtagctctgtttccactattgacactgcccggctgattcaagcttttggccatgaaagagtatgcttgtcacccagacgaattaaattatatagcagcatcaccaaccaacagaggagataccttgagaagcggagcaaacacagcaagaaagtgctgaatacaggtcatcccctagtgacttctgagcacaccagaaggagacacatccaggtagcaaaccatgtgatttcttctgactctatttcctcttctgccagtagtttcctgagctcaaactctactttttgcaacaagcagaatgtacacatgttaaacaagggcatacaagcaggtaacttggagattgtgaacggtgccaaaaaacacactcgagatgttgggataactttcccaactccaagttccagcgaggctaaattggaagagaacagtgatgtgacttcttggtcagaagaaaaacgtgaagagaaaatgctctttaccggttatcctgaggacagaaagttaaaaaagaacaagaagaattcccatgaaggagtttcctggtttgttcctgtggaaaatgtggagtctagatcaaagaaggaaaacgtgcctaacacttgtggccctggcatctcctggtttgaaccaataaccaagaccagaccctggagggagccactgcgggagcagaactgtcaggggcagcacctggacggtcggggctacctggcaggcccaggcagagaggctggcagagacctactgaggccatttgtgagagcaacccttcaggaatcgcttcagtttcacagacctgacttcatctcccgctctggggagcggataaagcgcctgaagttaatagtccaggagaggaagctgcagagcatgttacagaccgagcgggatgcactattcaacattgacagggaacggcagggccaccagaatcgcatgtgcccgctgcccaagagagtcttcctggctatccagaagaacaagcctatcagcaagaaggaaatgattcagaggtccaaacggatttatgagcagcttccagaagtacagaaaaagagagaagaagagaagagaaaatcagaatataagtcataccggctgcgagcccagctatataaaaagagagtgaccaatcaacttctggggagaaaagttccctgggactgacacaagtttattttcctcagagccttggaattctattttatgaacctagagaagcagaatccttacttttgtgagtctggttgaataaagcttattctttgtccatgtgtattttagaaatagtaacttctaaagagtctggaacaaagtggtgattaaaattcctaatggtttgggagcaatactttctgcatagtggccttgtccaatggcctgtgtgttacaatgatatgatcatttctcaagaataagtccctttttgtatgtgtttttatacttttagaaaataaaaactttagattaactc

SEQ ID NO: 106790 - DNA, 1843 bp, Homo sapiens
  Payload ID: 969
  Gene Symbol: ASPSCR1
  Gene Name: alveolar soft part sarcoma chromosome region, candidate 1
  Uniprot ID: Q9BZE9
  ENST ID: ENST00000306739
  CDS Start-End: 98-1759
gctgcggccccgccccctggccgcgtggctgcgcgtcctggctgttgccgataaagttgtttgacgccggcccggcggcgggtcacgtgagcggaaaatggcggccccggcaggcggcggaggctccgcggtgtcggtgctggccccgaacggccggcgccacacggtgaaggtgacgccgagcaccgtgctgcttcaggttctggaggacacgtgccggcggcaggacttcaacccctgtgaatatgatctgaagtttcagaggagcgtgctcgacctttctctccagtggagatttgccaacctgcccaacaatgccaagctggagatggtgcccgcttcccggagccgtgaggggcctgagaacatggttcgcatcgctttgcagctggacgatggctcgaggttgcaggactctttctgttcaggccagaccctctgggagcttctcagccattttccacagatcagggagtgcctgcagcaccccggcggggccaccccagtctgcgtgtacacgagggatgaggtgacgggtgaagctgccctgcggggcacgacgctgcagtcgctgggcctgaccgggggcagcgccaccatcaggtttgtcatgaagtgctacgaccccgtgggcaagaccccaggaagcctgggctcgtcagcgtcggctggccaggcagccgccagcgctccacttcccttggaatctggggagctcagccgcggcgacttgagccgtccggaggacgcggacacctcagggccctgctgcgagcacactcaggagaagcagagcacaagggcacccgcagctgccccctttgttcctttctcgggtgggggacagagactggggggccctcctgggcccacgaggcctctgacatcatcttcagctaagttgccgaagtccctctccagccctggaggcccctccaagccaaagaagtccaagtcgggccaggatccccagcaggagcaggagcaggagcgggagcgggatccccagcaggagcaggagcgggagcggcccgtggaccgggagcccgtggaccgggagccggtggtgtgccaccccgacctggaggagcggctgcaggcctggccagcggagctgcctgatgagttctttgagctgacggtggacgacgtgagaagacgcttggcccagctcaagagtgagcggaagcgcctggaagaagcccccttggtgaccaaggccttcagggaggcgcagataaaggagaagctggagcgctacccaaaggtggctctgagggtcctgttccccgaccgctacgtcctacagggcttcttccgccccagcgagacagtgggggacttgcgagacttcgtgaggagccacctggggaaccccgagctgtcattttacctgttcatcacccctccaaaaacagtcctggacgaccacacgcagaccctctttcaggcgaacctcttcccggccgctctggtgcacttgggagccgaggagccggcaggtgtctacctggagcctggcctgctggagcatgccatctccccatctgcggccgatgtgctggtggccaggtacatgtccagggccgccgggtccccttccccattgccagcccctgaccctgcacctaagtctgagccagctgctgaggagggggcgctggtcccccctgagcccatcccagggacggcccagcccgtgaagaggagcctgggcaaggtgcccaagtggctgaagctgccggccagcaagaggtgagagctgccagcctgaggtgcccactccgccagccacaggaccacctcctctgccagcaggaataaagacttgtgcatccctcaa

SEQ ID NO: 106791 - DNA, 2123 bp, Homo sapiens
  Payload ID: 969
  Gene Symbol: ASPSCR1
  Gene Name: alveolar soft part sarcoma chromosome region, candidate 1
  Uniprot ID: Q9BZE9
  ENST ID: ENST00000306729
  CDS Start-End: 98-2041
gctgcggccccgccccctggccgcgtggctgcgcgtcctggctgttgccgataaagttgtttgacgccggcccggcggcgggtcacgtgagcggaaaatggcggccccggcaggcggcggaggctccgcggtgtcggtgctggccccgaacggccggcgccacacggtgaaggtgacgccgagcaccgtgctgcttcaggttctggaggacacgtgccggcggcaggacttcaacccctgtgaatatgatctgaagtttcagaggagcgtgctcgacctttctctccagtggagatttgccaacctgcccaacaatgccaagctggagatggtgcccgcttcccggagccgtgaggggcctgagaacatggttcgcatcgctttgcagctggacgatggctcgaggttgcaggactctttctgttcaggccagaccctctgggagcttctcagccattttccacagatcagggagtgcctgcagcaccccggcggggccaccccagtctgcgtgtacacgagggatgaggtgacgggtgaagctgccctgcggggcacgacgctgcagtcgctgggcctgaccgggggcagcgccaccatcaggtttgtcatgaagtgctacgaccccgtgggcaagaccccaggaagcctgggctcgtcagcgtcggctggccaggcagccgccagcgctccacttcccttggaatctggggagctcagccgcggcgacttgagccgtccggaggacgcggacacctcagggccctgctgcgagcacactcaggagaagcagagcacaagggcacccgcagctgccccctttgttcctttctcgggtgggggacagagactggggggccctcctgggcccacgaggcctctgacatcatcttcagctaagttgccgaagtccctctccagccctggaggcccctccaagccaaagaagtccaagtcgggccaggatccccagcaggagcaggagcaggagcgggagcgggatccccagcaggagcaggagcgggagcggcccgtggaccgggagcccgtggaccgggagccggtggtgtgccaccccgacctggaggagcggctgcaggcctggccagcggagctgcctgatgagttctttgagctgacggtggacgacgtgagaagacgcttggcccagctcaagagtgagcggaagcgcctggaagaagcccccttggtgaccaaggccttcagggaggcgcagataaaggagaagctggagcgctacccaaaggtggctctgagggtcctgttccccgaccgctacgtcctacagggcttcttccgccccagcgagacagtgggggacttgcgagacttcgtgaggagccacctggggaaccccgagctgtcattttacctgttcatcacccctccaaaaacagtcctggacgaccacacgcagaccctctttcagccccagcttggtgaccgggtggctccattcaccctgggtccctcgctgaaacggtgcctgggaccagagcagagaacacgcttgccagtggtaggagatggaggcgacgtggactctgggaggcttcttttttggggtccatccagaggccgagcctctccaagcactggtcagcctccatgccacccagtctgccgaccctcctctccaccatcccctcgtccgagcagtggcgatccctcccgagtcaaggctgggcacaagcacgtggggacaggccgggcgaacctcttcccggccgctctggtgcacttgggagccgaggagccggcaggtgtctacctggagcctggcctgctggagcatgccatctccccatctgcggccgatgtgctggtggccaggtacatgtccagggccgccgggtccccttccccattgccagcccctgaccctgcacctaagtctgagccagctgctgaggagggggcgctggtcccccctgagcccatcccagggacggcccagcccgtgaagaggagcctgggcaaggtgcccaagtggctgaagctgccggccagcaagaggtgagagctgccagcctgaggtgcccactccgccagccacaggaccacctcctctgccagcaggaataaagacttgtgcatccctc

SEQ ID NO: 106792 - DNA, 1041 bp, Homo sapiens
  Payload ID: 969
  Gene Symbol: ASPSCR1
  Gene Name: alveolar soft part sarcoma chromosome region, candidate 1
  ENST ID: ENST00000344865
  CDS Start-End: 46-222
aaagttgtttgacgccggcccggcggcgggtcacgtgagcggaaaatggcggccccggcaggcggcggaggctccgcggtgtcggtgctggccccgaacggccggcgccacacggtgaaggtgacgccgagcaccgtgctgcttcaggttctggaggacacgtgccggcggcaggacttcaacccctgtgaatatgatctgaaatgcccctgggctgtctgaactctcttcactagttgtctccgacagcagcttgcatttccaaagtttcagaggagcgtgctcgacctttctctccagtggagatttgccaacctgcccaacaatgccaagctggagatggtgcccgcttcccggagccgtgaggggcctgagaacatggttcgcatcgctttgcagctggacgatggctcgaggttgcaggactctttctgttcaggccagaccctctgggagcttctcagccattttccacagatcagggagtgcctgcagcaccccggcggggccaccccagtctgcgtgtacacgagggatgaggtgacgggtgaagctgccctgcggggcacgacgctgcagtcgctgggcctgaccgggggcagcgccaccatcaggtttgtcatgaagtgctacgaccccgtgggcaagaccccaggaagcctgggctcgtcagcgtcggctggccaggcagccgccagcgctccacttcccttggaatctggggagctcagccgcggcgacttgagccgtccggaggacgcggacacctcagggccctgctgcgagcacactcaggagaagcagagcacaagggcacccgcagctgccccctttgttcctttctcgggtgggggacagagactggggggccctcctgggcccacgaggcctctgacatcatcttcagctaagttgccgaagtccctctccagccctggaggcccctccaagccaaagaagtccaagtcgggccaggatccccagcaggagcaggagcaggagcgggagcgggatccccagcaggagcaggagcgggagcgg

SEQ ID NO: 106793 - DNA, 539 bp, Homo sapiens
  Payload ID: 969
  Gene Symbol: ASPSCR1
  Gene Name: alveolar soft part sarcoma chromosome region, candidate 1
  ENST ID: ENST00000583744
  CDS Start-End: 1-539
agggtcctgttccccgaccgctacgtcctacagggcttcttccgccccagcgagacagtgggggacttgcgagacttcgtgaggagccacctggggaaccccgagctgtcattttacctgttcatcacccctccaaaaacagtcctggacgaccacacgcagaccctctttcaggcgaacctcttcccggccgctctggtgcacttgggagccgaggagccggcaggtgtctacctggagcctggcctgctggagcatgccatctccccatctgcggccgatgtgctggtggccaggtacatgtccagggccgccgggtccccttccccattgccagcccctgaccctgcacctaagtctgagccagctgctgaggagggggcgctggtcccccctgagcccatcccagggacggcccagcccgtgaagaggagcctgggcaagccagcaagaggtgagagctgccagcctgaggtgcccactccgccagccacaggaccacctcctctgccagcaggaataaagacttgtgcatccct

SEQ ID NO: 106794 - DNA, 564 bp, Homo sapiens
  Payload ID: 969
  Gene Symbol: ASPSCR1
  Gene Name: alveolar soft part sarcoma chromosome region, candidate 1
  ENST ID: ENST00000579684
  CDS Start-End: 1-564
ggcgccacacggtgaaggtgacgccgagcaccgtgctgcttcaggttctggaggacacgtgccggcggcaggacttcaacccctgtgaatatgatctgaagtttcagaggagcgtgctcgacctttctctccagtggagatttgccaacctgcccaacaatgccaagctggagatggtgcccgcttcccggagccgtgaggggcctgagaacatggttcgcatcgctttgcagctggacgatggctcgaggttgcaggactctttctgttcaggccagaccctctgggagcttctcagccattttccacagatcagggagtgcctgcagcaccccggcggggccaccccagtctgcgtgtacacgagggatgagccgtctccagggcagtggcgggagactcgggctcttgaaagcacgacgtgtttcatggaaaaagagggagtggccggccctcggagcccgggctgccccgaaacctccctcggcgccctgtttgttttttcagcttctctcaaagcccaagagtcacaaaagtggtttcatttaataaatatttgctttg

SEQ ID NO: 106795 - DNA, 1246 bp, Homo sapiens
  Payload ID: 969
  Gene Symbol: ASPSCR1
  Gene Name: alveolar soft part sarcoma chromosome region, candidate 1
  ENST ID: ENST00000582355
  CDS Start-End: 188-1246
ctgtcctgaggctgtggccctcagggacccttacaccctttggcttttgtgctgggccattgactgtgccctcgctagaggcagcttctccaccccttcctcacaggtgacgggtgaagctgccctgcggggcacgacgctgcagtcgctgggcctgaccgggggcagcgccaccatcaggtttgtcatgaagtgctacgaccccgtgggcaagaccccaggaagcctgggctcgtcagcgtcggctggccaggcagccgccagcgctccacttcccttggaatctggggagctcagccgcggcgacttgagccgtccggaggacgcggacacctcagggccctgctgcgagcacactcaggagaagcagagcacaagggcacccgcagctgccccctttgttcctttctcgggtgggggacagagactggggggccctcctgggcccacgaggcctctgacatcatcttcagctaagttgccgaagtccctctccagccctggaggcccctccaagccaaagaagtccaagtcgggccaggatccccagcaggagcaggagcaggagcgggagcgggatccccagcaggagcaggagcgggagcggcccgtggaccgggagcccgtggaccgggagccggtggtgtgccaccccgacctggaggagcggctgcaggcctggccagcggagctgcctgatgagttctttgagctgacggtggacgacgtgagaagacgcttggcccagctcaagagtgagcggaagcgcctggaagaagcccccttggtgaccaaggccttcagggaggcgcagataaaggagaagctggagcgctacccaaaggtggctctgagggtcctgttccccgaccgctacgtcctacagggcttcttccgccccagcgagacagtgggggacttgcgagacttcgtgaggagccacctggggaaccccgagctgtcattttacctgttcatcacccctccaaaaacagtcctggacgaccacacgcagaccctctttcaggcgaacctcttcccggccgctctggtgcacttgggagccgaggagccggcaggtgtctacctggagcctggcctgctggagcatgccatctccccatctgcggccgatgtgctggtggccaggtacatgtccagggccgccgggtccccttccccattgccagcccctgaccctgcacctaagtctgagccagctgctgaggagggggcgctggtcccc

SEQ ID NO: 106796 - DNA, 1776 bp, Homo sapiens
  Payload ID: 969
  Gene Symbol: ASPSCR1
  Gene Name: alveolar soft part sarcoma chromosome region, candidate 1
  Uniprot ID: Q9BZE9
  ENST ID: ENST00000580534
  CDS Start-End: 189-1694
acgtgagcggaaaatggcggccccggcaggcggcggaggctccgcggtgtcggtgctggccccgaacggccggcgccacacggtgaaggtgacgccgagcaccgtgctgcttcaggtttcagaggagcgtgctcgacctttctctccagtggagatttgccaacctgcccaacaatgccaagctggagatggtgcccgcttcccggagccgtgaggggcctgagaacatggttcgcatcgctttgcagctggacgatggctcgaggttgcaggactctttctgttcaggccagaccctctgggagcttctcagccattttccacagatcagggagtgcctgcagcaccccggcggggccaccccagtctgcgtgtacacgagggatgaggtgacgggtgaagctgccctgcggggcacgacgctgcagtcgctgggcctgaccgggggcagcgccaccatcaggtttgtcatgaagtgctacgaccccgtgggcaagaccccaggaagcctgggctcgtcagcgtcggctggccaggcagccgccagcgctccacttcccttggaatctggggagctcagccgcggcgacttgagccgtccggaggacgcggacacctcagggccctgctgcgagcacactcaggagaagcagagcacaagggcacccgcagctgccccctttgttcctttctcgggtgggggacagagactggggggccctcctgggcccacgaggcctctgacatcatcttcagctaagttgccgaagtccctctccagccctggaggcccctccaagccaaagaagtccaagtcgggccaggatccccagcaggagcaggagcaggagcgggagcgggatccccagcaggagcaggagcgggagcggcccgtggaccgggagcccgtggaccgggagccggtggtgtgccaccccgacctggaggagcggctgcaggcctggccagcggagctgcctgatgagttctttgagctgacggtggacgacgtgagaagacgcttggcccagctcaagagtgagcggaagcgcctggaagaagcccccttggtgaccaaggccttcagggaggcgcagataaaggagaagctggagcgctacccaaaggtggctctgagggtcctgttccccgaccgctacgtcctacagggcttcttccgccccagcgagacagtgggggacttgcgagacttcgtgaggagccacctggggaaccccgagctgtcattttacctgtgcctgtcttccttcgggcgcatggatgggcgaggtccacggtgcttcctaacacgtaggtgccttctctcctcagtcatcacccctccaaaaacagtcctggacgaccacacgcagaccctctttcaggcgaacctcttcccggccgctctggtgcacttgggagccgaggagccggcaggtgtctacctggagcctggcctgctggagcatgccatctccccatctgcggccgatgtgctggtggccaggtacatgtccagggccgccgggtccccttccccattgccagcccctgaccctgcacctaagtctgagccagctgctgaggagggggcgctggtcccccctgagcccatcccagggacggcccagcccgtgaagaggagcctgggcaaggtgcccaagtggctgaagctgccggccagcaagaggtgagagctgccagcctgaggtgcccactccgccagccacaggaccacctcctctgccagcaggaataaagacttgtgcatccctc

SEQ ID NO: 106797 - DNA, 1001 bp, Homo sapiens
  Payload ID: 969
  Gene Symbol: ASPSCR1
  Gene Name: alveolar soft part sarcoma chromosome region, candidate 1
  ENST ID: ENST00000581484
  CDS Start-End: 81-1001
gctgcgagtcaggagggcagctccttctggaagcctggagctggtgaggccaggtgctttccctgctgcggtggctggcgatgggagtgtttcctgaggctgccaccaagcccctcctcagcatgggttggtgcgggaagtccttgagtgcctgtgggtcggcaggagctccggttctggaggacacgtgccggcggcaggacttcaacccctgtgaatatgatctgaagtttcagaggagcgtgctcgacctttctctccagtggagatttgccaacctgcccaacaatgccaagctggagatggtgcccgcttcccggagccgtgaggggcctgagaacatggttcgcatcgctttgcagctggacgatggctcgaggttgcaggactctttctgttcaggccagaccctctgggagcttctcagccattttccacagatcagggagtgcctgcagcaccccggcggggccaccccagtctgcgtgtacacgagggatgaggtgacgggtgaagctgccctgcggggcacgacgctgcagtcgctgggcctgaccgggggcagcgccaccatcaggtttgtcatgaagtgctacgaccccgtgggcaagaccccaggaagcctgggctcgtcagcgtcggctggccaggcagccgccagcgctccacttcccttggaatctggggagctcagccgcggcgacttgagccgtccggaggacgcggacacctcagggccctgctgcgagcacactcaggagaagcagagcacaagggcacccgcagctgccccctttgttcctttctcgggtgggggacagagactggggggccctcctgggcccacgaggcctctgacatcatcttcagctaagttgccgaagtccctctccagccctggaggcccctccaagccaaagaagtccaagtcgggccaggatccccagcaggagcaggagcaggagcgggagcgggatccccagcaggagcaggagcgggag

SEQ ID NO: 106798 - DNA, 1035 bp, Homo sapiens
  Payload ID: 969
  Gene Symbol: ASPSCR1
  Gene Name: alveolar soft part sarcoma chromosome region, candidate 1
  ENST ID: ENST00000582019
  CDS Start-End: 1022-1035
cgtcacctgcgcttccgctggggtcccgggggtcccgggggtcccgagtgggggcggggcggtggcgagccttcccaggggtgaggtagaacggcgccgcgtgtcacccgcatcgagtactcggcgcccggccgagcccagctcgcgagggcgccgggaagagggaggagtggagccctagacccgcgttcccattccggggcgtcccccggagcgggagcccgggttgcgcggtggcagatgtcccggccgtggggcctggaagcgatttttgccgagtcactcactgcacttttacttgggcaccttgtgaccgcgaatcaattaaatgtaaaagtattggctgggcgcggtggctcacgcctgtaaatcccagcactgtgggatgccgaggcgggtggatcacgaggtcaagagatcaagaccatcctggctaaaacggtgaaaccccgtctgtactaaaaaaatacaaaaaaatttagccgggcgtggtggcgggcgcctgtagtcccagctactcgggaggctgaggcaggagaatggcgtgaacctgggaggcagagcttgcagtgagccgagatcgcgctactgcactccagcctgggagacagagcgagactccatatcaaaaaaaaaaaaaaaaagtatttattgagcctctgctgcgtgggggaccgtgaggatccgaaggtgcacacgactcggagtttgcgggagcagcccacggcgtggggtccccaggcctgggcaggtggagggcgcagccaggaggctgttggtgccaggcgtgcagagtgcggaagtggggcgctcccgcagaggctgcgcgggaccccttggtgcaaggccacggctttggctttttatggagaagaggggcggaggcggtgcaggcagtggcagcaggttctggaggacacgtgccggcggcaggacttcaacccctgtgaatatgatctgaagtttcagaggagcgtgctcgacctttctctccagtggagatttgccaacctgcccaacaatgccaagctggag

SEQ ID NO: 106799 - DNA, 1919 bp, Homo sapiens
  Payload ID: 969
  Gene Symbol: ASPSCR1
  Gene Name: alveolar soft part sarcoma chromosome region, candidate 1
  ENST ID: ENST00000584454
  CDS Start-End: 284-1696
tgcacttttacttgggcaccttgtgaccgcgaatcaattaaatgtaaaagtattggctgggcgcggtggctcacgcctgtaaatcccagcactgtgggatgccgaggcgggtggatcacgaggtcaagagatcaagaccatcctggctaaaacggttctggaggacacgtgccggcggcaggacttcaacccctgtgaatatgatctgaagtttcagaggagcgtgctcgacctttctctccagtggagatttgccaacctgcccaacaatgccaagctggagatggtgcccgcttcccggagccgtgaggggcctgagaacatggttcgcatcgctttgcagctggacgatggctcgaggttgcaggactctttctgttcaggccagaccctctgggagcttctcagccattttccacagatcagggagtgcctgcagcaccccggcggggccaccccagtctgcgtgtacacgagggatgaggtgacgggtgaagctgccctgcggggcacgacgctgcagtcgctgggcctgaccgggggcagcgccaccatcaggtttgtcatgaagtgctacgaccccgtgggcaagaccccaggaagcctgggctcgtcagcgtcggctggccaggcagccgccagcgctccacttcccttggaatctggggagctcagccgcggcgacttgagccgtccggaggacgcggacacctcagggccctgctgcgagcacactcaggagaagcagagcacaagggcacccgcagctgccccctttgttcctttctcgggtgggggacagagactggggggccctcctgggcccacgaggcctctgacatcatcttcagctaagttgccgaagtccctctccagccctggaggcccctccaagccaaagaagtccaagtcgggccaggatccccagcaggagcaggagcaggagcgggagcgggatccccagcaggagcaggagcgggagcggcccgtggaccgggagcccgtggaccgggagccggtggtgtgccaccccgacctggaggagcggctgcaggcctggccagcggagctgcctgatgagttctttgagctgacggtggacgacgtgagaagacgcttggcccagctcaagagtgagcggaagcgcctggaagaagcccccttggtgaccaaggccttcagggaggcgcagataaaggagaagctggagcgctacccaaagacggagtctctctctgtcgcccaggctggagtcagtggtgccatctcagctcactgcaagctccgcctcccgggttcaagtggttctcctgcctcagcctcccaagtagctgggatttcaggtggctctgagggtcctgttccccgaccgctacgtcctacagggcttcttccgccccagcgagacagtgggggacttgcgagacttcgtgaggagccacctggggaaccccgagctgtcattttacctgttcatcacccctccaaaaacagtcctggacgaccacacgcagaccctctttcaggcgaacctcttcccggccgctctggtgcacttgggagccgaggagccggcaggtgtctacctggagcctggcctgctggagcatgccatctccccatctgcggccgatgtgctggtggccaggtacatgtccagggccgccgggtccccttccccattgccagcccctgaccctgcacctaagtctgagccagctgctgaggagggggcgctggtcccccctgagcccatcccagggacggcccagcccgtgaagaggagcctgggcaaggtgcccaagtggctgaagctgccggccagcaagaggtgagagctgccagcctgaggtgcccactccgccagccacaggaccacctcctctgccagcaggaataaagacttgtgcatccctcaa

SEQ ID NO: 106800 - DNA, 641 bp, Homo sapiens
  Payload ID: 969
  Gene Symbol: ASPSCR1
  Gene Name: alveolar soft part sarcoma chromosome region, candidate 1
  ENST ID: ENST00000583503
  CDS Start-End: 7-489
cggaaaatggcggccccggcaggcggcggaggctccgcggtgtcggtgctggccccgaacggccggcgccacacggtgaaggtgacgccgagcaccgtgctgcttcaggttctggaggacacgtgccggcggcaggacttcaacccctgtgaatatgatctgaagtttcagaggagcgtgctcgacctttctctccagtggagatttgccaacctgcccaacaatgccaagctggagatggtgcccgcttcccggagccgtgaggggcctgagaacatggttcgcatcgctttgcagctggacgatggctcgaggttgcaggactctttctgttcaggccagaccctctgggagcttctcagccattttccacagatcagcccgtggaccgggagcccgtggaccgggagccggtggtgtgccaccccgacctggaggagcggctgcaggcctggccagcggagctgcctgatgagttctttgagctgacggtggacgacgtgagaagacgcttggcccagctcaagagtgagcggaagcgcctggaagaagcccccttggtgaccaaggccttcagggaggcgcagataaaggagaagctggagcgctacccaaaggtggctctgagggtcctgttcccc

SEQ ID NO: 106801 - DNA, 720 bp, Homo sapiens
  Payload ID: 969
  Gene Symbol: ASPSCR1
  Gene Name: alveolar soft part sarcoma chromosome region, candidate 1
  ENST ID: ENST00000581647
  CDS Start-End: 17-565
gtcacgtgagcggaaaatggcggccccggcaggcggcggaggctccgcggtgtcggtgctggccccgaacggccggcgccacacggtgaaggtgacgccgagcaccgtgctgcttcaggttctggaggacacgtgccggcggcaggacttcaacccctgtgaatatgatctgaagtttcagaggagcgtgctcgacctttctctccagtggagatttgccaacctgcccaacaatgccaagctggagatggtgcccgcttcccggagccgtgaggggcctgagaacatggttcgcatcgctttgcagctggacgatggctcgaggttgcaggactctttctgttcaggccagaccctctgggagcttctcagccattttccacagatcagggagtgcctgcagcaccccggcggggccaccccagtctgcgtgtacacgagggatgaggtaggcggcctgctcttgctcacccagtccccgctcactttcagcccactttccaactggaaaatctgctgtcccgcagccgtctccagggcagtggcgggagactcgggctcttgaaagcacgacgtgtttcatggaaaaagagggagtggccggccctcggagcccgggctgccccgaaacctccctcggcgccctgtttgttttttcagcttctctcaaagcccaagagtcacaaaagtggtttcatttaataaatatttgctttgctc

SEQ ID NO: 106802 - DNA, 1445 bp, Homo sapiens
  Payload ID: 970
  Gene Symbol: ALX1
  Gene Name: ALX homeobox 1
  Uniprot ID: Q15699
  ENST ID: ENST00000316824
  CDS Start-End: 156-1136
gtattaaagggaccggagcggggcagttcccgacgccgcagcgctcgctttcccttccctcctctctggccctccctcctcccacccactggctccctcccccagcgctctccagtttctgtgccccaggagctacgcgacagtcttccaggattatggagtttctgagcgagaagtttgccctcaagagccctccgagtaaaaacagtgacttttacatgggcgcaggaggtcctctggagcacgttatggagacgctggacaatgagtccttttacagcaaagcgtctgcaggcaaatgcgtgcaggccttcggacccctgccccgcgccgagcatcacgtgcgcttggagaggacctcgccctgtcaggacagcagcgtgaactatgggatcactaaagtagaaggacagccccttcacaccgaactgaatagagctatggacaactgtaacagtctccgaatgtctcccgtgaaagggatgcaagagaagggagagctggatgaacttggggataaatgtgatagcaatgtatccagcagtaagaaacggaggcaccgaaccaccttcaccagtttgcagctagaggagctggagaaagtctttcagaaaactcattacccggatgtgtatgtcagagaacagcttgctctgaggacagagctcactgaggccagggtccaggtttggtttcaaaatcgaagggccaaatggagaaaaagggaacgttatggccaaatacaacaagcgaaaagccattttgctgccacctatgatatatcagttttgccaaggactgacagctacccacagattcagaacaatttgtgggcaggaaatgcaagtggtggttctgtggttacttcatgcatgttaccacgtgacacttcctcctgtatgacaccttattctcactcgcctcggacagattccagttacacggggttttcaaaccaccagaaccagttcagccacgtgcccctcaacaattttttcactgactctcttcttactggggcaaccaatggacatgcatttgaaacaaagccagagtttgaaaggaggtcttccagtatcgcagttcttcgaatgaaagccaaggagcacaccgccaatatttcatgggccatgtaacatacagtactcttttatttttcttttaatagcaaagttaaacattcttatttctcatatttaaaggataccacaataagctgctgtgtgtggaattgctaaaggtcaagatattcagtgagaccagcttaaatgaatagttgttatttaacattaaaatctaagaatgaacctctgaaaagactaaataggtttaccatgtgccagtctccacaaaccctgttttagtagtaaggttttctttttctattgtacaagtcaatgaaatatgatcacgcaacttattaaagaataaatgtgttaaacaaa

SEQ ID NO: 106803 - DNA, 1859 bp, Homo sapiens
  Payload ID: 971
  Gene Symbol: ALX3
  Gene Name: ALX homeobox 3
  Uniprot ID: O95076
  ENST ID: ENST00000369792
  CDS Start-End: 89-1120
ccaggtccctcccccttggcgggcgctcacaggcggcgcgggcagcgcgagccccggagccccggaggcctgtgcgccctgagccggcatggaccccgagcactgcgcgcctttccgcgtggggcctgcacccggcccctatgtggcctcgggggacgagcctccgggcccgcagggaacccccgccgctgcgcctcacctgcaccccgcgccgccccgcggcccgcggctgacccgctttccggcctgcgggcccctggagccctacctcccagagccggccaagccgcccgccaagtacctgcaggacctcgggcccggcccggccctcaacggcggccacttctacgagggccccgcggaagctgaggagaagacctccaaagctgccagcttcccccagctgcccttggactgccgagggggccccagagacgggccctctaacttgcaaggctccccaggcccctgcctggccagcctgcatcttcctctttccccgggactccctgactccatggagttggccaagaacaagagcaagaagcgtcgtaaccgcacgaccttcagcacattccagctggaggagctggagaaggtcttccagaaaacccactatcctgatgtgtatgcccgggagcagctggccctgcgcacagacctgactgaggcccgggtacaggtctggttccagaaccgcagagccaagtggcggaagcgcgagcgttatgggaagatccaggaggggcggaaccccttcacggctgcctatgacatctctgtgctgccccgtactgacagccaccctcagctgcagaactccctgtgggccagtccaggatctgggagccctggaggcccctgccttgtgtctccagagggcatcccctccccatgcatgtctccatattcccacccccatgggagtgtggctggcttcatgggggtgccagccccttctgcggctcaccctggcatctactccatccatggctttccccccaccctggggggccacagctttgagccttcctcagatggtgactataagtctccaagcctcgtctcgctcagggtaaagcccaaggagccacccggccttctgaactggaccacgtgatcggttgcatggacctgcagaatgagctgcccacctctttttccattcccagtcgctcccagcccacctctgcctccaagccccagatggttctggaggctgcgagagcagctggcactgtcagcccccagcagggaacacgttacagggtcttttctcttagaacaaggtggggctgcctaggagaaggggcttcgaagcagccaggactcttcctaccacaaactgagtcccctcacctgaactctgggctggaggcagggagacactgccctgcttcctccagactttgtccaagtccattgtcatctctccagctaagacagcttacttggctcatcgttcagggaacccaggaaaatgggaggagaacgccgcgtggactgaagctcttcatgatgagatggaaaccaaaagggagtctcccatgatggggtggagtcagccctgcttcccctccccaccagcagggggcgcactggtgtctgacactaaggagggtgtaaaggccaaggtcagcatagactgaggcacactggctcctcagctccagccaccctcactcctgccatgtgcctgcactcccagcatgccatgcagtcatcttcccctccaagggggcagaaattccaccagaaatcaccacatatttggaatctcttccacgggaccagcccagagctatgccatggaaatgatattggatgttggtaagaataaaacagatttctacagactg

SEQ ID NO: 106804 - DNA, 5750 bp, Homo sapiens
  Payload ID: 972
  Gene Symbol: ALX4
  Gene Name: ALX homeobox 4
  Uniprot ID: Q9H161
  ENST ID: ENST00000329255
  CDS Start-End: 105-1340
gcacagccacagcctcctcgcctccccaaactcccagccaaggcgcgcggtggcgtcctcgcgccctcgctcgcgtccccgcccgccgcctgcgcaagccaggcatgaatgctgagacttgcgtctcttactgcgagtcgccggccgctgccatggacgcctactacagcccggtgtcgcagagtcgggagggctcgtcgccttttagggcatttcccggaggcgacaagttcggcacaactttcctgtcggccgccgccaaagcacagggattcggggacgccaagagccgggcccgttacggcgctgggcagcaggacctggcgacacccctggagagtggagctggggcgcggggctcctttaacaagttccagccccagccgtcgaccccgcagccccagccgccgccgcagccgcagccgcagcagcagcagccgcagccccagccgcccgcgcaaccgcatctttacttgcagcgaggcgcctgcaagacgcccccggacggcagcctcaaactccaggaaggcagcagcggccacagcgcggccttgcaggttccctgctacgctaaagagagctccctgggtgagccagagttaccccctgactctgacactgtggggatggacagcagctacctgagtgtcaaggaggctggggtgaaggggccccaggaccgggccagctcagacctccccagcccattggagaaggccgactcagagagcaacaagggcaagaagcggcggaaccggaccaccttcaccagctaccagctggaggagctggagaaggtcttccagaagacccactacccagacgtgtatgcgcgggaacagctggccatgaggacagacctcactgaggcccgcgtgcaggtctggttccagaaccgaagggccaagtggaggaagcgggagcgttttgggcagatgcagcaggttcgaacccacttctccactgcatatgagctgcccctcctcacccgagctgagaactacgcccagattcagaacccgtcctggctcggcaacaacggggctgcctcaccagtgccagcctgcgtggtcccctgcgacccggtgcctgcctgcatgtcccctcatgcccacccccctggctctggggccagcagcgtcaccgacttcctgagtgtgtctggggctggcagtcacgtgggccagacgcacatgggcagcctgtttggagcagccagcctcagcccaggcctcaatggctacgagctcaacggcgagccggaccgcaagacctcgagcatcgcggccctccgcatgaaggccaaggagcacagtgcggccatttcctgggccacatgacagggcacccctgccccgtccccacctcgggacaccatgggccacgcccatgttttccaggcccccagcctcccactcgactttcctcttaggaacctggcctgggccaggggcctgaccctcagcactttcagccgccccaagtctgaggccccgtggactgctgggagggagggggcagcaggcccctggcccctccctggcactgaggccctgacccctgctcccggccacaggcagtggagaaagccaggtggccacgtttttcagcttcgcatccatgataagctgaaagcgctttcttgctcccgcccactcctctgctctgcctagttgaccatgagtcaatgctagatttccatgcagacccagcagcctcaccagcccagtcttgtccatccttcccgctcctagtggggtcccctggtcaccaggccggtggctgtgtgtctgaagcacaggctgccctgcagagccagcctcctgccctcccatctttctctccctgaaagcacacggaatccgacctgctggggccaaggcgccagcctccacctccccccgaacagtgacgagtctgacagagcctggctgactgcatcctggctgtcccctaggctggatacacctggagagagtgggcagaggatgacaggagctggagccgaggacccctgctgccatctagcaatgccagtccccaggggagacacgggccagcccctcactggacactataggggaggagccagacctgagggaggctgagaacacagatgccacaagggctcccatggtgctagaagaaggaaaggtcctgggagagggggaggcatccgggtggggcgtgggcccgggcagtcctcccgctctccggcctgcctggcatctggtacagcggggaggtctgggcagctttgttctccatccagagcccagtcaggttccctccaggaggatgcggaggggctcgtctcttccctgccctaccctggcccctccctggggctgctcagcagtgtcccggcatggaaggactcacaacttcggaacacataagctagagcttgggggccgggtggcagagggtcaaaagctgcgtgcaggctttgctagaggacgtgtggccatgctcggcctccaggccctgctatggcctcaaactgactgtcctccctgccatatctgtcagtgtcatcgctgcccagagccttccacggcagatgggggctctgtgtccctccaggcactaggaggtgttgctcttctccacacagctttccacactccgtccttacacttcttccacagggaccaggactctctgccctctctccagcctgcggaagggctcctggcctgggctcctcggtgtggctttgctattgcaaatggggctgtcaggatgccctcctgaaaccaggcttcctgcctccaggaagcggggctctgtgcctgcctgcccgacccctgtagcttgggtctggccctgagccccagccctcacctcagctgggagtacacagtaaccgtccagaggcaggcctgtcagaccccaggtggggggtccctccagcaggcagcgccccgcattgaagcgctcgccttttctaccttctcccttgattcctgtcatggagtagggccaggcccactatgctcagggtcgtggacacagaaaggcctcctgggttgggcggagggtaaacttggtgttgttgaatgagggtctctggggttgggggtgacagtctcccgcctgcctggtgttctcatctgctctagaaaccaggctgaggaagggtctggctgtggcctcccttaatgagtcagacctctttgtgaaccgtagctctaaaatggatcttatagaggtgaaagggtcttggacattgaattaaatgttcttggaggcttggctttaagtgtttcaaatatttgaggatttggagtgacttttgggaagttttttctagttctgaggttcgctgaaatgacccagactcccccaaaatctagccagggaaaggaagaacttaaggctgggaacagtttccccatttctcccccctttccttctgaaatgctcatggctgaggaaggatggggaaggaaggaactttcaccttgggtctttctcacccatgagagaatcaggacaaagaggaggagagccaggtagctccagagtgggccaggagggagagcaagggaatcaggacaaagaggaggacagacaggtagctccagagcaggcagggagggagagtgagagctttaagggggctcttccgcagtggcccccggcactcagttcctccatgcgtctgctctctggctgggctagacccaagtcaggcaaatttcaacccaaaagcttgagaagaaaaggcgtctattagaagactctgtggctatggctgcctgtcccaacacacccaggaagtgtctaggattaaacatgccaatgtgaaacattcctgttcatctcgtcaaaggcagccacgtaccccaggcctgtcctctgtggcttggcccagcccttgggggccacctaaccacactaagtatgataggaccaccgagttgggaggaagcttagaaaccctctagttagtccagtcccttcacaacagagaagaccctggcccagagtggagacatgactgccctgacctgtacttgccctgagactaggctgagagaggagcctgggacgtgccacccagggtgtgagggcctgggcttcgttggcaccaggggcggccggtgctgcatggagctcccctctccaatgcctcatgggcattcactcagcagctcagttctccagaagagaaccttggggcccagtcccttccaagacaggtggctaggcccaaccttctgcactgcagagcagggggccactgccgtgtcagctcctaggatgactgagcaagtcagggcagctgcccaaggccatctggagctaaagctcatgaaggcaggtggagagaagcatctacctgccacgtggttcattgctatgcgaataagctaagagaggtgaggatttcctttggatacctgcctaagatctcaacagagatggcaacttaaaaataaagtcgtgggtagccggcagatggatgggcagcctccccacactgacagcctccagtccctgctgggcacaggtctcagcatggcaaggcttgacactaaggtgctgctactgccctccagatgccagcactactcctggggcatgggagcgagggctctggggggcacacagagaggcttgtctccaaggctgaaatagcacttggaggacatgggcttttagaactttccttgaattcttttaactatacttgattctcagcgctcactaccgtgcctccagcttcgggaagcacggtggccaggttagctcaaagacactgcgatggggtaggtgcagcaagtgtggggtgggtccccagcacacacagctgtgatcacactggacccagctccgtgccccatctcctgtcatttcggctgggcagacgagggacgcttccatgaaaactacgtaccctgcttatgcagtcattccctccctgggctagacagtggggggccatcttcgagaacctgaaagacacgcgggggttcctggtctgtttcatggcccttactgtccagtgcaaaggcaaacaggcctagctgggggaggatggttggtaaactggcccccaggataatactctgtgactatccagttaaaaaataagaaggtgacaatgacccatcaaccccacttcacttctttcaggatgctgtagggaggaaaggtgcttccatgacctaacctcggcctctcctttcttccctcttcactcacacacatagagctaggcctttatactactgattttgaaggacagttttcaatgtctaatcatctgtttaggtgtgcagtggttgaaaaaagaaagctgagtgctagaaggaacatgaacctcaaccgttacttattgttctcattgtaagatattttaaccctgtataaatgcaacttttcctttagcttaatggcctggggtggaatattaaaaatatatattaaaaatacagtaaaaatccagaaaaatgtaaaaaaaaaaatgaggtcggttccataaagttttactgcctataccaccatgtaactacattatagcaaaatattaaaagaaacgttcttgccttttaaagtaagttattgcacttacatcttttttgggagaggaggaacacggatgggaaggagatgtaggggcccaggcatggggcaaaatggagtgcagaggtagccgggcactcccagaacaccctttgctggcccagcccaaactgtttggttgttgttatttgcaataaactccttctccttcctcc

SEQ ID NO: 106805 - DNA, 1088 bp, Homo sapiens
  Payload ID: 973
  Gene Symbol: ALYREF
  Gene Name: Aly/REF export factor
  ENST ID: ENST00000505490
  CDS Start-End: 7-801
gagccgatgcccgattccgcgcccgccatggccgacaaaatggacatgtctctggacgacatcattaaactgaaccggagccagcgaggcggccggggcgggggccggggccgcggccgggccggctcccagggcggccgcggcggtggggcgcaggccgccgcgcgagtgaatcgaggcggcgggcccatccggaaccggccggccatcgcccgcggcgcggccggcggaggcggcaggaaccgaccggcgccctacagcaggccaaaacaacttcccgacaagtggcagcacgatcttttcgacagtggcttcggcggtggtgccggcgtggagacaggtgggaaactgctggtgtccaatctggattttggagtctcagacgccgatattcaggaactctttgctgaatttggaacgctgaagaaggcggctgtgcactatgatcgctctggtcgcagcttaggaacagcagacgtgcactttgagcggaaggcagatgccctgaaggccatgaagcagtacaacggcgtccctctggatggccgccccatgaacattcagcttgtcacgtcacagattgacgcacagcggaggcctgcacagagcgtaaacagaggtggcatgactagaaaccgtggcgctggaggttttggtggtggtggaggcacccggagaggcacccgcggaggcgcccgtggaagaggcagaggtgccggcaggaattcaaagcagcagctttcggcagaggagctggatgcccagctggacgcctataatgcgagaatggacaccagttaaacagaccagcaaatccgcgtgcggaacaggacccaggcgtctcctcttgctccctggttggggggcggtggctggggctgtgcggccaatgatggatttgtttcttttatgttttaaaataggatttaaaaactcatgtaaaggttttttttttttctttttttttttttttaattctgaaacagacctgttttgtaccgagttatttttgggataaattttactggttgctgttgtggagaaggtggcgtttccaccttttccataataaaatagaaatgtgtgta

SEQ ID NO: 106806 - DNA, 2005 bp, Homo sapiens
  Payload ID: 974
  Gene Symbol: AMBN
  Gene Name: ameloblastin (enamel matrix protein)
  Uniprot ID: Q9NP70
  ENST ID: ENST00000322937
  CDS Start-End: 104-1447
gagaagtacagagcaagtcccacgcacagtcctgaaaaaaattttaatcttcttttcttagaactatcttggttggcatcatcaggccctgagagcacagtgcatgtcagcatctaagattccacttttcaaaatgaaggacctgatactgatcctatgcctcctggaaatgagttttgcagtgccgttctttcctcagcaatctggaacaccgggtatggctagtttgagccttgagacaatgagacagttgggaagtctgcagagattaaacacactttctcagtattctagatacggctttggaaaatcatttaattctttgtggatgcacggtctcctcccaccacattcctctcttccatggatgaggccaagagaacatgaaactcaacagtatgaatattctttgcctgtgcatcccccacctctcccatcacagccatccttgaagcctcaacagccaggactgaaaccttttctccagtctgctgctgcaaccaccaaccaggccacagcactgaaagaagcacttcagcctccaattcacctgggacatctgcccttgcaggaaggagaactgcctctggttcagcagcaggtggcaccatcagataagccaccaaagcctgagctcccaggagtagattttgctgatccacaaggtccatcactcccaggaatggattttcctgatccacaaggtccatcactcccaggattggattttgctgatccacaaggttcaacaattttccaaatagcccgtttgatttctcacggaccaatgccacaaaataaacaatctccactttatccaggaatgttgtacgtgccttttggagcaaatcaattgaatgcccctgccagacttggcatcatgagttcagaagaagtggcaggcgggagagaagacccaatggcctatggagccatgtttccaggatttggaggcatgaggcccggctttgagggaatgccccacaacccagctatgggcggtgacttcactctggaatttgactccccagtggctgccaccaaaggccctgagaacgaagaaggaggtgcacaaggctcccctatgccggaggccaacccagacaatctagaaaacccagctttccttacagagctagaacctgctccccacgcagggctccttgctctccctaaggatgacattcccggcctgccaaggagcccttcagggaagatgaagggactccccagcgtcaccccagcagctgctgacccactgatgacccctgaattagctgatgtttataggacctacgatgctgacatgaccacatccgtggatttccaggaagaagcaaccatggataccacgatggccccaaactctctgcaaacatccatgccaggaaacaaagcccaggagcccgagatgatgcatgacgcatggcatttccaagagccctgacagctctaagatattagctactttctgtatgcacaagcttcccagctttgtccccacagtgtacctttttgctaaaacacttattacccttctgcagcaaaggcattaaaagcgctaagcatatattaataaatgcaagtggctagaaatagtgtaggtccccttcttgctttcaatatcttgttgaaataaaatgtgtcaattgtctctgtgatttagaaacactattaataacatcagagcaaggttctaagggtctcagcatttgatcatcactttttcttagctgtcttaagcattatagaatttctcttaccagcatgacactattatattcaggaaacatggcactgcttttttctctaagcaaaggcaaatatcctcataattctaagctaattcatttaaactttattaaatggggattggtggaaaactcctgactggtattactgggtttggtataatttaatttaaaattctcatttatagagtattttatttaatctagtataaaaaatctagcctattttaaataaagaatttttctcactgaaa

SEQ ID NO: 106807 - DNA, 1512 bp, Homo sapiens
  Payload ID: 974
  Gene Symbol: AMBN
  Gene Name: ameloblastin (enamel matrix protein)
  Uniprot ID: Q9NP70
  ENST ID: ENST00000449493
  CDS Start-End: 65-1363
aattttaatcttcttttcttagaactatcttggttggcatcatcaggccctgagagcacagtgcatgtcagcatctaagattccacttttcaaaatgaaggacctgatactgatcctatgcctcctggaaatgagttttgcagtgccgttctttcctcagcaatctggaacaccgggtatggctagtttgagccttgagacaatgagacagttgggaagtctgcagagattaaacacactttctcagtattctagatacggctttggaaaatcatttaattctttgtggatgcacggtctcctcccaccacattcctctcttccatggatgaggccaagagaacatgaaactcaacagccatccttgaagcctcaacagccaggactgaaaccttttctccagtctgctgctgcaaccaccaaccaggccacagcactgaaagaagcacttcagcctccaattcacctgggacatctgcccttgcaggaaggagaactgcctctggttcagcagcaggtggcaccatcagataagccaccaaagcctgagctcccaggagtagattttgctgatccacaaggtccatcactcccaggaatggattttcctgatccacaaggtccatcactcccaggattggattttgctgatccacaaggttcaacaattttccaaatagcccgtttgatttctcacggaccaatgccacaaaataaacaatctccactttatccaggaatgttgtacgtgccttttggagcaaatcaattgaatgcccctgccagacttggcatcatgagttcagaagaagtggcaggcgggagagaagacccaatggcctatggagccatgtttccaggatttggaggcatgaggcccggctttgagggaatgccccacaacccagctatgggcggtgacttcactctggaatttgactccccagtggctgccaccaaaggccctgagaacgaagaaggaggtgcacaaggctcccctatgccggaggccaacccagacaatctagaaaacccagctttccttacagagctagaacctgctccccacgcagggctccttgctctccctaaggatgacattcccggcctgccaaggagcccttcagggaagatgaagggactccccagcgtcaccccagcagctgctgacccactgatgacccctgaattagctgatgtttataggacctacgatgctgacatgaccacatccgtggatttccaggaagaagcaaccatggataccacgatggccccaaactctctgcaaacatccatgccaggaaacaaagcccaggagcccgagatgatgcatgacgcatggcatttccaagagccctgacagctctaagatattagctactttctgtatgcacaagcttcccagctttgtccccacagtgtacctttttgctaaaacacttattacccttctgcagcaaaggcattaaaagcgctaagcatatattaataaatgcaagtggctagaaa

SEQ ID NO: 106808 - DNA, 1997 bp, Homo sapiens
  Payload ID: 974
  Gene Symbol: AMBN
  Gene Name: ameloblastin (enamel matrix protein)
  ENST ID: ENST00000613447
  CDS Start-End: 102-1442
gaagtacagagcaagtcccacgcacagtcctgaaaaaaattttaatcttcttttcttagaactatcttggttggcatcatcaggccctgagagcacagtgcatgtcagcatctaagattccacttttcaaaatgaaggacctgatactgatcctatgcctcctggaaatgagttttgcagtgccgttctttcctcagcaatctggaacaccgggtatggctagtttgagccttgagacaatgagacagttgggaagtctgcagagattaaacacactttctcagtattctagatacggctttggaaaatcatttaattctttgtggatgcacggtctcctcccaccacattcctctcttccatggatgaggccaagagaacatgaaactcaacagtatgaatattctttgcctgtgcatcccccacctctcccatcacagccatccttgaagcctcaacagccaggactgaaaccttttctccagtctgctgctgcaaccaccaaccaggccacagcactgaaagaagcacttcagcctccaattcacctgggacatctgcccttgcaggaaggagaactgcctctggttcagcagcaggtggcaccatcagataagccaccaaagcctgagttgcgagtagattttgctgatccacaaggtccatcactcccaggaatggattttcctgatccacaaggtccatcactcccaggattggattttgctgatccacaaggttcaacaattttccaaatagcccgtttgatttctcacggaccaatgccacaaaataaacaatctccactttatccaggaatgttgtacgtgccttttggagcaaatcaattgaatgcccctgccagacttggcatcatgagttcagaagaagtggcaggcgggagagaagacccaatggcctatggagccatgtttccaggatttggaggcatgaggcccggctttgagggaatgccccacaacccagctatgggcggtgacttcactctggaatttgactccccagtggctgccaccaaaggccctgagaacgaagaaggaggtgcacaaggctcccctatgccggaggccaacccagacaatctagaaaacccagctttccttacagagctagaacctgctccccacgcagggctccttgctctccctaaggatgacattcccggcctgccaaggagcccttcagggaagatgaagggactccccagcgtcaccccagcagctgctgacccactgatgacccctgaattagctgatgtttataggacctacgatgctgacatgaccacatccgtggatttccaggaagaagcaaccatggataccacgatggccccaaactctctgcaaacatccatgccaggaaacaaagcccaggagcccgagatgatgcatgacgcatggcatttccaagagccctgacagctctaagatattagctactttctgtatgcacaagcttcccagctttgtccccacagtgtacctttttgctaaaacacttattacccttctgcagcaaaggcattaaaagcgctaagcatatattaataaatgcaagtggctagaaatagtgtaggtccccttcttgctttcaatatcttgttgaaataaaatgtgtcaattgtctctgtgatttagaaacactattaataacatcagagcaaggttctaagggtctcagcatttgatcatcactttttcttagctgtcttaagcattatagaatttctcttaccagcatgacactattatattcaggaaacatggcactgcttttttctctaagcaaaggcaaatatcctcataattctaagctaattcatttaaactttattaaatggggattggtggaaaactcctgactggtattactgggtttggtataatttaatttaaaattctcatttatagagtattttatttaatctagtataaaaaatctagcctattttaaataaagaatttttctcactg

SEQ ID NO: 106809 - DNA, 737 bp, Homo sapiens
  Payload ID: 975
  Gene Symbol: AMELX
  Gene Name: amelogenin, X-linked
  Uniprot ID: Q99217
  ENST ID: ENST00000348912
  CDS Start-End: 69-596
aaaggatcaagcatccctgagtttcaaacagaaacttgcactgaatacattcaaagaaccatcaagaaatggggacctggattttatttgcctgcctcctgggagcagcttttgccatgcctgtgcttacccctttgaagtggtaccagagcataaggccaccgtacccttcctatggttacgagcccatgggtggatggctgcaccaccaaatcatccccgtgctgtcccaacagcaccccccgactcacaccctgcagcctcatcaccacatcccagtggtgccagctcagcagcccgtgatcccccagcaaccaatgatgcccgttcctggccaacactccatgactccaatccaacaccaccagccaaacctccctccgcccgcccagcagccctaccagccccagcctgttcagccacagcctcaccagcccatgcagccccagccacctgtgcaccccatgcagcccctgccgccacagccacctctgcctccgatgttccccatgcagcccctgcctcccatgcttcctgatctgactctggaagcttggccatcaacagacaagaccaagcgggaggaagtggattaaaagatcagaagatgagaggggaatgaatacttcagatgctttcaggagtgacacaagaacacaatgatttttgcttataatcactttacttagcaaattctgtaactaaaaaagtaccattagcagacaataaaatgcatt

SEQ ID NO: 106810 - DNA, 835 bp, Homo sapiens
  Payload ID: 975
  Gene Symbol: AMELX
  Gene Name: amelogenin, X-linked
  Uniprot ID: Q99217
  ENST ID: ENST00000380712
  CDS Start-End: 69-686
aaaggatcaagcatccctgagtttcaaacagaaacttgcactgaatacattcaaagaaccatcaagaaatggggacctggattttatttgcctgcctcctgggagcagcttttgccatgcctctaccacctcatcctgggcaccctggttatatcaacttcagctatgagaactcacattctcaggctatcaatgttgacaggactgcattagtgcttacccctttgaagtggtaccagagcataaggccaccgtacccttcctatggttacgagcccatgggtggatggctgcaccaccaaatcatccccgtgctgtcccaacagcaccccccgactcacaccctgcagcctcatcaccacatcccagtggtgccagctcagcagcccgtgatcccccagcaaccaatgatgcccgttcctggccaacactccatgactccaatccaacaccaccagccaaacctccctccgcccgcccagcagccctaccagccccagcctgttcagccacagcctcaccagcccatgcagccccagccacctgtgcaccccatgcagcccctgccgccacagccacctctgcctccgatgttccccatgcagcccctgcctcccatgcttcctgatctgactctggaagcttggccatcaacagacaagaccaagcgggaggaagtggattaaaagatcagaagatgagaggggaatgaatacttcagatgctttcaggagtgacacaagaacacaatgatttttgcttataatcactttacttagcaaattctgtaactaaaaaagtaccattagcagacaataaaatgcattaaaaatca

SEQ ID NO: 106811 - DNA, 793 bp, Homo sapiens
  Payload ID: 975
  Gene Symbol: AMELX
  Gene Name: amelogenin, X-linked
  Uniprot ID: Q99217
  ENST ID: ENST00000380714
  CDS Start-End: 69-644
aaaggatcaagcatccctgagtttcaaacagaaacttgcactgaatacattcaaagaaccatcaagaaatggggacctggattttatttgcctgcctcctgggagcagcttttgccatgcctctaccacctcatcctgggcaccctggttatatcaacttcagctatgaggtgcttacccctttgaagtggtaccagagcataaggccaccgtacccttcctatggttacgagcccatgggtggatggctgcaccaccaaatcatccccgtgctgtcccaacagcaccccccgactcacaccctgcagcctcatcaccacatcccagtggtgccagctcagcagcccgtgatcccccagcaaccaatgatgcccgttcctggccaacactccatgactccaatccaacaccaccagccaaacctccctccgcccgcccagcagccctaccagccccagcctgttcagccacagcctcaccagcccatgcagccccagccacctgtgcaccccatgcagcccctgccgccacagccacctctgcctccgatgttccccatgcagcccctgcctcccatgcttcctgatctgactctggaagcttggccatcaacagacaagaccaagcgggaggaagtggattaaaagatcagaagatgagaggggaatgaatacttcagatgctttcaggagtgacacaagaacacaatgatttttgcttataatcactttacttagcaaattctgtaactaaaaaagtaccattagcagacaataaaatgcattaaaaatca

SEQ ID NO: 106812 - DNA, 802 bp, Homo sapiens
  Payload ID: 976
  Gene Symbol: AMELY
  Gene Name: amelogenin, Y-linked
  Uniprot ID: Q99218
  ENST ID: ENST00000215479
  CDS Start-End: 69-647
agaggaccaagcctccctgtgtagcacaaagaaagtttctctgaatatatttaaagaaccatcaagaaatggggacctggattttgtttgcctgccttgtgggagcagcttttgccatgcctctaccacctcatcctgggcaccctggttatatcaacttcagctatgaggtgctcacccctttgaagtggtaccagagcatgataagaccaccatactcttcctatggttacgagcccatgggtggatggctgcaccaccaaatcatccccgtggtgtcccaacagcaccccctgactcacaccctgcagtctcatcaccacatcccagtggtgccagctcagcagcccagggtccgccagcaagcactgatgcctgttcctggccagcaatccatgactccaacccaacaccatcagccaaacctccctctgcctgcccagcagcccttccagccccagcctgttcagccacagcctcaccagcccatgcagccccagccacctgtgcaacccatgcagcccctgctgccacagccacctctgcctccaatgttccccctgcggcccctgccccccatacttcctgatctgcatctggaagcttggccagcaacagacaagaccaagcaggaggaagtggattaaaagaccagaatatgagacaggaactgaagtaaacactttagttgctttcagggatgacacaagcacacaatgatttttgcttacaatcacttaacttagcaaattctgtaactaaaaatgtaccaatagtagacaataaaatgttttaaaaatca

SEQ ID NO: 106813 - DNA, 621 bp, Homo sapiens
  Payload ID: 976
  Gene Symbol: AMELY
  Gene Name: amelogenin, Y-linked
  Uniprot ID: Q99218
  ENST ID: ENST00000383036
  CDS Start-End: 1-621
atggggacctggattttgtttgcctgccttgtgggagcagcttttgccatgcctctaccacctcatcctgggcaccctggttatatcaacttcagctatgagaactcacattctcaggctatcaatgttgacaggattgctttagtgctcacccctttgaagtggtaccagagcatgataagaccaccatactcttcctatggttacgagcccatgggtggatggctgcaccaccaaatcatccccgtggtgtcccaacagcaccccctgactcacaccctgcagtctcatcaccacatcccagtggtgccagctcagcagcccagggtccgccagcaagcactgatgcctgttcctggccagcaatccatgactccaacccaacaccatcagccaaacctccctctgcctgcccagcagcccttccagccccagcctgttcagccacagcctcaccagcccatgcagccccagccacctgtgcaacccatgcagcccctgctgccacagccacctctgcctccaatgttccccctgcggcccctgccccccatacttcctgatctgcatctggaagcttggccagcaacagacaagaccaagcaggaggaagtggattaa

SEQ ID NO: 106814 - DNA, 1037 bp, Homo sapiens
  Payload ID: 977
  Gene Symbol: AMTN
  Gene Name: amelotin
  Uniprot ID: Q6UX39
  ENST ID: ENST00000339336
  CDS Start-End: 131-760
tttaaatttcttctacaaacacatacatcattgaagggtaaaatttttcaccagagtaaacttgagaaaccaactggaccttgagtattgtacattttgcctcgtggacccaaaggtagcaatctgaaacatgaggagtacgattctactgttttgtcttctaggatcaactcggtcattaccacagctcaaacctgctttgggactccctcccacaaaactggctccggatcagggaacactaccaaaccaacagcagtcaaatcaggtctttccttctttaagtctgataccattaacacagatgctcacactggggccagatctgcatctgttaaatcctgctgcaggaatgacacctggtacccagacccacccattgaccctgggagggttgaatgtacaacagcaactgcacccacatgtgttaccaatttttgtcacacaacttggagcccagggcactatcctaagctcagaggaattgccacaaatcttcacgagcctcatcatccattccttgttcccgggaggcatcctgcccaccagtcaggcaggggctaatccagatgtccaggatggaagccttccagcaggaggagcaggtgtaaatcctgccacccagggaaccccagcaggccgcctcccaactcccagtggcacagatgacgactttgcagtgaccacccctgcaggcatccaaaggagcacacatgccatcgaggaagccaccacagaatcagcaaatggaattcagtaagctgtttcaaattttttcaactaagctgcctcgaatttggtgatacatgtgaatctttatcattgattatattatggaatagattgagacacattggatagtcttagaagaaattaattcttaatttacctgaaaatattcttgaaatttcagaaaatatgttctatgtagagaatcccaacttttaaaaacaataattcaatggataaatctgtctttgaaatataacattatgctgcctggatgatatgcatattaaaacatatttggaaaactg

SEQ ID NO: 106815 - DNA, 761 bp, Homo sapiens
  Payload ID: 977
  Gene Symbol: AMTN
  Gene Name: amelotin
  Uniprot ID: Q6UX39
  ENST ID: ENST00000504451
  CDS Start-End: 86-712
tttcaccagagtaaacttgagaaaccaactggaccttgagtattgtacattttgcctcgtggacccaaaggtagcaatctgaaacatgaggagtacgattctactgttttgtcttctaggatcaactcggtcattaccactcaaacctgctttgggactccctcccacaaaactggctccggatcagggaacactaccaaaccaacagcagtcaaatcaggtctttccttctttaagtctgataccattaacacagatgctcacactggggccagatctgcatctgttaaatcctgctgcaggaatgacacctggtacccagacccacccattgaccctgggagggttgaatgtacaacagcaactgcacccacatgtgttaccaatttttgtcacacaacttggagcccagggcactatcctaagctcagaggaattgccacaaatcttcacgagcctcatcatccattccttgttcccgggaggcatcctgcccaccagtcaggcaggggctaatccagatgtccaggatggaagccttccagcaggaggagcaggtgtaaatcctgccacccagggaaccccagcaggccgcctcccaactcccagtggcacagatgacgactttgcagtgaccacccctgcaggcatccaaaggagcacacatgccatcgaggaagccaccacagaatcagcaaatggaattcagtaagctgtttcaaattttttcaactaagctgcctcgaatttggtgatacatg

SEQ ID NO: 106816 - DNA, 2260 bp, Homo sapiens
  Payload ID: 978
  Gene Symbol: AMDHD1
  Gene Name: amidohydrolase domain containing 1
  Uniprot ID: Q96NU7
  ENST ID: ENST00000266736
  CDS Start-End: 107-1387
accctcccagccccggacagcgcaggctgcggcttttcgtcctccactgagtcctgccggtggcccgagcccggtggcctcccggcgaccctcggcgcgaggcgacatggcaagcggccacagcctcctgctggagaacgcgcagcaagtggtgctggtgtgcgcccgcggcgagcgcttcctggcgcgggatgcgctgcgcagcctggcggtgctggaaggcgccagcctggtggtgggcaaagatggatttataaaagctattggtcctgctgatgttattcaaagacagttttctggagaaacttttgaagaaataattgactgctctgggaaatgtattctaccaggtttggtggatgcacacacacatccagtatgggctggtgaaagagttcacgaatttgcaatgaagttggcaggagccacctacatggaaattcaccaggccggaggagggatccactttaccgtggagcgcacgcgccaagccacagaggaggagctgttccgctccttgcagcaacggctccagtgcatgatgagggctggcaccacgctggtggagtgcaagagtggatatggcctcgacctggagaccgagctcaagatgctgcgcgtgattgagcgcgcccggcgggagctggacatcggcatctcggctacctactgcggggctcattcagtgcctaaaggaaaaactgctactgaagctgctgatgacatcatcaataaccacctcccaaagctgaaggaacttggcagaaatggggaaatacacgtggacaatatagacgtattttgtgagaaaggtgtctttgatctcgattccaccagaaggattcttcaacgtggaaaagatatagggttacagattaacttccatggggatgaactccacccgatgaaggctgctgagcttggggctgaactgggagcgcaggcaatcagccacctggaagaagtgagtgatgaaggcatcgttgccatggcaacggccaggtgctctgccatccttctgcccaccacagcctacatgctgagactgaaacaacctcgagccaggaagatgttagatgaaggagtaatagttgctctgggaagtgatttcaaccccaatgcatattgcttttcaatgccaatggtcatgcatctggcctgtgtaaacatgagaatgtccatgcctgaggccttggccgctgccaccatcaatgcagcttatgcactgggaaagtctcacacacacggatcgttggaagttggcaaacagggagatctcattatcatcaattcatcccgatgggagcatttgatttaccagttcggaggccatcatgaattaattgaatatgttatagctaaaggaaaactcatctataaaacatgatagatttgaaaagagaagactttttgactatatgaaataagtcaatatagttatattaaaagttaaaacaccttaatatttacaagaattatatcacttaaacctaaatgtacttcaatgtctttttaagtcactcaaaaaacccaagggatagatttattttcatttaacacatgcatttgacatataaacaggtaaacctattgtgattaaaatcacaaaacatccaattagttcacaaatattggttacaaatattctgtagattaatatggtggggtatcacaaaaatgcctttgtggggaaaagtaggcttggcttaaaatttccattttgtgtctgtatttcacatctcagtttttaaactatatttagtgaacattgagggatcgaaagaaatctaagtgatacgccccaatgaagctaaaatatagccttctgttaagcaaatagtatttcctttccccaagtagttcattttctagatgcttgtcaaatgaattaatgtcctctgatgaagagtgtccttccgtttctaaggtcttctcaatctcagcaatagagcttcccagcagcgttcaagacacatcatttatacacaggcacaggggccttcctgaaatgggtgcatttttaccaactacaatcatgtaatttttttggaaattttttaaaattttcgattctttacattacaattgggtgaaacacattttacagctctcaataaatgtttgctgtcgctcttattgttgttgtttcctttcagcctggaagtagatcagcagcgttgtctattagagtttttaggaaattacaaaattatttgtaaagagtcgataattatttacatataaatgggtgtttttaaaa

SEQ ID NO: 106817 - DNA, 1841 bp, Homo sapiens
  Payload ID: 978
  Gene Symbol: AMDHD1
  Gene Name: amidohydrolase domain containing 1
  ENST ID: ENST00000548310
  CDS Start-End: 1-335
gcctggtggtgggcaaagatggatttataaaagctattggtcctgctgatgttattcaaagacagttttctggagaaacttttgaagaaataattgactgctctgggaaatgtattctaccagttggcaggagccacctacatggaaattcaccaggccggaggagggatccactttaccgtggagcgcacgcgccaagccacagaggaggagctgttccgctccttgcagcaacggctccagtgcatgatgagggctggcaccacgctggtggagtgcaagagtggatatggcctcgacctggagaccgagctcaagatgctgcgcgtgattgagcgcgcccggcgggagctggacatcggcatctcggctacctactgcggggctcattcagtgcctaaaggaaaaactgctactgaagctgctgatgacatcatcaataaccacctcccaaagctgaaggaacttggcagaaatggggaaatacacgtggacaatatagacgtattttgtgagaaaggtgtctttgatctcgattccaccagaaggattcttcaacgtggaaaagatatagggttacagattaacttccatggggatgaactccacccgatgaaggctgctgagcttggggctgaactgggagcgcaggcaatcagccacctggaagaagtgagtgatgaaggcatcgttgccatggcaacggccaggtgctctgccatccttctgcccaccacagcctacatgctgagactgaaacaacctcgagccaggaagatgttagatgaaggagtaatagttgctctgggaagtgatttcaaccccaatgcatattgcttttcaatgccaatggtcatgcatctggcctgtgtaaacatgagaatgtccatgcctgaggccttggccgctgccaccatcaatgcagcttatgcactgggaaagtctcacacacacggatcgttggaagttggcaaacagggagatctcattatcatcaattcatcccgatgggagcatttgatttaccagttcggaggccatcatgaattaattgaatatgttatagctaaaggaaaactcatctataaaacatgatagatttgaaaagagaagactttttgactatatgaaataagtcaatatagttatattaaaagttaaaacaccttaatatttacaagaattatatcacttaaacctaaatgtacttcaatgtctttttaagtcactcaaaaaacccaagggatagatttattttcatttaacacatgcatttgacatataaacaggtaaacctattgtgattaaaatcacaaaacatccaattagttcacaaatattggttacaaatattctgtagattaatatggtggggtatcacaaaaatgcctttgtggggaaaagtaggcttggcttaaaatttccattttgtgtctgtatttcacatctcagtttttaaactatatttagtgaacattgagggatcgaaagaaatctaagtgatacgccccaatgaagctaaaatatagccttctgttaagcaaatagtatttcctttccccaagtagttcattttctagatgcttgtcaaatgaattaatgtcctctgatgaagagtgtccttccgtttctaaggtcttctcaatctcagcaatagagcttcccagcagcgttcaagacacatcatttatacacaggcacaggggccttcctgaaatgggtgcatttttaccaactacaatcatgtaatttttttggaaattttttaaaattttcgattctttacattacaattgggtgaaacacattttacagctctcaataaatgtttgctgtcgctc

SEQ ID NO: 106818 - DNA, 566 bp, Homo sapiens
  Payload ID: 978
  Gene Symbol: AMDHD1
  Gene Name: amidohydrolase domain containing 1
  ENST ID: ENST00000553023
  CDS Start-End: 549-566
gtgtctctgcctggccgcccatcgtctgggatgtgaggagcccctctgcctggctgcccagtctggaaagtgaggagcgtctctgcccggccgccatcccatctaggaagtgaggagcgcctcttcccagccgccatcacatctaggaagtgaagagcctctctgcccggccgcccatcgtctgagatgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccgtctgagaaagatggatttataaaagctattggtcctgctgatgttattcaaagacagttttctggagaaacttttgaagaaataattgactgctctgggaaatgtattctaccaggtttggtggatgcacacacacatccagtatgggctggtgaaagagttcacgaatttgcaatgaagttggcaggagcc

SEQ ID NO: 106819 - DNA, 1459 bp, Homo sapiens
  Payload ID: 979
  Gene Symbol: AMDHD2
  Gene Name: amidohydrolase domain containing 2
  Uniprot ID: Q9Y303
  ENST ID: ENST00000293971
  CDS Start-End: 95-1324
ggcgcggtctcagctctcggctggggttcgtcactgggcgcgggatttggccgccgcggggctccggagccgctcgctcccgacacggctcacgatgcgcggcgagcagggcgcggcgggggcccgcgtgctccagttcactaactgccggatcctgcgcggagggaaactgctcagggaggatctgtgggtgcgcggaggccgcatcttggacccagagaagctgttctttgaggagcggcgcgtggccgacgagcggcgggactgcgggggccgcatcttggctcccggattcatcgacgtgcagatcaacggtggatttggtgttgacttctctcaagccacggaggacgtgggttcgggggttgccctcgtggcccggaggatcctgtcgcacggcgtcacctccttctgccccaccctggtcacttccccaccggaggtttatcacaaggttgttcctcagatccctgtgaagagtggtggtccccatggggcaggggtcctcgggctgcacctggagggccccttcatcagccgggagaagcggggcgcgcaccccgaggcccacctccgctccttcgaggccgatgccttccaggacttgctggccacctacgggcccctggacaatgtccgcatcgtgacgctggccccagagttgggccgtagccacgaagtgatccgggcgctgacggcccgtggcatctgcgtgtccctagggcactcagtggctgacctgcgggcggcagaggatgctgtgtggagcggagccaccttcatcacccacctcttcaacgccatgctgcctttccaccaccgcgacccaggcatcgtggggctcctgaccagcgaccggctgcccgcaggccgctgcatcttctatgggatgattgcagatggcacgcacaccaaccccgccgccctgcggatcgcccaccgtgcccatccccaggggctggtgctggtcaccgatgccatccctgccttgggcctgggcaacggccggcacacgctgggacagcaggaagtggaagtggacggtctgacggcctacgtggcaggcaccaagacgctgagtggcagcatagccccaatggacgtctgtgtccggcacttcctgcaggccacaggctgcagcatggagtcggccctggaggctgcatccctgcaccccgcccagttgctggggctggagaagagtaaggggaccctggactttggtgctgacgcagacttcgtggtgctcgacgactcccttcacgtccaggccacctacatctcgggtgagctggtgtggcaggcggacgcagctaggcagtgacaaggacctcggctgagaggacacctggccgcagcgggatgccatcagggccgggtggttggggagctggtctccagggagtgagtcgggagccctgctggattgatgcccagggcctgtgcggccgccctggag

SEQ ID NO: 106820 - DNA, 3273 bp, Homo sapiens
  Payload ID: 979
  Gene Symbol: AMDHD2
  Gene Name: amidohydrolase domain containing 2
  Uniprot ID: Q9Y303
  ENST ID: ENST00000302956
  CDS Start-End: 95-1414
ggcgcggtctcagctctcggctggggttcgtcactgggcgcgggatttggccgccgcggggctccggagccgctcgctcccgacacggctcacgatgcgcggcgagcagggcgcggcgggggcccgcgtgctccagttcactaactgccggatcctgcgcggagggaaactgctcagggaggatctgtgggtgcgcggaggccgcatcttggacccagagaagctgttctttgaggagcggcgcgtggccgacgagcggcgggactgcgggggccgcatcttggctcccggattcatcgacgtgcagatcaacggtggatttggtgttgacttctctcaagccacggaggacgtgggttcgggggttgccctcgtggcccggaggatcctgtcgcacggcgtcacctccttctgccccaccctggtcacttccccaccggaggtttatcacaaggttgttcctcagatccctgtgaagagtggtggtccccatggggcaggggtcctcgggctgcacctggagggccccttcatcagccgggagaagcggggcgcgcaccccgaggcccacctccgctccttcgaggccgatgccttccaggacttgctggccacctacgggcccctggacaatgtccgcatcgtgacgctggccccagagttgggccgtagccacgaagtgatccgggcgctgacggcccgtggcatctgcgtgtccctagggcactcagtggctgacctgcgggcggcagaggatgctgtgtggagcggagccaccttcatcacccacctcttcaacgccatgctgcctttccaccaccgcgacccaggcatcgtggggctcctgaccagcgaccggctgcccgcaggccgctgcatcttctatgggatgattgcagatggcacgcacaccaaccccgccgccctgcggatcgcccaccgtgcccatccccaggggctggtgctggtcaccgatgccatccctgccttgggcctgggcaacggccggcacacgctgggacagcaggaagtggaagtggacggtctgacggcctacgtggcaggtgagcgccctgacccactgggtcccaggtcccagcccgcatgccaggtggcccacgacccccccagagcctgccctctctgctctcaaggcaccaagacgctgagtggcagcatagccccaatggacgtctgtgtccggcacttcctgcaggccacaggctgcagcatggagtcggccctggaggctgcatccctgcaccccgcccagttgctggggctggagaagagtaaggggaccctggactttggtgctgacgcagacttcgtggtgctcgacgactcccttcacgtccaggccacctacatctcgggtgagctggtgtggcaggcggacgcagctaggcagtgacaaggacctcggctgagaggacacctggccgcagcgggatgccatcagggccgggtggttggggagctggtctccagggagtgagtcgggagccctgctggattgatgcccagggcctgtgcggccgccctggaggcggtggctgggataaacgtgcacccagcaggactcgccttggctccgggttttgcttgtgctcacatgtggcaccatccttggttgccctcctggagaaggcattcacggcctggggtgggatggctgggctgtagtttagcctgggccttgggccccagtgggggacagggcctgtctgcatgaagtggaccggagacctgcagaccccaggaaagtgtcactatgggagggaggggcaggcagtcagtggctggtgccatggggtgaagccaccatgggctgggggtgaagagccggcaggaaggggaccagtcacagggagtgtggacagtcaggggtttgctttctgctcctgagttggggtgtgcagcgtggagcccacagcctggttctgggccagggcacagtgccaggggctccgctctgacctccaggagggagactgggcccgggacccctgttttctgctccctggactgcctagccctgagtgccacggatgaccagcgttctgttttctcttctcaataaccctatctcttcacacatccccaggcccagtgcttgccggctgtggtgaccctgcctggtgctggagggcagtatgggaggcaccagtgtgccctgctcaccccattagtgtcatcctgccatcttctgtgtccccttggccctggcacacacccatgtggcaaacacgggccgtgaggctccctgaacagcttcgaggcgggtgggcttctggagccctcttggctctgaggacagccacagtggggtcagacgtcagggattggtgcagccccacgtcaggggtgattgtcttgactttctctccatttgagttctggggtgggtggctcccttcccccttgcttacaggtgctgtcctgggcacaggaggtacgcgcctggctctgccactgttctcttccctctgctgcaaagcccagttaaggaaatgtctccaggtccaaagagataggatggtctgggccccacctgttggaagggaacagccagggaagaaccacctgcctgggcagggcctcgcctgagggagggcctggggcagggcacaaggggttgatctcagcccacaagccccaggggcagcccaggaaagcaggcgacggatgtggatcctgacctcctgagaggtgtgaggtgcagggatacccacctctgccttgacggccgcgcaccccttaggaagtggctgtccagcgcctgcctgtgctgggcctgggagaggagctgtcttgccagggctcccaggcagggagaggcaggtgaggttctcagccgatgtgttagaggttgagcatcgcctgtgcccagcttgctggctgtcagtgcttgatgtgcccatcctcagctaaaacccagagctggcatgttggtcatccccacctcagacgggacgcccagtccagagctggtgagccctgggccagcctttgggcctggcctgccccattcaccggccagcgccccacctccctggctggagggtcggggaggggctggcagagatggttggtccacagggctagccctgggtggtgggagaggggcccagggtcagggtgagagagagctgggccagggagctgctgcaggatgattttgaggtgtgggggaagcactcttggttggttttggtttgctttttaaaaattgtggtaaaatacataacaaaagtaactatcgtaacctga

SEQ ID NO: 106821 - DNA, 2049 bp, Homo sapiens
  Payload ID: 979
  Gene Symbol: AMDHD2
  Gene Name: amidohydrolase domain containing 2
  Uniprot ID: Q9Y303
  ENST ID: ENST00000413459
  CDS Start-End: 70-1854
gttcgtcactgggcgcgggatttggccgccgcggggctccggagccgctcgctcccgacacggctcacgatgcgcggcgagcagggcgcggcgggggcccgcgtgctccagttcactaactgccggatcctgcgcggagggaaactgctcagggaggatctgtgggtgcgcggaggccgcatcttggacccagagaagctgttctttgaggagcggcgcgtggccgacgagcggcgggactgcgggggccgcatcttggctcccggattcatcgacgtgcagatcaacggtggatttggtgttgacttctctcaagccacggaggacgtgggttcgggggttgccctcgtggcccggaggatcctgtcgcacggcgtcacctccttctgccccaccctggtcacttccccaccggaggtttatcacaaggttgttcctcagatccctgtgaagagtggtggtccccatggggcaggggtcctcgggctgcacctggagggccccttcatcagccgggagaagcggggcgcgcaccccgaggcccacctccgctccttcgaggccgatgccttccaggacttgctggccacctacgggcccctggacaatgtccgcatcgtgacgctggccccagagttgggccgtagccacgaagtgatccgggcgctgacggcccgtggcatctgcgtgtccctagggcactcagtggctgacctgcgggcggcagaggatgctgtgtggagcggagccaccttcatcacccacctcttcaacgccatgctgcctttccaccaccgcgacccaggcatcgtggggctcctgaccagcgaccggctgcccgcaggccgctgcatcttctatgggatgattgcagatggcacgcacaccaaccccgccgccctgcggatcgcccaccgtgcccatccccaggggctggtgctggtcaccgatgccatccctgccttgggcctgggcaacggccggcacacgctgggacagcaggaagtggaagtggacggtctgacggcctacgtggcaggtgagcgccctgacccactgggtcccaggtcccagcccgcatgccaggtggcccacgacccccccagagcctgccctctctgctctcaaggcaccaagacgctgagtggcagcatagccccaatggacgtctgtgtccggcacttcctgcaggccacaggctgcagcatggagtcggccctggaggctgcatccctgcaccccgcccagttgctggggctggagaagagtaaggggaccctggactttggtgctgacgcagacttcgtggtgctcgacgactcccttcacgtccaggccacctacatctcgggcccagtgcttgccggctgtggtgaccctgcctggtgctggagggcagtatgggaggcaccagtgtgccctgctcaccccattagtgtcatcctgccatcttctgtgtccccttggccctggcacacacccatgtggcaaacacgggccgtgaggctccctgaacagcttcgaggcgggtgggcttctggagccctcttggctctgaggacagccacagtggggtcagacgtcagggattggtgcagccccacgtcaggggtgattgtcttgactttctctccatttgagttctggggtgggtggctcccttcccccttgcttacaggtgctgtcctgggcacaggaggtacgcgcctggctctgccactgttctcttccctctgctgcaaagcccagttaaggaaatgtctccaggtccaaagagataggatggtctgggccccacctgttggaagggaacagccagggaagaaccacctgcctgggcagggcctcgcctgagggagggcctggggcagggcacaaggggttgatctcagcccacaagccccaggggcagcccaggaaagcaggcgacggatgtggatcctgacctcctgagaggtgtgaggtgcagggatacccacctctgccttgacggccgcgcaccccttaggaagtggctgtccagcgcctgcctgtgctgggcctgggaga

SEQ ID NO: 106822 - DNA, 490 bp, Homo sapiens
  Payload ID: 979
  Gene Symbol: AMDHD2
  Gene Name: amidohydrolase domain containing 2
  ENST ID: ENST00000563556
  CDS Start-End: 24-490
gctcgctcccgacacggctcacgatgcgcggcgagcagggcgcggcgggggcccgcgtgctccagttcactaactgccggatcctgcgcggagggaaactgctcagggaggatctgtgggtgcgcggaggccgcatcttggacccagagaagctgttctttgaggagcggcgcgtggccgacgagcggcgggactgcgggggccgcatcttggctcccggattcatcgacgtgcagatcaacggtggatttggtgttgacttctctcaagccacggaggacgtgggttcgggggttgccctcgtggcccggaggatcctgtcgcacggcgtcacctccttctgccccaccctggtcacttccccaccggaggtttatcacaagatccctgtgaagagtggtggtccccatggggcaggggtcctcgggctgcacctggagggccccttcatcagccgggagaagcggggcgcgcaccccgaggcccacct

SEQ ID NO: 106823 - DNA, 940 bp, Homo sapiens
  Payload ID: 979
  Gene Symbol: AMDHD2
  Gene Name: amidohydrolase domain containing 2
  ENST ID: ENST00000566706
  CDS Start-End: 39-940
cggggctccggagccgctcgctcccgacacggctcacgatgcgcggcgagcagggcgcggcgggggcccgcgtgctccagttcactaactgccggatcctgcgcggagggaaactgctcagggaggatctgtgggtgcgcggaggccgcatcttggacccagagaagctgttctttgaggagcggcgcgtggccgacgagcggcgggactgcgggggccgcatcttggctcccggattcatcgacgtgcagatcaacggtggatttggtgttgacttctctcaagccacggaggacgtgggttcgggggttgccctcgtggcccggaggatcctgtcgcacggcgtcacctccttctgccccaccctggtcacttccccaccggaggtttatcacaaggttgttcctcagatccctgtgaagagtggtggtccccatggggcaggggtcctcgggcactcagtggctgacctgcgggcggcagaggatgctgtgtggagcggagccaccttcatcacccacctcttcaacgccatgctgcctttccaccaccgcgacccaggcatcgtggggctcctgaccagcgaccggctgcccgcaggccgctgcatcttctatgggatgattgcagatggcacgcacaccaaccccgccgccctgcggatcgcccaccgtgcccatccccaggggctggtgctggtcaccgatgccatccctgccttgggcctgggcaacggccggcacacgctgggacagcaggaagtggaagtggacggtctgacggcctacgtggcaggctgcagcatggagtcggccctggaggctgcatccctgcaccccgcccagttgctggggctggagaagagtaaggggaccctggactttggtgctgacgcagacttcgtggtgctcgacgactcccttcacgtccaggccaccta

SEQ ID NO: 106824 - DNA, 1117 bp, Homo sapiens
  Payload ID: 979
  Gene Symbol: AMDHD2
  Gene Name: amidohydrolase domain containing 2
  ENST ID: ENST00000563633
  CDS Start-End: 67-564
cgtcactgggcgcgggatttggccgccgcggggctccggagccgctcgctcccgacacggctcacgatgcgcggcgagcagggcgcggcgggggcccgcgtgctccagttcactaactgccggatcctgcgcggagggaaactgctcagggaggatctgtgggtgcgcggaggccgcatcttggacccagagaagctgttctttgaggagcggcgcgtggccgacgagcggcgggactgcgggggccgcatcttggctcccggattcatcgacgtgcagatcaacggtggatttggtgttgacttctctcaagccacggaggacgtgggttcgggggttgccctcgtggcccggaggatcctgtcgcacggcgtcacctccttctgccccaccctggtcacttccccaccggaggtttatcacaagggctgcacctggagggccccttcatcagccgggagaagcggggcgcgcaccccgaggcccacctccgctccttcgaggccgatgccttccaggacttgctggccacctacgggcccctggacaatgtccgcatcgtgacgctggccccagagttgggccgtagccacgaagtgatccgggcgctgacggcccgtggcatctgcgtgtccctagggcactcagtggctgacctgcgggcggcagaggatgctgtgtggagcggagccaccttcatcacccacctcttcaacgccatgctgcctttccaccaccgcgacccaggcatcgtggggctcctgaccagcgaccggctgcccgcaggccgctgcatcttctatgggatgattgcagatggcacgcacaccaaccccgccgccctgcggatcgcccaccgtgcccatccccaggggctggtgctggtcaccgatgccatccctgccttgggcctgggcaacggccggcacacgctgggacagcaggaagtggaagtggacggtctgacggcctacgtggcaggcaccaagacgctgagtggcagcatagccccaatggacgtctgtgtccggcacttcctgcaggccacaggctgcagcatggagtcggccctggaggctgcatccctgcaccccgcccagttgctggggctggagaa

SEQ ID NO: 106825 - DNA, 1482 bp, Homo sapiens
  Payload ID: 979
  Gene Symbol: AMDHD2
  Gene Name: amidohydrolase domain containing 2
  ENST ID: ENST00000568263
  CDS Start-End: 674-1482
gtcacgtgggcgcggtctcagctctcggctggggttcgtcactgggcgcgggatttggccgccgcggggctccggagccgctcgctcccgacacggctcacgatgcgcggcgagcagggcgcggcgggggcccgcgtgctccagttcactaactgccggatcctgcgcggagggaaactgctcaggtggatttggtgttgacttctctcaagccacggaggacgtgggttcgggggttgccctcgtggcccggaggatcctgtcgcacggcgtcacctccttctgccccaccctggtcacttccccaccggaggtttatcacaaggttgttcctcagatccctgtgaagagtggtggtccccatggggcaggggtcctcgggctgcacctggagggccccttcatcagccgggagaagcggggcgcgcaccccgaggcccacctccgctccttcgaggccgatgccttccaggacttgctggccacctacgggcccctggacaatgtccgcatcgtgacgctggccccagagttgggccgtagccacgaagtgatccgggcgctgacggcccgtggcatctgcgtgtccctagggcactcagtggctgacctgcgggcggcagaggatgctgtgtggagcggagccaccttcatcacccacctcttcaacgccatgctgcctttccaccaccgcgacccaggcatcgtggggctcctgaccagcgaccggctgcccgcaggccgctgcatcttctatgggatgattgcagatggcacgcacaccaaccccgccgccctgcggatcgcccaccgtgcccatccccaggggctggtgctggtcaccgatgccatccctgccttgggcctgggcaacggccggcacacgctgggacagcaggaagtggaagtggacggtctgacggcctacgtggcaggtgagcgccctgacccactgggtcccaggtcccagcccgcatgccaggtggcccacgacccccccagagcctgccctctctgctctcaaggcaccaagacgctgagtggcagcatagccccaatggacgtctgtgtccggcacttcctgcaggccacaggctgcagcatggagtcggccctggaggctgcatccctgcaccccgcccagttgctggggctggagaagagtaaggggaccctggactttggtgctgacgcagacttcgtggtgctcgacgactcccttcacgtccaggccacctacatctcgggcccagtgcttgccggctgtggtgaccctgcctggtgctggagggcagtatgggaggcaccagtgtgccctgctcaccccattagtgtcatcctgccatcttctgtgtccccttggccctggcacacacccatgtggcaaacacgggccgtgaggctccctgaacagcttcgaggcgggtgggcttctggagccctcttggctctgaggacagccacagtggggtcagacgtcag

SEQ ID NO: 106826 - DNA, 924 bp, Homo sapiens
  Payload ID: 979
  Gene Symbol: AMDHD2
  Gene Name: amidohydrolase domain containing 2
  ENST ID: ENST00000569879
  CDS Start-End: 35-924
gctccggagccgctcgctcccgacacggctcacgatgcgcggcgagcagggcgcggcgggggcccgcgtgctccagttcactaactgccggatcctgcgcggagggaaactgctcagggaggatctgtgggtgcgcggaggccgcatcttggacccagagaagctgttctttgaggagcggcgcgtggccgacgagcggcgggactgcgggggccgcatcttggctcccggattcatcgacgtgcagatcaacggtggatttggtgttgacttctctcaagccacggaggacgtgggttcgggggttgccctcgtggcccggaggatcctgtcgcacggcgtcacctccttctgccccaccctggtcacttccccaccggaggtttatcacaaggttgttcctcagatccctgtgaagagtggtggtccccatggggcaggggtcctcgggcactcagtggctgacctgcgggcggcagaggatgctgtgtggagcggagccaccttcatcacccacctcttcaacgccatgctgcctttccaccaccgcgacccaggcatcgtggggctcctgaccagcgaccggctgcccgcaggccgctgcatcttctatgggatgattgcagatggcacgcacaccaaccccgccgccctgcggatcgcccaccgtgcccatccccaggggctggtgctggtcaccgatgccatccctgccttgggcctgggcaacggccggcacacgctgggacagcaggaagtggaagtggacggtctgacggcctacgtggcaggtgagcgccctgacccactgggtcccaggtcccagcccgcatgccaggtggcccacgacccccccagagcctgccctctctgctctcaaggcaccaagacgctgagtggcagcatagccccaatggacgtctg

SEQ ID NO: 106827 - DNA, 2649 bp, Homo sapiens
  Payload ID: 980
  Gene Symbol: AOC1
  Gene Name: amine oxidase, copper containing 1
  Uniprot ID: P19801
  ENST ID: ENST00000360937
  CDS Start-End: 99-2354
tctgattgacttcaagaaggagtcagagatcagcttaagggcaaaggctggaagcagagcgaactgggagcagagcacacagagccgtggagcgagagatgccggccctgggctgggccgtggctgccatcctgatgctgcagacggccatggcggagccctccccggggactctgcccaggaaggcaggggtgttttcagacctaagcaaccaagagctgaaggcagtgcacagcttcctctggtccaagaaggagctgaggctgcagccctccagtaccaccaccatggccaagaacaccgtgtttctcatcgagatgctgctgcccaagaagtaccatgtgctgaggtttctggataaaggtgaaaggcatcctgtgcgggaagcccgtgccgtcatcttctttggtgaccaggagcatcccaatgtcaccgagtttgctgtggggcccctgccagggccctgctacatgcgagcactgtcccccaggcctgggtaccagtcctcctgggcatcgaggcccatctccacagcagagtatgccctcctctaccacaccctgcaggaagccaccaagcccctgcatcagttcttcctcaataccacaggcttctcattccaagactgccatgacagatgcctggccttcaccgatgtggccccccggggtgtggcttctggccagcgccgcagttggcttatcatacagcgctatgtagaaggctactttctgcaccccactgggctggagctcctcgtggatcatgggagcacagatgctgggcactgggccgtggagcaggtgtggtacaacgggaagttctatgggagcccagaggaactggctcggaagtatgcagatggagaggtggacgtggtggtcctggaggacccgctgcctgggggcaaggggcatgacagcacagaggagccgcccctcttctcctcccacaagccccgcggggacttccccagccccatccatgtgagcggcccccgcttggtccagccccacggccctcgcttcaggctggagggcaacgctgtgctctacggcggctggagctttgccttccggctgcgctcctcctccgggctgcaggtcctgaacgtgcacttcggcggagagcgcattgcctatgaggtcagcgtgcaagaggcagtggcgctgtatggaggacacacacctgcaggcatgcagaccaagtacctcgatgtcggctggggcctgggcagcgtcactcatgagttagcccccggcatcgactgcccggagaccgccaccttcctggacactttccactactatgatgccgatgacccggtccattatccccgagccctctgcctctttgaaatgcccacaggggtgccccttcggcggcactttaattccaactttaaaggtggcttcaacttctatgcggggctgaagggccaggtgctggtgctgcggacaacttcaactgtctacaattatgattacatttgggactttatcttctaccccaacggggtgatggaggccaagatgcatgccactggctacgtccacgccaccttctacacccccgaggggctgcgccacggcactcgcctgcacacccacctgattggcaacatacacactcacttggtgcactaccgcgtagacctggatgtggcaggcaccaagaacagcttccagacactgcagatgaagctagaaaacatcaccaacccctggagcccaagacaccgcgtggtccagccaactctggagcagacgcagtactcctgggagcgccaggcggccttccgcttcaaaaggaagctgcctaagtacctgctctttaccagcccccaggagaacccctggggccacaagcgcacgtaccgcctgcagatccactccatggccgaccaggtgctgcccccaggctggcaggaggagcaggccatcacctgggcaaggtaccccctggcagtgaccaagtaccgggagtcggagctgtgcagcagcagcatctaccaccagaacgacccctggcacccgcccgtggtctttgagcagtttcttcacaacaacgagaacattgaaaatgaggacctggtggcctgggtgacggtgggcttcctgcacatcccccactcagaggacattcccaacacagccacacctgggaactccgtgggcttcctgctccggccattcaacttcttcccagaggacccctccctggcatccagagacactgtgatcgtgtggcctcgggacaacggccccaactacgtccagcgctggatccctgaggacagggactgctcgatgcctcccccttttagctacaatgggacctatagacctgtgtgaccagcccccagttcctcccccagttcctcccaggaagcccaggagcctcactggggcagacaataaaccctcagagcctcgctctgtgtgctgcttcttgcggggaggcacagggccatgtgtgtaggaaacacacgaacagacgtgcacacacacagacgtgcacacacacacagacatgcacacacacacagacgtgcacacacacagacgtgcacgcactcacacggacatgcacacacatggcatgtactttattcacactggtctactgcagtccagaaaagccaccatt

SEQ ID NO: 106828 - DNA, 2453 bp, Homo sapiens
  Payload ID: 980
  Gene Symbol: AOC1
  Gene Name: amine oxidase, copper containing 1
  Uniprot ID: P19801
  ENST ID: ENST00000416793
  CDS Start-End: 61-2373
gggcaaaggctggaagcagagcgaactgggagcagagcacacagagccgtggagcgagagatgccggccctgggctgggccgtggctgccatcctgatgctgcagacggccatggcggagccctccccggggactctgcccaggaaggcaggggtgttttcagacctaagcaaccaagagctgaaggcagtgcacagcttcctctggtccaagaaggagctgaggctgcagccctccagtaccaccaccatggccaagaacaccgtgtttctcatcgagatgctgctgcccaagaagtaccatgtgctgaggtttctggataaaggtgaaaggcatcctgtgcgggaagcccgtgccgtcatcttctttggtgaccaggagcatcccaatgtcaccgagtttgctgtggggcccctgccagggccctgctacatgcgagcactgtcccccaggcctgggtaccagtcctcctgggcatcgaggcccatctccacagcagagtatgccctcctctaccacaccctgcaggaagccaccaagcccctgcatcagttcttcctcaataccacaggcttctcattccaagactgccatgacagatgcctggccttcaccgatgtggccccccggggtgtggcttctggccagcgccgcagttggcttatcatacagcgctatgtagaaggctactttctgcaccccactgggctggagctcctcgtggatcatgggagcacagatgctgggcactgggccgtggagcaggtgtggtacaacgggaagttctatgggagcccagaggaactggctcggaagtatgcagatggagaggtggacgtggtggtcctggaggacccgctgcctgggggcaaggggcatgacagcacagaggagccgcccctcttctcctcccacaagccccgcggggacttccccagccccatccatgtgagcggcccccgcttggtccagccccacggccctcgcttcaggctggagggcaacgctgtgctctacggcggctggagctttgccttccggctgcgctcctcctccgggctgcaggtcctgaacgtgcacttcggcggagagcgcattgcctatgaggtcagcgtgcaagaggcagtggcgctgtatggaggacacacacctgcaggcatgcagaccaagtacctcgatgtcggctggggcctgggcagcgtcactcatgagttagcccccggcatcgactgcccggagaccgccaccttcctggacactttccactactatgatgccgatgacccggtccattatccccgagccctctgcctctttgaaatgcccacaggggtgccccttcggcggcactttaattccaactttaaaggtggcttcaacttctatgcggggctgaagggccaggtgctggtgctgcggacaacttcaactgtctacaattatgattacatttgggactttatcttctaccccaacggggtgatggaggccaagatgcatgccactggctacgtccacgccaccttctacacccccgaggggctgcgccacggcactcgcctgcacacccacctgattggcaacatacacactcacttggtgcactaccgcgtagacctggatgtggcaggcaccaagaacagcttccagacactgcagatgaagctagaaaacatcaccaacccctggagcccaagacaccgcgtggtccagccaactctggagcagacgcagtactcctgggagcgccaggcggccttccgcttcaaaaggaagctgcctaagtacctgctctttaccagcccccaggagaacccctggggccacaagcgcacgtaccgcctgcagatccactccatggccgaccaggtgctgcccccaggctggcaggaggagcaggccatcacctgggcaaggactgaggggggccagcccagggccctgagccaagctgcttcgcctgtgcctggcaggtaccccctggcagtgaccaagtaccgggagtcggagctgtgcagcagcagcatctaccaccagaacgacccctggcacccgcccgtggtctttgagcagtttcttcacaacaacgagaacattgaaaatgaggacctggtggcctgggtgacggtgggcttcctgcacatcccccactcagaggacattcccaacacagccacacctgggaactccgtgggcttcctgctccggccattcaacttcttcccagaggacccctccctggcatccagagacactgtgatcgtgtggcctcgggacaacggccccaactacgtccagcgctggatccctgaggacagggactgctcgatgcctcccccttttagctacaatgggacctatagacctgtgtgaccagcccccagttcctcccccagttcctcccaggaagcccaggagcctcactggggcagacaataaaccctcagagcctc

SEQ ID NO: 106829 - DNA, 1314 bp, Homo sapiens
  Payload ID: 980
  Gene Symbol: AOC1
  Gene Name: amine oxidase, copper containing 1
  ENST ID: ENST00000483043
  CDS Start-End: 303-1314
aaaggctggaagcagagcgaactgggagcagagcacacagaggctgaggcaggagaattgcttgaacctgggaggcagaggtagcagtgagccaagatcgcatcactgcactccagcctgggctacagagcaagactgtctcaggaaaaagaaaaaatagtctatttaaagaagaaaaaaaagaggcctggccaatatttaataggagaacacaagaactcacctcatatccttcctgctggctctgggttccgcctgcagcccctgcctcacctgctccctccagagccgtggagcgagagatgccggccctgggctgggccgtggctgccatcctgatgctgcagacggccatggcggagccctccccggggactctgcccaggaaggcaggggtgttttcagacctaagcaaccaagagctgaaggcagtgcacagcttcctctggtccaagaaggagctgaggctgcagccctccagtaccaccaccatggccaagaacaccgtgtttctcatcgagatgctgctgcccaagaagtaccatgtgctgaggtttctggataaaggtgaaaggcatcctgtgcgggaagcccgtgccgtcatcttctttggtgaccaggagcatcccaatgtcaccgagtttgctgtggggcccctgccagggccctgctacatgcgagcactgtcccccaggcctgggtaccagtcctcctgggcatcgaggcccatctccacagcagagtatgccctcctctaccacaccctgcaggaagccaccaagcccctgcatcagttcttcctcaataccacaggcttctcattccaagactgccatgacagatgcctggccttcaccgatgtggccccccggggtgtggcttctggccagcgccgcagttggcttatcatacagcgctatgtagaaggctactttctgcaccccactgggctggagctcctcgtggatcatgggagcacagatgctgggcactgggccgtggagcaggtgtggtacaacgggaagttctatgggagcccagaggaactggctcggaagtatgcagatggagaggtggacgtggtggtcctggaggacccgctgcctgggggcaaggggcatgacagcacagaggagccgcccctcttctcctcccacaagccccgcggggacttccccagccccatccatgtgagcggcccccgcttggtccagccccacggccctcgcttcaggctggagggcaacgctgtgctctacggcggctggagctttgccttccggctgcgctcctcctccgggctgcaggtcctga

SEQ ID NO: 106830 - DNA, 2857 bp, Homo sapiens
  Payload ID: 980
  Gene Symbol: AOC1
  Gene Name: amine oxidase, copper containing 1
  Uniprot ID: P19801
  ENST ID: ENST00000467291
  CDS Start-End: 307-2562
tttggaggagacaagtttgggagcaggaaagccagtaggagtctactgcaggaatttagctttcaaatctgtacctgttgatgagagaacctccaggtttgtcccctactaccaatgatgaggcaaacacagagagaggaacccctttgactaaagctgaattgtaaaggactaaagccctaacttctcttcgaatgacctgcattcaaatcaagagcggttgaattctctgttttgctgtgggtgccagcctctatcagcccctgccctggtccatctgtcagcttcagagccgtggagcgagagatgccggccctgggctgggccgtggctgccatcctgatgctgcagacggccatggcggagccctccccggggactctgcccaggaaggcaggggtgttttcagacctaagcaaccaagagctgaaggcagtgcacagcttcctctggtccaagaaggagctgaggctgcagccctccagtaccaccaccatggccaagaacaccgtgtttctcatcgagatgctgctgcccaagaagtaccatgtgctgaggtttctggataaaggtgaaaggcatcctgtgcgggaagcccgtgccgtcatcttctttggtgaccaggagcatcccaatgtcaccgagtttgctgtggggcccctgccagggccctgctacatgcgagcactgtcccccaggcctgggtaccagtcctcctgggcatcgaggcccatctccacagcagagtatgccctcctctaccacaccctgcaggaagccaccaagcccctgcatcagttcttcctcaataccacaggcttctcattccaagactgccatgacagatgcctggccttcaccgatgtggccccccggggtgtggcttctggccagcgccgcagttggcttatcatacagcgctatgtagaaggctactttctgcaccccactgggctggagctcctcgtggatcatgggagcacagatgctgggcactgggccgtggagcaggtgtggtacaacgggaagttctatgggagcccagaggaactggctcggaagtatgcagatggagaggtggacgtggtggtcctggaggacccgctgcctgggggcaaggggcatgacagcacagaggagccgcccctcttctcctcccacaagccccgcggggacttccccagccccatccatgtgagcggcccccgcttggtccagccccacggccctcgcttcaggctggagggcaacgctgtgctctacggcggctggagctttgccttccggctgcgctcctcctccgggctgcaggtcctgaacgtgcacttcggcggagagcgcattgcctatgaggtcagcgtgcaagaggcagtggcgctgtatggaggacacacacctgcaggcatgcagaccaagtacctcgatgtcggctggggcctgggcagcgtcactcatgagttagcccccggcatcgactgcccggagaccgccaccttcctggacactttccactactatgatgccgatgacccggtccattatccccgagccctctgcctctttgaaatgcccacaggggtgccccttcggcggcactttaattccaactttaaaggtggcttcaacttctatgcggggctgaagggccaggtgctggtgctgcggacaacttcaactgtctacaattatgattacatttgggactttatcttctaccccaacggggtgatggaggccaagatgcatgccactggctacgtccacgccaccttctacacccccgaggggctgcgccacggcactcgcctgcacacccacctgattggcaacatacacactcacttggtgcactaccgcgtagacctggatgtggcaggcaccaagaacagcttccagacactgcagatgaagctagaaaacatcaccaacccctggagcccaagacaccgcgtggtccagccaactctggagcagacgcagtactcctgggagcgccaggcggccttccgcttcaaaaggaagctgcctaagtacctgctctttaccagcccccaggagaacccctggggccacaagcgcacgtaccgcctgcagatccactccatggccgaccaggtgctgcccccaggctggcaggaggagcaggccatcacctgggcaaggtaccccctggcagtgaccaagtaccgggagtcggagctgtgcagcagcagcatctaccaccagaacgacccctggcacccgcccgtggtctttgagcagtttcttcacaacaacgagaacattgaaaatgaggacctggtggcctgggtgacggtgggcttcctgcacatcccccactcagaggacattcccaacacagccacacctgggaactccgtgggcttcctgctccggccattcaacttcttcccagaggacccctccctggcatccagagacactgtgatcgtgtggcctcgggacaacggccccaactacgtccagcgctggatccctgaggacagggactgctcgatgcctcccccttttagctacaatgggacctatagacctgtgtgaccagcccccagttcctcccccagttcctcccaggaagcccaggagcctcactggggcagacaataaaccctcagagcctcgctctgtgtgctgcttcttgcggggaggcacagggccatgtgtgtaggaaacacacgaacagacgtgcacacacacagacgtgcacacacacacagacatgcacacacacacagacgtgcacacacacagacgtgcacgcactcacacggacatgcacacacatggcatgtactttattcacactggtctactgcagtccagaaaagccaccatt

SEQ ID NO: 106831 - DNA, 945 bp, Homo sapiens
  Payload ID: 980
  Gene Symbol: AOC1
  Gene Name: amine oxidase, copper containing 1
  ENST ID: ENST00000460213
  CDS Start-End: 199-945
gaatctggtcagggtctcaaagatcgttaaaaagccgccaaagtttgcaactcgtcttgagtggctgctcctcccaaacggttctgcctctggtgtcttgttctaggagcggttgaattctctgttttgctgtgggtgccagcctctatcagcccctgccctggtccatctgtcagcttcagagccgtggagcgagagatgccggccctgggctgggccgtggctgccatcctgatgctgcagacggccatggcggagccctccccggggactctgcccaggaaggcaggggtgttttcagacctaagcaaccaagagctgaaggcagtgcacagcttcctctggtccaagaaggagctgaggctgcagccctccagtaccaccaccatggccaagaacaccgtgtttctcatcgagatgctgctgcccaagaagtaccatgtgctgaggtttctggataaaggtgaaaggcatcctgtgcgggaagcccgtgccgtcatcttctttggtgaccaggagcatcccaatgtcaccgagtttgctgtggggcccctgccagggccctgctacatgcgagcactgtcccccaggcctgggtaccagtcctcctgggcatcgaggcccatctccacagcagagtatgccctcctctaccacaccctgcaggaagccaccaagcccctgcatcagttcttcctcaataccacaggcttctcattccaagactgccatgacagatgcctggccttcaccgatgtggccccccggggtgtggcttctggccagcgccgcagttggcttatcatacagcgctatgtagaaggctactttctgcaccccactgggctggagctcctcgtggatcatgggagcacagatgctgggcactgggccgtggagcaggtgtggtacaacgggaagttctatgggagcccagaggaactg

SEQ ID NO: 106832 - DNA, 3135 bp, Homo sapiens
  Payload ID: 980
  Gene Symbol: AOC1
  Gene Name: amine oxidase, copper containing 1
  Uniprot ID: P19801
  ENST ID: ENST00000493429
  CDS Start-End: 585-2840
gactgggaagacatgaccttacacaccttggttctttaacttgaccttgggaagacagggccagccagcaaggtggctggggagaaggccgaggtccccgggccgcagacgggaattgagggtcaggagccgaagtgaaactggagccggcgccacgagatgcagccctgaagggcacctccacccagtggccctcccccaccccactcccggggccctcctggcccagcgtcaccctgctgcgctaggacctacaagggcggcctctgggagccctctgctttacctcctctcctgggtcaggctgcagaaagaacaagctcctccaccctgcctgctttcaaatctgtacctgttgatgagagaacctccaggtttgtcccctactaccaatgatgaggcaaacacagagagaggaacccctttgactaaagctgaattgtaaaggactaaagccctaacttctcttcgaatgacctgcattcaaatcaagagcggttgaattctctgttttgctgtgggtgccagcctctatcagcccctgccctggtccatctgtcagcttcagagccgtggagcgagagatgccggccctgggctgggccgtggctgccatcctgatgctgcagacggccatggcggagccctccccggggactctgcccaggaaggcaggggtgttttcagacctaagcaaccaagagctgaaggcagtgcacagcttcctctggtccaagaaggagctgaggctgcagccctccagtaccaccaccatggccaagaacaccgtgtttctcatcgagatgctgctgcccaagaagtaccatgtgctgaggtttctggataaaggtgaaaggcatcctgtgcgggaagcccgtgccgtcatcttctttggtgaccaggagcatcccaatgtcaccgagtttgctgtggggcccctgccagggccctgctacatgcgagcactgtcccccaggcctgggtaccagtcctcctgggcatcgaggcccatctccacagcagagtatgccctcctctaccacaccctgcaggaagccaccaagcccctgcatcagttcttcctcaataccacaggcttctcattccaagactgccatgacagatgcctggccttcaccgatgtggccccccggggtgtggcttctggccagcgccgcagttggcttatcatacagcgctatgtagaaggctactttctgcaccccactgggctggagctcctcgtggatcatgggagcacagatgctgggcactgggccgtggagcaggtgtggtacaacgggaagttctatgggagcccagaggaactggctcggaagtatgcagatggagaggtggacgtggtggtcctggaggacccgctgcctgggggcaaggggcatgacagcacagaggagccgcccctcttctcctcccacaagccccgcggggacttccccagccccatccatgtgagcggcccccgcttggtccagccccacggccctcgcttcaggctggagggcaacgctgtgctctacggcggctggagctttgccttccggctgcgctcctcctccgggctgcaggtcctgaacgtgcacttcggcggagagcgcattgcctatgaggtcagcgtgcaagaggcagtggcgctgtatggaggacacacacctgcaggcatgcagaccaagtacctcgatgtcggctggggcctgggcagcgtcactcatgagttagcccccggcatcgactgcccggagaccgccaccttcctggacactttccactactatgatgccgatgacccggtccattatccccgagccctctgcctctttgaaatgcccacaggggtgccccttcggcggcactttaattccaactttaaaggtggcttcaacttctatgcggggctgaagggccaggtgctggtgctgcggacaacttcaactgtctacaattatgattacatttgggactttatcttctaccccaacggggtgatggaggccaagatgcatgccactggctacgtccacgccaccttctacacccccgaggggctgcgccacggcactcgcctgcacacccacctgattggcaacatacacactcacttggtgcactaccgcgtagacctggatgtggcaggcaccaagaacagcttccagacactgcagatgaagctagaaaacatcaccaacccctggagcccaagacaccgcgtggtccagccaactctggagcagacgcagtactcctgggagcgccaggcggccttccgcttcaaaaggaagctgcctaagtacctgctctttaccagcccccaggagaacccctggggccacaagcgcacgtaccgcctgcagatccactccatggccgaccaggtgctgcccccaggctggcaggaggagcaggccatcacctgggcaaggtaccccctggcagtgaccaagtaccgggagtcggagctgtgcagcagcagcatctaccaccagaacgacccctggcacccgcccgtggtctttgagcagtttcttcacaacaacgagaacattgaaaatgaggacctggtggcctgggtgacggtgggcttcctgcacatcccccactcagaggacattcccaacacagccacacctgggaactccgtgggcttcctgctccggccattcaacttcttcccagaggacccctccctggcatccagagacactgtgatcgtgtggcctcgggacaacggccccaactacgtccagcgctggatccctgaggacagggactgctcgatgcctcccccttttagctacaatgggacctatagacctgtgtgaccagcccccagttcctcccccagttcctcccaggaagcccaggagcctcactggggcagacaataaaccctcagagcctcgctctgtgtgctgcttcttgcggggaggcacagggccatgtgtgtaggaaacacacgaacagacgtgcacacacacagacgtgcacacacacacagacatgcacacacacacagacgtgcacacacacagacgtgcacgcactcacacggacatgcacacacatggcatgtactttattcacactggtctactgcagtccagaaaagccaccatt

SEQ ID NO: 106833 - DNA, 2435 bp, Homo sapiens
  Payload ID: 980
  Gene Symbol: AOC1
  Gene Name: amine oxidase, copper containing 1
  ENST ID: ENST00000622116
  CDS Start-End: 1521-2105
tctgattgacttcaagaaggagtcagagatcagcttaagggcaaaggctggaagcagagcgaactgggagcagagcacacagagccgtggagcgagagatgccggccctgggctgggccgtggctgccatcctgatgctgcagacggccatggcggagccctccccggggactctgcccaggaaggcaggggtgttttcagacctaagcaaccaagagctgaaggcagtgcacagcttcctctggtccaagaaggagctgaggctgcagccctccagtaccaccaccatggccaagaacaccgtgtttctcatcgagatgctgctgcccaagaagtaccatgtgctgaggtttctggataaaggtgaaaggcatcctgtgcgggaagcccgtgccgtcatcttctttggtgaccaggagcatcccaatgtcaccgagtttgctgtggggcccctgccagggccctgctacatgcgagcactgtcccccaggcctgggtaccagtcctcctgggcatcgaggcccatctccacagcagagtatgccctcctctaccacaccctgcaggaagccaccaagcccctgcatcagttcttcctcaataccacaggcttctcattccaagactgccatgacagatgcctggccttcaccgatgtggccccccggggtgtggcttctggccagcgccgcagttggcttatcatacagcgctatgtagaaggctactttctgcaccccactgggctggagctcctcgtggatcatgggagcacagatgctgggcactgggccgtggagcaggtgtggtacaacgggaagttctatgggagcccagaggaactggctcggaagtatgcagatggagaggtggacgtggtggtcctggaggacccgctgcctgggggcaaggggcatgacagcacagaggagccgcccctcttctcctcccacaagccccgcggggacttccccagccccatccatgtgagcggcccccgcttggtccagccccacggccctcgcttcaggctggagggcaacgctgtgctctacggcggctggagctttgccttccggctgcgctcctcctccgggctgcaggtcctgaacgtgcacttcggcggagagcgcattgcctatgaggtcagcgtgcaagaggcagtggcgctgtatggaggacacacacctgcaggcatgcagaccaagtacctcgatgtcggctggggcctgggcagcgtcactcatgagttagcccccggcatcgactgcccggagaccgccaccttcctggacactttccactactatgatgccgatgacccggtccattatccccgagccctctgcctctttgaaatgcccacaggggtgccccttcggcggcactttaattccaactttaaaggtggcttcaacttctatgcggggctgaagggccaggtgctggtgctgcggacaacttcaactgtctacaattatgattacatttgggactttatcttctaccccaacggggtgatggaggccaagatgcatgccactggctacgtccacgccaccttctacacccccgaggggctgcgccacggcactcgcctgcacacccacctgattggcaacatacacactcacttggtgcactaccgcgtagacctggatgtggcaggcaccaagaacagcttccagacactgcagatgaagctagaaaacatcaccaacccctggagcccaagacaccgcgtggtccagccaactctggagcagacgcagtactcctgggagcgccaggcggccttccgcttcaaaaggaagctgcctaagtacctgctctttaccagcccccaggagaacccctggggccacaagcgcacgtaccgcctgcagatccactccatggccgaccaggtgctgcccccaggctggcaggaggagcaggccatcacctgggcaaggtaccccctggcagtgaccaagtaccgggagtcggagctgtgcagcagcagcatctaccaccagaacgacccctggcacccgccgtggtctttgagcagtttcttcacaacaacgagaacattgaaaatgaggacctggtggcctgggtgacggtgggcttcctgcacatcccccactcagaggacattcccaacacagccacacctgggaactccgtgggcttcctgctccggccattcaacttcttcccagaggacccctccctggcatccagagacactgtgatcgtgtggcctcgggacaacggccccaactacgtccagcgctggatccctgaggacagggactgctcgatgcctcccccttttagctacaatgggacctatagacctgtgtgaccagcccccagttcctcccccagttcctcccaggaagcccaggagcctcactggggcagacaataaaccctcagagcctcgc

SEQ ID NO: 106834 - DNA, 2366 bp, Homo sapiens
  Payload ID: 980
  Gene Symbol: AOC1
  Gene Name: amine oxidase, copper containing 1
  ENST ID: ENST00000619575
  CDS Start-End: 41-2173
gcgaactgggagcagagcacacagagccgtggagcgagagatgccggccctgggctgggccgtggctgccatcctgatgctgcagacggccatggcggagccctccccggggactctgcccaggaaggcaggggtgttttcagacctaagcaaccaagagctgaaggcagtgcacagcttcctctggtccaagaaggagctgaggctgcagccctccagtaccaccaccatggccaagaacaccgtgtttctcatcgagatgctgctgcccaagaagtaccatgtgctgaggtttctggataaaggtgaaaggcatcctgtgcgggaagcccgtgccgtcatcttctttggtgaccaggagcatcccaatgtcaccgagtttgctgtggggcccctgccagggccctgctacatgcgagcactgtcccccaggcctgggtaccagtcctcctgggcatcgaggcccatctccacagcagagtatgccctcctctaccacaccctgcaggaagccaccaagcccctgcatcagttcttcctcaataccacaggcttctcattccaagactgccatgacagatgcctggccttcaccgatgtggccccccggggtgtggcttctggccagcgccgcagttggcttatcatacagcgctatgtagaaggctactttctgcaccccactgggctggagctcctcgtggatcatgggagcacagatgctgggcactgggccgtggagcaggtgtggtacaacgggaagttctatgggagcccagaggaactggctcggaagtatgcagatggagaggtggacgtggtggtcctggaggaccgctgcctgggggcaaggggcatgacagcacagaggagccgcccctcttctcctccacaagccccgcggggacttccccagccccatccatgtgagcggcccccgcttggtccagccccacggccctcgcttcaggctggagggcaacgctgtgctctacggcggctggagctttgccttccgctgcgctcctcctccgggctgcaggtcctgaacgtgcacttcggcggagagcgcattgcctatgaggtcagcgtgcaagaggcagtggcgctgtatggaggacacacacctgcaggcatgcagaccaagtacctcgatgtcggctggggcctgggcagcgtcactcatgagttagcccccggcatcgactgcccggagaccgccaccttcctggacactttccactactatgatgccgatgacccggtccattatccccgagccctctgcctctttgaaatgcccacaggggtgccccttcggcggcactttaattccaactttaaaggtggcttcaacttctatgcggggctgaagggccaggtgctggtgctgcggacaacttcaactgtctacaattatgattacatttgggactttatcttctaccccaacggggtgatggaggccaagatgcatgccactggctacgtccacgccaccttctacacccccgagggctgcgcccggcactcgcctgcacacccacctgattggcaacatacacactcacttgtgcactaccgcgtagacctggatgtggcaggcaccaagaacagcttccagacactgcagatgaagctagaaaacatcaccaacccctggagcccaagacaccgcgtggtccagccaactctggagcagacgcagtactcctgggagcgccaggcggccttccgcttcaaaaggaagctgcctaagtacctgctctttaccagcccccaggagaacccctggggccacaagcgcacgtaccgcctgcagatccactccatggccgaccaggtgctgcccccaggctggcaggaggagcaggccatcacctgggcaaggtaccccctggcagtgaccaagtaccgggagtcggagctgtgcagcagcagcatctaccaccagaacgacccctggcacccgcccgtggtctttgagcagtttcttcacaacaacgagaacattgaaaatgaggacctggtggcctgggtgacggtgggcttcctgcacatcccccactcagaggacattcccaacacagccacacctgggaactccgtgggcttcctgctccggccattcaacttcttcccagaggacccctggcatccagagacactgtgatcgtgtggcctcgggacaacggccccaactacgtccagcgctggatccctgaggacagggactgctcgatgcctcccccttttagctacaatgggacctatagacctgtgtgaccagcccccagttcctcccccagttcctcccaggaagcccaggagcctcactggggcagacaataaaccctcagagcctc

SEQ ID NO: 106835 - DNA, 2657 bp, Homo sapiens
  Payload ID: 981
  Gene Symbol: AOC2
  Gene Name: amine oxidase, copper containing 2 (retina-specific)
  Uniprot ID: O75106
  ENST ID: ENST00000253799
  CDS Start-End: 28-2298
ttctgatttcagctctcagcatccaccatgcatctcaagatagtcctggcgttcctggcactgtccctcattaccatctttgccctggcctatgttttgctgaccagcccaggtggttccagccagcctccccactgcccctctgtatcccatagggcccagccctggccacaccctggccagagccagctgtttgcagacctgagccgagaggagttgacagctgtgatgcgctttctgacccagcggctggggccagggctggtggacgcagcccaggctcagccctcggacaactgcatcttctcagtggagctgcagctgccccccaaggctgcagccctggcccacctggacagggggagccccccacctgcccgggaggcactggccatcgtcctctttggtggacaaccccaacccaatgtgagtgagctggtggtggggccgctgcctcacccctcgtacatgcgggatgtgactgtggagcgtcacggcgggcccctgccctatcaccgtcgcccggtgctgagagctgagtttacacagatgtggaggcatctgaaagaggtggagctacccaaggcacccatcttcctgtcgtccaccttcaactacaatggctctaccctggcagctgtgcatgccacccctcggggcttgcgctcaggggaccgagctacctggatggccctctaccataacatctcaggggttggtcttttccttcaccccgtggggctggagctactactggaccacagggccctggaccctgcccactggactgtccagcaggtcttctaccttgggcactactatgcagacttgggccagttggaacgggagtttaagtctggccggttggaagtggttagagtccctctacctccaccaaatggagcttcatccctgaggtctcggaactctccaggtcctcttccccctcttcagttctcgccccagggttcccagtacagtgtgcaaggaaacctggtggtatcctccctctggtcatttacctttggccatggggtgttcagcggcctgaggatttttgatgttcggttccagggtgagcgaatagcctatgaagtcagtgtccaggagtgtgtatctatctatggtgccgattcacccaagacgatgctgactcgctatttggatagcagctttggactcggccgtaacagccgaggcttggtgcggggagtggactgcccctatcaagccacgatggtggacatccatatattagtgggcaaaggggcagtccagctgcttccaggggctgtgtgtgtatttgaggaagcccagggactgccccttcgaaggcaccacaattaccttcaaaatcatttctatggtggtttggccagctcagcccttgtggtcaggtctgtgtcatctgtgggcaactatgactacatttgggactttgtgttgtacccaaatggggcacttgaagggcgggtccatgccacgggttatatcaacacagctttcctgaaagggggagaggagggcctcctctttgggaaccgtgtgggggaaagagtgctgggaacggtgcacacacatgccttccacttcaagctggacctggatgtggcagggctgaaaaactgggtggtagctgaagacgtggtgtttaaacctgtggctgccccctggaacccggagcactggctacagcgcccacagctgactcggcaggtcctgggaaaggaggacctgacagctttttccttgggaagccccctaccccgctacctctacctggctagcaaccagactaatgcgtggggtcaccagcgcgggtaccgaatccagatccacagcccccttggcatacacatacccctggagagtgacatggagagggccctcagctgggggagataccagcttgtggtgacccagagaaaggaggaggagtcacagagcagtagcatctatcaccagaatgacatctggacacccacagttacctttgctgacttcatcaacaatgaaaccctcttaggagaggatctggtggcttgggtcacagccagcttcctgcacattccccatgccgaggacatcccaaacacagtgactctggggaacagagttggcttcttgctccgaccctataacttctttgatgaggacccctccatcttctcccctggcagtgtctactttgagaagggccaggatgctgggctctgcagcatcaatcctgtggcctgcctccccgacctggcagcctgtgtcccggacttaccccctttctcttaccacggcttctagtcctgagggtgtggcgggcggcgtggttaggcacatgtacttttccctgtttctactttctattctccgtgtttttatcacacctgctccccagattcccaccccctcaatgttcctctcacacgaaacccccatcagtccctttggttaattcttacttcctgttcatctctaaagtgttaaattataaaaatgatttttaaatattcaaagaaaaatatcacaaatcctactactcagaaataggtggtcacattacatcagacatctctttatgcatgtgcattcaaaaggaagagtagatagaattttgtaaaacagatgttgtatgtaatttataataaaaagtattagaggaa

SEQ ID NO: 106836 - DNA, 2572 bp, Homo sapiens
  Payload ID: 981
  Gene Symbol: AOC2
  Gene Name: amine oxidase, copper containing 2 (retina-specific)
  Uniprot ID: O75106
  ENST ID: ENST00000452774
  CDS Start-End: 27-2216
tctgatttcagctctcagcatccaccatgcatctcaagatagtcctggcgttcctggcactgtccctcattaccatctttgccctggcctatgttttgctgaccagcccaggtggttccagccagcctccccactgcccctctgtatcccatagggcccagccctggccacaccctggccagagccagctgtttgcagacctgagccgagaggagttgacagctgtgatgcgctttctgacccagcggctggggccagggctggtggacgcagcccaggctcagccctcggacaactgcatcttctcagtggagctgcagctgccccccaaggctgcagccctggcccacctggacagggggagccccccacctgcccgggaggcactggccatcgtcctctttggtggacaaccccaacccaatgtgagtgagctggtggtggggccgctgcctcacccctcgtacatgcgggatgtgactgtggagcgtcacggcgggcccctgccctatcaccgtcgcccggtgctgagagctgagtttacacagatgtggaggcatctgaaagaggtggagctacccaaggcacccatcttcctgtcgtccaccttcaactacaatggctctaccctggcagctgtgcatgccacccctcggggcttgcgctcaggggaccgagctacctggatggccctctaccataacatctcaggggttggtcttttccttcaccccgtggggctggagctactactggaccacagggccctggaccctgcccactggactgtccagcaggtcttctaccttgggcactactatgcagacttgggccagttggaacgggagtttaagtctggccggttggaagtggttagagtccctctacctccaccaaatggagcttcatccctgaggtctcggaactctccaggtcctcttccccctcttcagttctcgccccagggttcccagtacagtgtgcaaggaaacctggtggtatcctccctctggtcatttacctttggccatggggtgttcagcggcctgaggatttttgatgttcggttccagggtgagcgaatagcctatgaagtcagtgtccaggagtgtgtatctatctatggtgccgattcacccaagacgatgctgactcgctatttggatagcagctttggactcggccgtaacagccgaggcttggtgcggggagtggactgcccctatcaagccacgatggtggacatccatatattagtgggcaaaggggcagtccagctgcttccaggggctgtgtgtgtatttgaggaagcccagggactgccccttcgaaggcaccacaattaccttcaaaatcatttctatggtggtttggccagctcagcccttgtggtcaggtctgtgtcatctgtgggcaactatgactacatttgggactttgtgttgtacccaaatggggcacttgaagggcgggtccatgccacgggttatatcaacacagctttcctgaaagggggagaggagggcctcctctttgggaaccgtgtgggggaaagagtgctgggaacggtgcacacacatgccttccacttcaagctggacctggatgtggcagggctgaaaaactgggtggtagctgaagacgtggtgtttaaacctgtggctgccccctggaacccggagcactggctacagcgcccacagctgactcggcaggtcctgggaaaggaggacctgacagctttttccttgggaagccccctaccccgctacctctacctggctagcaaccagactaatgcgtggggtcaccagcgcggataccagcttgtggtgacccagagaaaggaggaggagtcacagagcagtagcatctatcaccagaatgacatctggacacccacagttacctttgctgacttcatcaacaatgaaaccctcttaggagaggatctggtggcttgggtcacagccagcttcctgcacattccccatgccgaggacatcccaaacacagtgactctggggaacagagttggcttcttgctccgaccctataacttctttgatgaggacccctccatcttctcccctggcagtgtctactttgagaagggccaggatgctgggctctgcagcatcaatcctgtggcctgcctccccgacctggcagcctgtgtcccggacttaccccctttctcttaccacggcttctagtcctgagggtgtggcgggcggcgtggttaggcacatgtacttttccctgtttctactttctattctccgtgtttttatcacacctgctccccagattcccaccccctcaatgttcctctcacacgaaacccccatcagtccctttggttaattcttacttcctgttcatctctaaagtgttaaattataaaaatgatttttaaatattcaaagaaaaatatcacaaatcctactactcagaaataggtggtcacattacatcagacatctctttatgcatgtgcattcaaaaggaagagtagatagaattttgtaaaacagatgttgtatgtaatttataataaaaagtattagag

SEQ ID NO: 106837 - DNA, 4026 bp, Homo sapiens
  Payload ID: 982
  Gene Symbol: AOC3
  Gene Name: amine oxidase, copper containing 3
  Uniprot ID: Q16853
  ENST ID: ENST00000308423
  CDS Start-End: 161-2452
gtccttcccacccttagtcccaggcatctgactaccgggaacctcagccagagtccgggagccccccaccccgtccaggagccaacagagcccccgtcttgctggcgtgagaatacattgctctcctttggttgaatcagctgtccctcttcgtgggaaaatgaaccagaagacaatcctcgtgctcctcattctggccgtcatcaccatctttgccttggtttgtgtcctgctggtgggcaggggtggagatgggggtgaacccagccagcttccccattgcccctctgtatctcccagtgcccagccttggacacaccctggccagagccagctgtttgcagacctgagccgagaggagctgacggctgtgatgcgctttctgacccagcggctggggccagggctggtggatgcagcccaggcccggccctcggacaactgtgtcttctcagtggagttgcagctgcctcccaaggctgcagccctggctcacttggacagggggagccccccacctgcccgggaggcactggccatcgtcttctttggcaggcaaccccagcccaacgtgagtgagctggtggtggggccactgcctcacccctcctacatgcgggacgtgactgtggagcgtcatggaggccccctgccctatcaccgacgccccgtgctgttccaagagtacctggacatagaccagatgatcttcaacagagagctgccccaggcttctgggcttctccaccactgttgcttctacaagcaccggggacggaacctggtgacaatgaccacggctccccgtggtctgcaatcaggggaccgggccacctggtttggcctctactacaacatctcgggcgctgggttcttcctgcaccacgtgggcttggagctgctagtgaaccacaaggcccttgaccctgcccgctggactatccagaaggtgttctatcaaggccgctactacgacagcctggcccagctggaggcccagtttgaggccggcctggtgaatgtggtgctgatcccagacaatggcacaggtgggtcctggtccctgaagtcccctgtgcccccgggtccagctccccctctacagttctatccccaaggcccccgcttcagtgtccagggaagtcgagtggcctcctcactgtggactttctcctttggcctcggagcattcagtggcccaaggatctttgacgttcgcttccaaggagaaagactagtttatgagataagcctccaagaggccttggccatctatggtggaaattccccagcagcaatgacgacccgctatgtggatggaggctttggcatgggcaagtacaccacgcccctgacccgtggggtggactgcccctacttggccacctacgtggactggcacttccttttggagtcccaggcccccaagacaatacgtgatgccttttgtgtgtttgaacagaaccagggcctccccctgcggcgacaccactcagatctctactcgcactactttgggggtcttgcggaaacggtgctggtcgtcagatctatgtccaccttgctcaactatgactatgtgtgggatacggtcttccaccccagtggggccatagaaatacgattctatgccacgggctacatcagctcggcattcctctttggtgctactgggaagtacgggaaccaagtgtcagagcacaccctgggcacggtccacacccacagcgcccacttcaaggtggatctggatgtagcaggactggagaactgggtctgggccgaggatatggtctttgtccccatggctgtgccctggagccctgagcaccagctgcagaggctgcaggtgacccggaagctgctggagatggaggagcaggccgccttcctcgtgggaagcgccacccctcgctacctgtacctggccagcaaccacagcaacaagtggggtcacccccggggctaccgcatccagatgctcagctttgctggagagccgctgccccaaaacagctccatggcgagaggcttcagctgggagaggtaccagctggctgtgacccagcggaaggaggaggagcccagtagcagcagcgttttcaatcagaatgacccttgggcccccactgtggatttcagtgacttcatcaacaatgagaccattgctggaaaggatttggtggcctgggtgacagctggttttctgcatatcccacatgcagaggacattcctaacacagtgactgtggggaacggcgtgggcttcttcctccgaccctataacttctttgacgaagacccctccttctactctgccgactccatctacttccgaggggaccaggatgctggggcctgcgaggtcaaccccctagcttgcctgccccaggctgctgcctgtgcccccgacctccctgccttctcccacgggggcttctctcacaactaggcggtcctgggatggggcatgtggccaagggctccagggccagggtgtgagggatggggagcagctgggcactgggccggcagcctggttccctctttcctgtgccaggactctctttcttccactaccctccctcgcatccgcctctgagccaggagcctcctgaccctgtgatgcctgacacaggggacactgaaccttgttgatgccagctgtactgagttctcatccacagaggccaggcatggcccagcctggagccgtggccgagggcttccctagatggttccctttgttgctgtctggctttcccgaatctttttaggccacctccaaggactctaaaagggggctattccctggagaccccagagtagggttgccagtcctgcaagtccatagctgagctggaaaggatgcttctgctcacattccctctcatccaggtcctttccttctcgtcttcctctctctcacctacttcctcctcctcctcctgttcctgccttctcttctatcctgcaatttctcccgaatcctgaggggatatccctatgtcccagcccctggtactcccccagccctcagttttcagtcaagttccgtctcctctccagccctatggaagtctcaaggtcacgggacccctaatcagagtggccaatccctgtgtgtcgttcccttgtgtctgttgcttattgggagtaggagttgctcctacccctgtcctggggctgggtgtgtttcaggacagctgcttctgtgcatttgtgtctgcctgcctcatgctctctatagaggaggatggtcatcgtgacagcagcagctcaagttagcatttcaagtgatttgggggtgcaatgataatgaagaatggccattttgtaccagggctctgtattctgcaacagcctgtttgggaggctggagtggaaacaaagggtgggcatcaaagatgagaagccaaagcccctacaactccagccacccagccaggaggggctgtccaatcacattcaggcatgcgaatgagctgggccctgggtgaggtgggggtctggcctagtggggaggggcctggcctgggtggggcagggcctggcctggtccaggcttgggctccattcccatcactgctgtccctcctgaggtctggattggggatggggacaaagaaatagcaagagatgagaaacaacagaaacttttttctctaaaggactggttaaatcaattctgatacagccttacaatacaatagtatgcagctaaaaaataattgtatgtctttatatactaatatgtaataatcttcaggtgaaaaaggcaagccacagaaatgtgtatagcgcacttcccatttgtgtttcagaaaggagtagaatataaacacataattgcttatgtatgcctattcagaataaatgggtaacactgattacttttgggaggggaaccagtaggttgaggacaggagagggaagggtcttaacacttacacccttttgtacattttgaattttgaaccatgtgactgtattacctattcaaaataaacaataaatgggcccaaa

SEQ ID NO: 106838 - DNA, 545 bp, Homo sapiens
  Payload ID: 982
  Gene Symbol: AOC3
  Gene Name: amine oxidase, copper containing 3
  ENST ID: ENST00000587330
  CDS Start-End: 1-433
ctatgactatgtgtgggatacggtcttccaccccagtggggccatagaaatacgattctatgccacgggctacatcagctcggcattcctctttggtgctactgggaagtacgggaaccaagtgtcagagcacaccctgggcacggtccacacccacagcgcccacttcaaggtggatctggatgtagcaggtgacccggaagctgctggagatggaggagcaggccgccttcctcgtgggaagcgccacccctcgctacctgtacctggccagcaaccacagcaacaagtggggtcacccccggggctaccgcatccagatgctcagctttgctggagagccgctgccccaaaacagctccatggcgagaggcttcagctgggagaggtaccagctggctgtgacccagcggaaggaggaggagcccagtagcagcagcgttttcaatcagaatgacccttgggcccccactgtggatttcagtgacttcatcaacaatgagaccattgctggaaaggatttggtggcctgggtgacagctggt

SEQ ID NO: 106839 - DNA, 573 bp, Homo sapiens
  Payload ID: 982
  Gene Symbol: AOC3
  Gene Name: amine oxidase, copper containing 3
  ENST ID: ENST00000592999
  CDS Start-End: 118-573
tgtttgtcagctcagttctgtgtctggcctgtggtggtggtgttttggaggatctctttgcattctaccacgtccctggcatgtgcaggactggagaactgggtctgggccgaggatatggtctttgtccccatggctgtgccctggagccctgagcaccagctgcagaggctgcaggtgacccggaagctgctggagatggaggagcaggccgccttcctcgtgggaagcgccacccctcgctacctgtacctggccagcaaccacagcaacaagtggggtcacccccggggctaccgcatccagatgctcagctttgctggagagccgctgccccaaaacagctccatggcgagaggcttcagctgggagaggtaccagctggctgtgacccagcggaaggaggaggagcccagtagcagcagcgttttcaatcagaatgacccttgggcccccactgtggatttcagtgacttcatcaacaatgagaccattgctggaaaggatttggtggcctgggtgacagctggttttctgcatatcccacatgcagaggacattcctaacacagtg

SEQ ID NO: 106840 - DNA, 542 bp, Homo sapiens
  Payload ID: 982
  Gene Symbol: AOC3
  Gene Name: amine oxidase, copper containing 3
  ENST ID: ENST00000588033
  CDS Start-End: 207-542
gtttgtctgtctgcgtggaaagcaagagggtaaggatgatcattcatctctatccccagggacgagtacagtcctctctgctaatgaatgttgaaagaatgaatgagtgaaatggaatgaactccctgatgaagtattttaatttacaggtcaacagctttggctaaaggattggaggactggagaactgggtctgggccgaggatatggtctttgtccccatggctgtgccctggagccctgagcaccagctgcagaggctgcaggtgacccggaagctgctggagatggaggagcaggccgccttcctcgtgggaagcgccacccctcgctacctgtacctggccagcaaccacagcaacaagtggggtcacccccggggctaccgcatccagatgctcagctttgctggagagccgctgccccaaaacagctccatggcgagaggcttcagctgggagaggtaccagctggctgtgacccagcggaaggaggaggagcccagtagcagcagcgttttcaatcagaatgacccttgggcc

SEQ ID NO: 106841 - DNA, 2522 bp, Homo sapiens
  Payload ID: 982
  Gene Symbol: AOC3
  Gene Name: amine oxidase, copper containing 3
  Uniprot ID: Q16853
  ENST ID: ENST00000591562
  CDS Start-End: 280-942
ccggaagttgcctaggccatgctcctctcacaggacaggccagtcagtggtttgtctgtctgcgtggaaagcaagagggtcaacagctttggctaaaggattggaggtatcctggggagagggaagagaaggaggggcacactcagttctgggctgctctttggcccccactctgaagccagatgggggcagagtccagaggggccagggcagttgcctgacaggccctcccctatcccaccctgagcaggactggagaactgggtctgggccgaggatatggtctttgtccccatggctgtgccctggagccctgagcaccagctgcagaggctgcaggtgacccggaagctgctggagatggaggagcaggccgccttcctcgtgggaagcgccacccctcgctacctgtacctggccagcaaccacagcaacaagtggggtcacccccggggctaccgcatccagatgctcagctttgctggagagccgctgccccaaaacagctccatggcgagaggcttcagctgggagaggtaccagctggctgtgacccagcggaaggaggaggagcccagtagcagcagcgttttcaatcagaatgacccttgggcccccactgtggatttcagtgacttcatcaacaatgagaccattgctggaaaggatttggtggcctgggtgacagctggttttctgcatatcccacatgcagaggacattcctaacacagtgactgtggggaacggcgtgggcttcttcctccgaccctataacttctttgacgaagacccctccttctactctgccgactccatctacttccgaggggaccaggatgctggggcctgcgaggtcaaccccctagcttgcctgccccaggctgctgcctgtgcccccgacctccctgccttctcccacgggggcttctctcacaactaggcggtcctgggatggggcatgtggccaagggctccagggccagggtgtgagggatggggagcagctgggcactgggccggcagcctggttccctctttcctgtgccaggactctctttcttccactaccctccctcgcatccgcctctgagccaggagcctcctgaccctgtgatgcctgacacaggggacactgaaccttgttgatgccagctgtactgagttctcatccacagaggccaggcatggcccagcctggagccgtggccgagggcttccctagatggttccctttgttgctgtctggctttcccgaatctttttaggccacctccaaggactctaaaagggggctattccctggagaccccagagtagggttgccagtcctgcaagtccatagctgagctggaaaggatgcttctgctcacattccctctcatccaggtcctttccttctcgtcttcctctctctcacctacttcctcctcctcctcctgttcctgccttctcttctatcctgcaatttctcccgaatcctgaggggatatccctatgtcccagcccctggtactcccccagccctcagttttcagtcaagttccgtctcctctccagccctatggaagtctcaaggtcacgggacccctaatcagagtggccaatccctgtgtgtcgttcccttgtgtctgttgcttattgggagtaggagttgctcctacccctgtcctggggctgggtgtgtttcaggacagctgcttctgtgcatttgtgtctgcctgcctcatgctctctatagaggaggatggtcatcgtgacagcagcagctcaagttagcatttcaagtgatttgggggtgcaatgataatgaagaatggccattttgtaccagggctctgtattctgcaacagcctgtttgggaggctggagtggaaacaaagggtgggcatcaaagatgagaagccaaagcccctacaactccagccacccagccaggaggggctgtccaatcacattcaggcatgcgaatgagctgggccctgggtgaggtgggggtctggcctagtggggaggggcctggcctgggtggggcagggcctggcctggtccaggcttgggctccattcccatcactgctgtccctcctgaggtctggattggggatggggacaaagaaatagcaagagatgagaaacaacagaaacttttttctctaaaggactggttaaatcaattctgatacagccttacaatacaatagtatgcagctaaaaaataattgtatgtctttatatactaatatgtaataatcttcaggtgaaaaaggcaagccacagaaatgtgtatagcgcacttcccatttgtgtttcagaaaggagtagaatataaacacataattgcttatgtatgcctattcagaataaatgggtaacactgattacttttgggaggggaaccagtaggttgaggacaggagagggaagggtcttaacacttacacccttttgtacattttgaattttgaaccatgtgactgtattacctattcaaaataaacaataaatgggcccaaacaggaa

SEQ ID NO: 106842 - DNA, 2392 bp, Homo sapiens
  Payload ID: 982
  Gene Symbol: AOC3
  Gene Name: amine oxidase, copper containing 3
  Uniprot ID: Q16853
  ENST ID: ENST00000617500
  CDS Start-End: 152-814
acttatatgggctctgctgctgggagcagccttctgtttgtcagctcagttctgtgtctggcctgtggtggtggtgttttggaggatctctttgcattctaccacgtccctggcatgtgcaggactggagaactgggtctgggccgaggatatggtctttgtccccatggctgtgccctggagccctgagcaccagctgcagaggctgcaggtgacccggaagctgctggagatggaggagcaggccgccttcctcgtgggaagcgccacccctcgctacctgtacctggccagcaaccacagcaacaagtggggtcacccccggggctaccgcatccagatgctcagctttgctggagagccgctgccccaaaacagctccatggcgagaggcttcagctgggagaggtaccagctggctgtgacccagcggaaggaggaggagcccagtagcagcagcgttttcaatcagaatgacccttgggcccccactgtggatttcagtgacttcatcaacaatgagaccattgctggaaaggatttggtggcctgggtgacagctggttttctgcatatcccacatgcagaggacattcctaacacagtgactgtggggaacggcgtgggcttcttcctccgaccctataacttctttgacgaagacccctccttctactctgccgactccatctacttccgaggggaccaggatgctggggcctgcgaggtcaaccccctagcttgcctgccccaggctgctgcctgtgcccccgacctccctgccttctcccacgggggcttctctcacaactaggcggtcctgggatggggcatgtggccaagggctccagggccagggtgtgagggatggggagcagctgggcactgggccggcagcctggttccctctttcctgtgccaggactctctttcttccactaccctccctcgcatccgcctctgagccaggagcctcctgaccctgtgatgcctgacacaggggacactgaaccttgttgatgccagctgtactgagttctcatccacagaggccaggcatggcccagcctggagccgtggccgagggcttccctagatggttccctttgttgctgtctggctttcccgaatctttttaggccacctccaaggactctaaaagggggctattccctggagaccccagagtagggttgccagtcctgcaagtccatagctgagctggaaaggatgcttctgctcacattccctctcatccaggtcctttccttctcgtcttcctctctctcacctacttcctcctcctcctcctgttcctgccttctcttctatcctgcaatttctcccgaatcctgaggggatatccctatgtcccagcccctggtactcccccagccctcagttttcagtcaagttccgtctcctctccagccctatggaagtctcaaggtcacgggacccctaatcagagtggccaatccctgtgtgtcgttcccttgtgtctgttgcttattgggagtaggagttgctcctacccctgtcctggggctgggtgtgtttcaggacagctgcttctgtgcatttgtgtctgcctgcctcatgctctctatagaggaggatggtcatcgtgacagcagcagctcaagttagcatttcaagtgatttgggggtgcaatgataatgaagaatggccattttgtaccagggctctgtattctgcaacagcctgtttgggaggctggagtggaaacaaagggtgggcatcaaagatgagaagccaaagcccctacaactccagccacccagccaggaggggctgtccaatcacattcaggcatgcgaatgagctgggccctgggtgaggtgggggtctggcctagtggggaggggcctggcctgggtggggcagggcctggcctggtccaggcttgggctccattcccatcactgctgtccctcctgaggtctggattggggatggggacaaagaaatagcaagagatgagaaacaacagaaacttttttctctaaaggactggttaaatcaattctgatacagccttacaatacaatagtatgcagctaaaaaataattgtatgtctttatatactaatatgtaataatcttcaggtgaaaaaggcaagccacagaaatgtgtatagcgcacttcccatttgtgtttcagaaaggagtagaatataaacacataattgcttatgtatgcctattcagaataaatgggtaacactgattacttttgggaggggaaccagtaggttgaggacaggagagggaagggtcttaacacttacacccttttgtacattttgaattttgaaccatgtgactgtattacctattcaaaataaacaataaatgggcccaaacagg

SEQ ID NO: 106843 - DNA, 3900 bp, Homo sapiens
  Payload ID: 982
  Gene Symbol: AOC3
  Gene Name: amine oxidase, copper containing 3
  Uniprot ID: Q16853
  ENST ID: ENST00000613571
  CDS Start-End: 161-2065
gtccttcccacccttagtcccaggcatctgactaccgggaacctcagccagagtccgggagccccccaccccgtccaggagccaacagagcccccgtcttgctggcgtgagaatacattgctctcctttggttgaatcagctgtccctcttcgtgggaaaatgaaccagaagacaatcctcgtgctcctcattctggccgtcatcaccatctttgccttggtttgtgtcctgctggtgggcaggggtggagatgggggtgaacccagccagcttccccattgcccctctgtatctcccagtgcccagccttggacacaccctggccagagccagctgtttgcagacctgagccgagaggagctgacggctgtgatgcgctttctgacccagcggctggggccagggctggtggatgcagcccaggcccggccctcggacaactgtgtcttctcagtggagttgcagctgcctcccaaggctgcagccctggctcacttggacagggggagccccccacctgcccgggaggcactggccatcgtcttctttggcaggcaaccccagcccaacgtgagtgagctggtggtggggccactgcctcacccctcctacatgcgggacgtgactgtggagcgtcatggaggccccctgccctatcaccgacgccccgtgctgttccaagagtacctggacatagaccagatgatcttcaacagagagctgccccaggcttctgggcttctccaccactgttgcttctacaagcaccggggacggaacctggtgacaatgaccacggctccccgtggtctgcaatcaggggaccgggccacctggtttggcctctactacaacatctcgggcgctgggttcttcctgcaccacgtgggcttggagctgctagtgaaccacaaggcccttgaccctgcccgctggactatccagaaggtgttctatcaaggccgctactacgacagcctggcccagctggaggcccagtttgaggccggcctggtgaatgtggtgctgatcccagacaatggcacaggtgggtcctggtccctgaagtcccctgtgcccccgggtccagctccccctctacagttctatccccaaggcccccgcttcagtgtccagggaagtcgagtggcctcctcactgtggactttctcctttggcctcggagcattcagtggcccaaggatctttgacgttcgcttccaaggagaaagactagtttatgagataagcctccaagaggccttggccatctatggtggaaattccccagcagcaatgacgacccgctatgtggatggaggctttggcatgggcaagtacaccacgcccctgacccgtggggtggactgcccctacttggccacctacgtggactggcacttccttttggagtcccaggcccccaagacaatacgtgatgccttttgtgtgtttgaacagaaccagggcctccccctgcggcgacaccactcagatctctactcgcactactttgggggtcttgcggaaacggtgctggtcgtcagatctatgtccaccttgctcaactatgactatgtgtgggatacggtcttccaccccagtggggccatagaaatacgattctatgccacgggctacatcagctcggcattcctctttggtgctactgggaagtacgggaaccaagtgtcagagcacaccctgggcacggtccacacccacagcgcccacttcaaggtggatctggatgtagcaggactggagaactgggtctgggccgaggatatggtctttgtccccatggctgtgccctggagccctgagcaccagctgcagaggctgcaggtgacccggaagctgctggagatggaggagcaggccgccttcctcgtgggaagcgccacccctcgctacctgtacctggccagcaaccacagcaacaagtggggtcacccccggggctaccgcatccagatgctcagctttgctggagagccgctgccccaaaacagctccatggcgagaggcttcagctgggagaggatttggtggcctgggtgacagctggttttctgcatatcccacatgcagaggacattcctaacacagtgactgtggggaacggcgtgggcttcttcctccgaccctataacttctttgacgaagacccctccttctactctgccgactccatctacttccgaggggaccaggatgctggggcctgcgaggtcaaccccctagcttgcctgccccaggctgctgcctgtgcccccgacctccctgccttctcccacgggggcttctctcacaactaggcggtcctgggatggggcatgtggccaagggctccagggccagggtgtgagggatggggagcagctgggcactgggccggcagcctggttccctctttcctgtgccaggactctctttcttccactaccctccctcgcatccgcctctgagccaggagcctcctgaccctgtgatgcctgacacaggggacactgaaccttgttgatgccagctgtactgagttctcatccacagaggccaggcatggcccagcctggagccgtggccgagggcttccctagatggttccctttgttgctgtctggctttcccgaatctttttaggccacctccaaggactctaaaagggggctattccctggagaccccagagtagggttgccagtcctgcaagtccatagctgagctggaaaggatgcttctgctcacattccctctcatccaggtcctttccttctcgtcttcctctctctcacctacttcctcctcctcctcctgttcctgccttctcttctatcctgcaatttctcccgaatcctgaggggatatccctatgtcccagcccctggtactcccccagccctcagttttcagtcaagttccgtctcctctccagccctatggaagtctcaaggtcacgggacccctaatcagagtggccaatccctgtgtgtcgttcccttgtgtctgttgcttattgggagtaggagttgctcctacccctgtcctggggctgggtgtgtttcaggacagctgcttctgtgcatttgtgtctgcctgcctcatgctctctatagaggaggatggtcatcgtgacagcagcagctcaagttagcatttcaagtgatttgggggtgcaatgataatgaagaatggccattttgtaccagggctctgtattctgcaacagcctgtttgggaggctggagtggaaacaaagggtgggcatcaaagatgagaagccaaagcccctacaactccagccacccagccaggaggggctgtccaatcacattcaggcatgcgaatgagctgggccctgggtgaggtgggggtctggcctagtggggaggggcctggcctgggtggggcagggcctggcctggtccaggcttgggctccattcccatcactgctgtccctcctgaggtctggattggggatggggacaaagaaatagcaagagatgagaaacaacagaaacttttttctctaaaggactggttaaatcaattctgatacagccttacaatacaatagtatgcagctaaaaaataattgtatgtctttatatactaatatgtaataatcttcaggtgaaaaaggcaagccacagaaatgtgtatagcgcacttcccatttgtgtttcagaaaggagtagaatataaacacataattgcttatgtatgcctattcagaataaatgggtaacactgattacttttgggaggggaaccagtaggttgaggacaggagagggaagggtcttaacacttacacccttttgtacattttgaattttgaaccatgtgactgtattacctattcaaaataaacaataaatgggcccaaacagg

SEQ ID NO: 106844 - DNA, 2412 bp, Homo sapiens
  Payload ID: 983
  Gene Symbol: AIMP1
  Gene Name: aminoacyl tRNA synthetase complex-interacting multifunctional protein 1
  Uniprot ID: Q12904
  ENST ID: ENST00000358008
  CDS Start-End: 675-1613
agtgacagagcgattactaagcctacggttcccaaacgactcaggtgaacctgatttacaggaaaggcgggctgtagctagggatggagacagtacctatcagcaagcggctccacagctcggttctctatctattctgaagacatgcggggccactcactgctcctgatagtcctctacctcccacagaccccacccactacgacacggaaaactggattacccaaatacctgcctctgagtctggggacgcaggcaagcacaaagacaagggggatggagcttctacacagggccccagcgctgtcgctgtggctgctgctgccgctacggcttagtgcaccagacgctgcatttcaggtgctcctacaaaagaggccactcctggaacgccgggagctcagacgctgccctttgctcgcgagccaagtcagccaaggttaaccttcgcggaacccggcgaggagcgcaagcctggccttccccaaacacagatccgagcttttcaccctctaccctcccctcagcctggccttttcttccgccctcacagccaccgcgacccaacgctgaggaaagaccccgacttgtggtgtccttccccttgcccaaactggccacgaaaggacatatagcgagagagaaagaggattttctgccgtctcttggcaaaaatggcaaataatgatgctgttctgaagagactggagcagaagggtgcagaggcagatcaaatcattgaatatcttaagcagcaagtttctctacttaaggagaaagcaattttgcaggcaactttgagggaagagaagaaacttcgagttgaaaatgctaaactgaagaaagaaattgaagaactgaaacaagagctaattcaggcagaaattcaaaatggagtgaagcaaataccatttccatctggtactccactgcacgctaattctatggtttctgaaaatgtgatacagtctacagcagtaacaaccgtatcttctggtaccaaagaacagataaaaggaggaacaggagacgaaaagaaagcgaaagagaaaattgaaaagaaaggagagaagaaggagaaaaaacagcaatcaatagctggaagtgccgactctaagccaatagatgtttcccgtctggatcttcgaattggttgcatcataactgctagaaaacaccctgatgcagattctttgtatgtggaagaagtagatgtcggagaaatagccccaaggacagttgtcagtggcctggtgaatcatgttcctcttgaacagatgcaaaatcggatggtgattttactttgtaacctgaaacctgcaaagatgaggggagtattatctcaagcaatggtcatgtgtgctagttcaccagagaaaattgaaatcttggctcctccaaatgggtctgttcctggagacagaattacttttgatgctttcccaggagagcctgacaaggagctgaatcctaagaagaagatttgggagcagatccagcctgatcttcacactaatgatgagtgtgtggctacatacaaaggagttccctttgaggtgaaagggaagggagtatgtagggctcaaaccatgagcaacagtggaatcaaataaaatgcttccactaccaaaagacattagagaaaaccttaaaagtaataaagagaaatatatttgtcacttatacctaaaatatgagtggctcatttttgcattactctcttctagacttgactagtcatttacttggtatatattgttttcattgattggggaaacactagatttttacctcggtttttgatcatttataatggagagaggaagttgcctatgttttgtaataatttattttttagcaggaatattgattagcagcttttttttctttatacacatagataactaactagattaatgtttagtttcttatttgtaggcacaggatgcatgaaatttcaagctctgggattttttgtatattgtgtatctgtatcaaaaatatcctctccttttcaaaaatgacaggttggaaaatgtttgtcagacttattaactggtcatattataataatactgataatgaccaactgctcattctgaaagccaaacataaaagctaggagaagtggcatctgaacatttttgctttgctgccagagtaaccctgactaataatacaataacagcaatttttttaaaaaactgagatttcctactggcttgaagtttttctatttagcaaaataattagtaataagttttgactaggtctaaagaatgaacacattgtaaacagttgccacagtagtttctaataaattgatcataaaagcagctatcctttttttttttaattctagcttctttttaaagattatttgggtacctaataaaggataatttatatctt

SEQ ID NO: 106845 - DNA, 2586 bp, Homo sapiens
  Payload ID: 983
  Gene Symbol: AIMP1
  Gene Name: aminoacyl tRNA synthetase complex-interacting multifunctional protein 1
  Uniprot ID: Q12904
  ENST ID: ENST00000394701
  CDS Start-End: 42-1052
gtcctttctcactgctatagtacgcgggtggctggacctacatgcttcctgctgtggctgtctcggaacccgtggtcctccgcttcatgattttctgccgtctcttggcaaaaatggcaaataatgatgctgttctgaagagactggagcagaagggtgcagaggcagatcaaatcattgaatatcttaagcagcaagtttctctacttaaggagaaagcaattttgcaggcaactttgagggaagagaagaaacttcgagttgaaaatgctaaactgaagaaagaaattgaagaactgaaacaagagctaattcaggcagaaattcaaaatggagtgaagcaaataccatttccatctggtactccactgcacgctaattctatggtttctgaaaatgtgatacagtctacagcagtaacaaccgtatcttctggtaccaaagaacagataaaaggaggaacaggagacgaaaagaaagcgaaagagaaaattgaaaagaaaggagagaagaaggagaaaaaacagcaatcaatagctggaagtgccgactctaagccaatagatgtttcccgtctggatcttcgaattggttgcatcataactgctagaaaacaccctgatgcagattctttgtatgtggaagaagtagatgtcggagaaatagccccaaggacagttgtcagtggcctggtgaatcatgttcctcttgaacagatgcaaaatcggatggtgattttactttgtaacctgaaacctgcaaagatgaggggagtattatctcaagcaatggtcatgtgtgctagttcaccagagaaaattgaaatcttggctcctccaaatgggtctgttcctggagacagaattacttttgatgctttcccaggagagcctgacaaggagctgaatcctaagaagaagatttgggagcagatccagcctgatcttcacactaatgatgagtgtgtggctacatacaaaggagttccctttgaggtgaaagggaagggagtatgtagggctcaaaccatgagcaacagtggaatcaaataaaatgcttccactaccaaaagacattagagaaaaccttaaaagtaataaagagaaatatatttgtcacttatacctaaaatatgagtggctcatttttgcattactctcttctagacttgactagtcatttacttggtatatattgttttcattgattggggaaacactagatttttacctcggtttttgatcatttataatggagagaggaagttgcctatgttttgtaataatttattttttagcaggaatattgattagcagcttttttttctttatacacatagataactaactagattaatgtttagtttcttatttgtaggcacaggatgcatgaaatttcaagctctgggattttttgtatattgtgtatctgtatcaaaaatatcctctccttttcaaaaatgacaggttggaaaatgtttgtcagacttattaactggtcatattataataatactgataatgaccaactgctcattctgaaagccaaacataaaagctaggagaagtggcatctgaacatttttgctttgctgccagagtaaccctgactaataatacaataacagcaatttttttaaaaaactgagatttcctactggcttgaagtttttctatttagcaaaataattagtaataagttttgactaggtctaaagaatgaacacattgtaaacagttgccacagtagtttctaataaattgatcataaaagcagctatcctttttttttttaattctagcttctttttaaagattatttgggtacctaataaaggataatttatatcttattacagactgatattttgctttttcatgtgtcatcatactgtcagtatattaaaagaaattacagcctaaaacttaacatataccatacatatatattaaggtgtcaaatagctattctcactcatcttacaaatattgtaagagcaataaaaattaattgaggaattataagcctacaggtcatcagccttgaggtgattactgatgatttgggcttacacacatgtcagcaagatagggagtgtggataggggagggctggtagctaacaaggggcctcacagagaaatattagtgactttaaccaggtttcagaatctgggccttacctttacaggttcaacaaaagaatggcatcaatagaggcagaagtatagacattgttttaaaaatacacacatgcacacacacacaaaacattttagcattatagctgtctgaatccttcaataagaaggagaggcacacacaaatacacacactcacacaaaactcaacaaccataaaacaaccctgcatgttataaaaggcagaattaaattttatttatttaaatccatggaactctggtaggccaggatatattatagtaccattatcaatgtgatattctgaaaatatgaactgagcgtcattaacaattgttggtacctaaacacaaaatgaatttcaaaagttactttgttctcaagatatgtcattcttttgggaataaatacttctggtgacaaag

SEQ ID NO: 106846 - DNA, 2519 bp, Homo sapiens
  Payload ID: 983
  Gene Symbol: AIMP1
  Gene Name: aminoacyl tRNA synthetase complex-interacting multifunctional protein 1
  Uniprot ID: Q12904
  ENST ID: ENST00000442366
  CDS Start-End: 53-991
aaaccaaagcaaaattctgcctccaaggattttctgccgtctcttggcaaaaatggcaaataatgatgctgttctgaagagactggagcagaagggtgcagaggcagatcaaatcattgaatatcttaagcagcaagtttctctacttaaggagaaagcaattttgcaggcaactttgagggaagagaagaaacttcgagttgaaaatgctaaactgaagaaagaaattgaagaactgaaacaagagctaattcaggcagaaattcaaaatggagtgaagcaaataccatttccatctggtactccactgcacgctaattctatggtttctgaaaatgtgatacagtctacagcagtaacaaccgtatcttctggtaccaaagaacagataaaaggaggaacaggagacgaaaagaaagcgaaagagaaaattgaaaagaaaggagagaagaaggagaaaaaacagcaatcaatagctggaagtgccgactctaagccaatagatgtttcccgtctggatcttcgaattggttgcatcataactgctagaaaacaccctgatgcagattctttgtatgtggaagaagtagatgtcggagaaatagccccaaggacagttgtcagtggcctggtgaatcatgttcctcttgaacagatgcaaaatcggatggtgattttactttgtaacctgaaacctgcaaagatgaggggagtattatctcaagcaatggtcatgtgtgctagttcaccagagaaaattgaaatcttggctcctccaaatgggtctgttcctggagacagaattacttttgatgctttcccaggagagcctgacaaggagctgaatcctaagaagaagatttgggagcagatccagcctgatcttcacactaatgatgagtgtgtggctacatacaaaggagttccctttgaggtgaaagggaagggagtatgtagggctcaaaccatgagcaacagtggaatcaaataaaatgcttccactaccaaaagacattagagaaaaccttaaaagtaataaagagaaatatatttgtcacttatacctaaaatatgagtggctcatttttgcattactctcttctagacttgactagtcatttacttggtatatattgttttcattgattggggaaacactagatttttacctcggtttttgatcatttataatggagagaggaagttgcctatgttttgtaataatttattttttagcaggaatattgattagcagcttttttttctttatacacatagataactaactagattaatgtttagtttcttatttgtaggcacaggatgcatgaaatttcaagctctgggattttttgtatattgtgtatctgtatcaaaaatatcctctccttttcaaaaatgacaggttggaaaatgtttgtcagacttattaactggtcatattataataatactgataatgaccaactgctcattctgaaagccaaacataaaagctaggagaagtggcatctgaacatttttgctttgctgccagagtaaccctgactaataatacaataacagcaatttttttaaaaaactgagatttcctactggcttgaagtttttctatttagcaaaataattagtaataagttttgactaggtctaaagaatgaacacattgtaaacagttgccacagtagtttctaataaattgatcataaaagcagctatcctttttttttttaattctagcttctttttaaagattatttgggtacctaataaaggataatttatatcttattacagactgatattttgctttttcatgtgtcatcatactgtcagtatattaaaagaaattacagcctaaaacttaacatataccatacatatatattaaggtgtcaaatagctattctcactcatcttacaaatattgtaagagcaataaaaattaattgaggaattataagcctacaggtcatcagccttgaggtgattactgatgatttgggcttacacacatgtcagcaagatagggagtgtggataggggagggctggtagctaacaaggggcctcacagagaaatattagtgactttaaccaggtttcagaatctgggccttacctttacaggttcaacaaaagaatggcatcaatagaggcagaagtatagacattgttttaaaaatacacacatgcacacacacacaaaacattttagcattatagctgtctgaatccttcaataagaaggagaggcacacacaaatacacacactcacacaaaactcaacaaccataaaacaaccctgcatgttataaaaggcagaattaaattttatttatttaaatccatggaactctggtaggccaggatatattatagtaccattatcaatgtgatattctgaaaatatgaactgagcgtcattaacaattgttggtacctaaacacaaaatgaatttcaaaagttactttgttctcaagatatgtcattcttttgggaataaatacttctggtg

SEQ ID NO: 106847 - DNA, 568 bp, Homo sapiens
  Payload ID: 983
  Gene Symbol: AIMP1
  Gene Name: aminoacyl tRNA synthetase complex-interacting multifunctional protein 1
  ENST ID: ENST00000510207
  CDS Start-End: 119-568
actttctcctactgctcaagggggtgttacactttgacgactgactaaacctcgagggccagaaacaaaccaaagcaaaattctgcctccaaggattttctgccgtctcttggcaaaaatggcaaataatgatgctgttctgaagagactggagcagaagggtgcagaggcagatcaaatcattgaatatcttaagcagcaagtttctctacttaaggagaaagcaattttgcaggcaactttgagggaagagaagaaacttcgagttgaaaatgctaaactgaagaaagaaattgaagaactgaaacaagagctaattcaggcagaaattcaaaatggagtgaagcaaataccatttccatctggtactccactgcacgctaattctatggtttctgaaaatgtgatacagtctacagcagtaacaaccgtatcttctggtaccaaagaacagataaaaggaggaacaggagacgaaaagaaagcgaaagagaaaattgaaaagaaaggagagaagaaggagaaaaaacagcaatcaatagctggaagtgccgactctaagccaata

SEQ ID NO: 106848 - DNA, 1225 bp, Homo sapiens
  Payload ID: 984
  Gene Symbol: AIMP2
  Gene Name: aminoacyl tRNA synthetase complex-interacting multifunctional protein 2
  Uniprot ID: Q13155
  ENST ID: ENST00000223029
  CDS Start-End: 120-1082
gttttcccgaacgcccgcagcagggtcagaagggaggtggccggtctccgtcgtgacctctgacggtttctgagcgttggcctttggcacgcgctacccccttttgctttggttctgccatgccgatgtaccaggtaaagccctatcacgggggcggcgcgcctctccgtgtggagcttcccacctgcatgtaccggctccccaacgtgcacggcaggagctacggcccagcgccgggcgctggccacgtgcaggaagagtctaacctgtctctgcaagctcttgagtcccgccaagatgatattttaaaacgtctgtatgagttgaaagctgcagttgatggcctctccaagatgattcaaacaccagatgcagacttggatgtaaccaacataatccaagcggatgagcccacgactttaaccaccaatgcgctggacttgaattcagtgcttgggaaggattacggggcgctgaaagacatcgtgatcaacgcaaacccggcctcccctcccctctccctgcttgtgctgcacaggctgctctgtgagcacttcagggtcctgtccacggtgcacacgcactcctcggtcaagagcgtgcctgaaaaccttctcaagtgctttggagaacagaataaaaaacagccccgccaagactatcagctgggattcactttaatttggaagaatgtgccgaagacgcagatgaaattcagcatccagacgatgtgccccatcgaaggcgaagggaacattgcacgtttcttgttctctctgtttggccagaagcataatgctgtcaacgcaacccttatagatagctgggtagatattgcgatttttcagttaaaagagggaagcagtaaagaaaaagccgctgttttccgctccatgaactctgctcttgggaagagcccttggctcgctgggaatgaactcaccgtagcagacgtggtgctgtggtctgtactccagcagatcggaggctgcagtgtgacagtgccagccaatgtgcagaggtggatgaggtcttgtgaaaacctggctccttttaacacggccctcaagctccttaagtgaattgccgtaactgattttaaagggtttagattttaagaatggtgctctttcatgcctattatcagtaaggggacttgtattagagtcagagtctttttatttaggccagttgtcaagtgtcaataaaagcatcatgtaattta

SEQ ID NO: 106849 - DNA, 860 bp, Homo sapiens
  Payload ID: 984
  Gene Symbol: AIMP2
  Gene Name: aminoacyl tRNA synthetase complex-interacting multifunctional protein 2
  ENST ID: ENST00000395236
  CDS Start-End: 49-804
gagcgttggcctttggcacgcgctacccccttttgctttggttctgccatgccgatgtaccaggtaaagccctatcacgggggcggcgcgcctctccgtgtggagcttcccacctgcatgtaccggctccccaacgtgcacggcaggagctacggcccagcgccgggcgctggccacgtgcaggattacggggcgctgaaagacatcgtgatcaacgcaaacccggcctcccctcccctctccctgcttgtgctgcacaggctgctctgtgagcacttcagggtcctgtccacggtgcacacgcactcctcggtcaagagcgtgcctgaaaaccttctcaagtgctttggagaacagaataaaaaacagccccgccaagactatcagctgggattcactttaatttggaagaatgtgccgaagacgcagatgaaattcagcatccagacgatgtgccccatcgaaggcgaagggaacattgcacgtttcttgttctctctgtttggccagaagcataatgctgtcaacgcaacccttatagatagctgggtagatattgcgatttttcagttaaaagagggaagcagtaaagaaaaagccgctgttttccgctccatgaactctgctcttgggaagagcccttggctcgctgggaatgaactcaccgtagcagacgtggtgctgtggtctgtactccagcagatcggaggctgcagtgtgacagtgccagccaatgtgcagaggtggatgaggtcttgtgaaaacctggctccttttaacacggccctcaagctccttaagtgaattgccgtaactgattttaaagggtttagattttaagaatggtgctctttcatgcc

SEQ ID NO: 106850 - DNA, 1107 bp, Homo sapiens
  Payload ID: 984
  Gene Symbol: AIMP2
  Gene Name: aminoacyl tRNA synthetase complex-interacting multifunctional protein 2
  ENST ID: ENST00000400479
  CDS Start-End: 375-1103
acgcccgcagcagggtcagaagggaggtggccggtctccgtcgtgacctctgacggtttctgagcgttggcctttggcacgcgctacccccttttgctttggttctgccatgccgatgtaccagtagagacggggtttcaccatgttggccaggctggtcttgaactcctgacgtcagatgatctgcctacctggacctcccgaagtgctgggattacaggcgtgagccaccacacccagcccataatgtcttcttttaaagggtgggaggtttggaagagtctaacctgtctctgcaagctcttgagtcccgccaagatgatattttaaaacgtctgtatgagttgaaagctgcagttgatggcctctccaagatgattcaaacaccagatgcagacttggatgtaaccaacataatccaagcggatgagcccacgactttaaccaccaatgcgctggacttgaattcagtgcttgggaaggattacggggcgctgaaagacatcgtgatcaacgcaaacccggcctcccctcccctctccctgcttgtgctgcacaggctgctctgtgagcacttcagggtcctgtccacggtgcacacgcactcctcggtcaagagcgtgcctgaaaaccttctcaagtgctttggagaacagaataaaaaacagccccgccaagactatcagctgggattcactttaatttggaagaatgtgccgaagacgcagatgaaattcagcatccagacgatgtgccccatcgaaggcgaagggaacattgcacgtttcttgttctctctgtttggccagaagcataatgctgtcaacgcaacccttatagatagctgggtagatattgcgatttttcagttaaaagagggaagcagtaaagaaaaagccgctgttttccgctccatgaactctgctcttgggaagagcccttggctcgctgggaatgaactcaccgtagcagacgtggtgctgtggtctgtactccagcagatcggaggctgcagtgtgacagtgccagccaatgtgcagaggtggatgaggtcttgtgaaaacctggctccttttaacacggccctcaagctccttaagtgaattg

SEQ ID NO: 106851 - DNA, 777 bp, Homo sapiens
  Payload ID: 984
  Gene Symbol: AIMP2
  Gene Name: aminoacyl tRNA synthetase complex-interacting multifunctional protein 2
  ENST ID: ENST00000415999
  CDS Start-End: 75-221
ctccgtcgtgacctctgacggtttctgagcgttggcctttggcacgcgctacccccttttgctttggttctgccatgccgatgtaccaggtaaagccctatcacgggggcggcgcgcctctccgtgtggagcttcccacctgcatgtaccggctccccaacgtgcacggcaggagctacggcccagcgccgggcgctggccacgtgcagcctctccagtagctgggattacaggtgccccccaccaagcccagctaatttttgtgtttcagtagaaatggagtttcatcatgttgtcctctcgaactcctgacctcaagtgatccacccgcctcgcccttccaaagtgctgagattacaggtatcagccactgtgcctagccagcactcaataatttaattggcatactgaactctgttccacccggaagtcagtggacttcacatttctctgacgtttgatcttaaataagagcagcagactaggagaggtgagaaagtgctgattaagcccgaaggtaaataggagttaagcaaacaagagaagaaggaagagtgatgcagatggagggaacagcacatgtgaagatctgtggtcagagccagggtggtggtttaggaactcctcggacagtgtggctagagcacaggcaaaggacgaaattgggtgaggaagagtctaacctgtctctgcaagctcttgagtcccgccaagatgatattttaaaacgtctgtatgagttgaaagctgcagttgatggcctctccaagatgattc

SEQ ID NO: 106852 - DNA, 1444 bp, Homo sapiens
  Payload ID: 985
  Gene Symbol: ACY1
  Gene Name: aminoacylase 1
  Uniprot ID: Q03154
  ENST ID: ENST00000404366
  CDS Start-End: 147-1373
cgtggtgggcggaccggggcggtcctgagcctgcgacctcgcaggcgacctcgctggaccctaagtccaggccacagtcagggaagggcgctgagaggcgagcgtgagcccagcgacaggagagtgagctcaccacgcgcagcgccatgaccagcaagggtcccgaggaggagcacccatcggtgacgctcttccgccagtacctgcgtatccgcactgtccagcccaagcctgactatggagctgctgtggctttctttgaggagacagcccgccagctgggcctgggctgtcagaaagtagaggtggcacctggctatgtggtgaccgtgttgacctggccaggcaccaaccctacactctcctccatcttgctcaactcccacacggatgtggtgcctgtcttcaaggaacattggagtcacgacccctttgaggccttcaaggattctgagggctacatctatgccaggggtgcccaggacatgaagtgcgtcagcatccagtacctggaagctgtgaggaggctgaaggtggagggccaccggttccccagaaccatccacatgacctttgtgcctgatgaggaggttgggggtcaccaaggcatggagctgttcgtgcagcggcctgagttccacgccctgagggcaggctttgccctggatgagggcatagccaatcccactgatgccttcactgtcttttatagtgagcggagtccctggtgggtgcgggttaccagcactgggaggccaggccatgcctcacgcttcatggaggacacagcagcagagaagctgcacaaggttgtaaactccatcctggcattccgggagaaggaatggcagaggctgcagtcaaacccccacctgaaagaggggtccgtgacctccgtgaacctgactaagctagagggtggcgtggcctataacgtgatacctgccaccatgagcgccagctttgacttccgtgtggcaccggatgtggacttcaaggcttttgaggagcagctgcagagctggtgccaggcagctggcgagggggtcaccctagagtttgctcagaagtggatgcacccccaagtgacacctactgatgactcaaacccttggtgggcagcttttagccgggtctgcaaggatatgaacctcactctggagcctgagatcatgcctgctgccactgacaaccgctatatccgcgcggtgggggtcccagctctaggcttctcacccatgaaccgcacacctgtgctgctgcacgaccacgatgaacggctgcatgaggctgtgttcctccgtggggtggacatatatacacgcctgctgcctgcccttgccagtgtgcctgccctgcccagtgacagctgagccctggaactcctaaacctttgcccctggggcttccatcccaaccagtgccaaggacctcctcttccccc

SEQ ID NO: 106853 - DNA, 1409 bp, Homo sapiens
  Payload ID: 985
  Gene Symbol: ACY1
  Gene Name: aminoacylase 1
  Uniprot ID: Q03154
  ENST ID: ENST00000476351
  CDS Start-End: 166-1287
cgacatccggcctcggccacgtggtgggcggaccggggcggtcctgagcctgcgacctcgcaggcgacctcgctggaccctaagtccaggccacagtcagggaagggcgctgagaggcgagcgtgagcccagcgacaggagagtgagctcaccacgcgcagcgccatgaccagcaagggtcccgaggaggagcacccatcggtgacgctcttccgccagtacctgcgtatccgcactgtccagcccaagcctgactatggcaccaaccctacactctcctccatcttgctcaactcccacacggatgtggtgcctgtcttcaaggaacattggagtcacgacccctttgaggccttcaaggattctgagggctacatctatgccaggggtgcccaggacatgaagtgcgtcagcatccagtacctggaagctgtgaggaggctgaaggtggagggccaccggttccccagaaccatccacatgacctttgtgcctgatgaggaggttgggggtcaccaaggcatggagctgttcgtgcagcggcctgagttccacgccctgagggcaggctttgccctggatgagggcatagccaatcccactgatgccttcactgtcttttatagtgagcggagtccctggtgggtgcgggttaccagcactgggaggccaggccatgcctcacgcttcatggaggacacagcagcagagaagctgcacaaggttgtaaactccatcctggcattccgggagaaggaatggcagaggctgcagtcaaacccccacctgaaagaggggtccgtgacctccgtgaacctgactaagctagagggtggcgtggcctataacgtgatacctgccaccatgagcgccagctttgacttccgtgtggcaccggatgtggacttcaaggcttttgaggagcagctgcagagctggtgccaggcagctggcgagggggtcaccctagagtttgctcagaagtggatgcacccccaagtgacacctactgatgactcaaacccttggtgggcagcttttagccgggtctgcaaggatatgaacctcactctggagcctgagatcatgcctgctgccactgacaaccgctatatccgcgcggtgggggtcccagctctaggcttctcacccatgaaccgcacacctgtgctgctgcacgaccacgatgaacggctgcatgaggctgtgttcctccgtggggtggacatatatacacgcctgctgcctgcccttgccagtgtgcctgccctgcccagtgacagctgagccctggaactcctaaacctttgcccctggggcttccatcccaaccagtgccaaggacctcctcttcccccttccaaataataaagtctatggacagggctgtctctgaagtactaacacaa

SEQ ID NO: 106854 - DNA, 1298 bp, Homo sapiens
  Payload ID: 985
  Gene Symbol: ACY1
  Gene Name: aminoacylase 1
  Uniprot ID: Q03154
  ENST ID: ENST00000494103
  CDS Start-End: 166-1176
cgacatccggcctcggccacgtggtgggcggaccggggcggtcctgagcctgcgacctcgcaggcgacctcgctggaccctaagtccaggccacagtcagggaagggcgctgagaggcgagcgtgagcccagcgacaggagagtgagctcaccacgcgcagcgccatgaccagcaagggtcccgaggaggagcacccatcggtgacgctcttccgccagtacctgcgtatccgcactgtccagcccaagcctgactatggagctgctgtggctttctttgaggagacagcccgccagctgggcctgggctgtcagaaagtagaggtggcacctggctatgtggtgaccgtgttgacctggccaggcaccaaccctacactctcctccatcttgctcaactcccacacggatgtggtgcctgtcttcaaggaacattggagtcacgacccctttgaggccttcaaggattctgagggcatagccaatcccactgatgccttcactgtcttttatagtgagcggagtccctggtgggtgcgggttaccagcactgggaggccaggccatgcctcacgcttcatggaggacacagcagcagagaagctgcacaaggttgtaaactccatcctggcattccgggagaaggaatggcagaggctgcagtcaaacccccacctgaaagaggggtccgtgacctccgtgaacctgactaagctagagggtggcgtggcctataacgtgatacctgccaccatgagcgccagctttgacttccgtgtggcaccggatgtggacttcaaggcttttgaggagcagctgcagagctggtgccaggcagctggcgagggggtcaccctagagtttgctcagaagtggatgcacccccaagtgacacctactgatgactcaaacccttggtgggcagcttttagccgggtctgcaaggatatgaacctcactctggagcctgagatcatgcctgctgccactgacaaccgctatatccgcgcggtgggggtcccagctctaggcttctcacccatgaaccgcacacctgtgctgctgcacgaccacgatgaacggctgcatgaggctgtgttcctccgtggggtggacatatatacacgcctgctgcctgcccttgccagtgtgcctgccctgcccagtgacagctgagccctggaactcctaaacctttgcccctggggcttccatcccaaccagtgccaaggacctcctcttcccccttccaaataataaagtctatggacagggctgtctctgaagtactaacacaa

SEQ ID NO: 106855 - DNA, 1390 bp, Homo sapiens
  Payload ID: 985
  Gene Symbol: ACY1
  Gene Name: aminoacylase 1
  ENST ID: ENST00000491318
  CDS Start-End: 166-771
cgacatccggcctcggccacgtggtgggcggaccggggcggtcctgagcctgcgacctcgcaggcgacctcgctggaccctaagtccaggccacagtcagggaagggcgctgagaggcgagcgtgagcccagcgacaggagagtgagctcaccacgcgcagcgccatgaccagcaagggtcccgaggaggagcacccatcggtgacgctcttccgccagtacctgcgtatccgcactgtccagcccaagcctgactatggagctgctgtggctttctttgaggagacagcccgccagctgggcctgggctgtcagaaagtagaggtggcacctggctatgtggtgaccgtgttgacctggccaggcaccaaccctacactctcctccatcttgctcaactcccacacggatgtggtgcctgtcttcaaggaacattggagtcacgacccctttgaggccttcaaggattctgagggctacatctatgccaggggtgcccaggacatgaagtgcgtcagcatccagtacctggaagctgtgaggaggctgaaggtggagggccaccggttccccagaaccatccacatgacctttgtgcctgatgaggaggttgggggtcaccaaggcatggagctgttcgtgcagcggcctgagttccacgccctgagggcaggctttgccctggatgagggcatagccaatcccactgatgccttcactgtcttttatagtgagcggagtccctggtgctgcagtcaaacccccacctgaaagaggggtccgtgacctccgtgaacctgactaagctagagggtggcgtggcctataacgtgatacctgccaccatgagcgccagctttgacttccgtgtggcaccggatgtggacttcaaggcttttgaggagcagctgcagagctggtgccaggcagctggcgagggggtcaccctagagtttgctcagaagtggatgcacccccaagtgacacctactgatgactcaaacccttggtgggcagcttttagccgggtctgcaaggatatgaacctcactctggagcctgagatcatgcctgctgccactgacaaccgctatatccgcgcggtgggggtcccagctctaggcttctcacccatgaaccgcacacctgtgctgctgcacgaccacgatgaacggctgcatgaggctgtgttcctccgtggggtggacatatatacacgcctgctgcctgcccttgccagtgtgcctgccctgcccagtgacagctgagccctggaactcctaaacctttgcccctggggcttccatcccaaccagtgccaaggacctcctcttcccccttccaaataataaagtctatggacagggctgtctctgaagtactaacacaa

SEQ ID NO: 106856 - DNA, 1319 bp, Homo sapiens
  Payload ID: 985
  Gene Symbol: ACY1
  Gene Name: aminoacylase 1
  Uniprot ID: Q03154
  ENST ID: ENST00000476854
  CDS Start-End: 166-1197
cgacatccggcctcggccacgtggtgggcggaccggggcggtcctgagcctgcgacctcgcaggcgacctcgctggaccctaagtccaggccacagtcagggaagggcgctgagaggcgagcgtgagcccagcgacaggagagtgagctcaccacgcgcagcgccatgaccagcaagggtcccgaggaggagcacccatcggtgacgctcttccgccagtacctgcgtatccgcactgtccagcccaagcctgactatggagctgctgtggctttctttgaggagacagcccgccagctgggcctgggctgtcagaaagtagaggtggcacctggctatgtggtgaccgtgttgacctggccaggcaccaaccctacactctcctccatcttgctcaactcccacacggatgtggtgcctgtcttcaaggaacattggagtcacgacccctttgaggccttcaaggattctgagggctacatctatgccaggggtgcccaggacatgaagtgcgtcagcatccagtacctggaagctgtgaggaggctgaaggtggagggccaccggttccccagaaccatccacatgacctttgtgcctgatgaggaggttgggggtcaccaaggcatggagctgttcgtgcagcggcctgagttccacgccctgagggcaggctttgccctggatgagggcatagccaatcccactgatgccttcactgtcttttatagtgagcggagtccctggtgggtgcgggttaccagcactgggaggccaggccatgcctcacgcttcatggaggacacagcagcagagaagctggcttttgaggagcagctgcagagctggtgccaggcagctggcgagggggtcaccctagagtttgctcagaagtggatgcacccccaagtgacacctactgatgactcaaacccttggtgggcagcttttagccgggtctgcaaggatatgaacctcactctggagcctgagatcatgcctgctgccactgacaaccgctatatccgcgcggtgggggtcccagctctaggcttctcacccatgaaccgcacacctgtgctgctgcacgaccacgatgaacggctgcatgaggctgtgttcctccgtggggtggacatatatacacgcctgctgcctgcccttgccagtgtgcctgccctgcccagtgacagctgagccctggaactcctaaacctttgcccctggggcttccatcccaaccagtgccaaggacctcctcttcccccttccaaataataaagtctatggacagggctgtctctgaagtactaacacaa

SEQ ID NO: 106857 - DNA, 755 bp, Homo sapiens
  Payload ID: 985
  Gene Symbol: ACY1
  Gene Name: aminoacylase 1
  ENST ID: ENST00000469863
  CDS Start-End: 72-755
agtcagggaagggcgctgagaggcgagcgtgagcccagcgacaggagagtgagctcaccacgcgcagcgccatgaccagcaagggtcccgaggaggagcacccatcggtgacgctcttccgccagtacctgcgtatccgcactgtccagcccaagcctgactatggagctgctgtggctttctttgaggagacagcccgccagctgggcctgggctgtcagaaagtagagaccacctaccctcctgaccatctccaggtggcacctggctatgtggtgaccgtgttgacctggccaggcaccaaccctacactctcctccatcttgctcaactcccacacggatgtggtgcctgtcttcaaggaacattggagtcacgacccctttgaggccttcaaggattctgagggctacatctatgccaggggtgcccaggacatgaagtgcgtcagcatccagtacctggaagctgtgaggaggctgaaggtggagggccaccggttccccagaaccatccacatgacctttgtgcctgatgaggaggttgggggtcaccaaggcatggagctgttcgtgcagcggcctgagttccacgccctgagggcaggctttgccctggatgagggcatagccaatcccactgatgccttcactgtcttttatagtgagcggagtccctggtgggtgcgggttaccagcactgggaggccaggccatgcctcacgcttcatggaggacacagcagcagagaagctg

SEQ ID NO: 106858 - DNA, 1300 bp, Homo sapiens
  Payload ID: 986
  Gene Symbol: ACY3
  Gene Name: aminoacylase 3
  Uniprot ID: Q96HD9
  ENST ID: ENST00000255082
  CDS Start-End: 172-1131
cggagtgacagccccacgggccacgcagcaagcagaagatccccgggagtcaccctcaaccctctggggccacgtgggcccatgaataccagcctgtctgcgagttagacgccagtcctggtggcccgggaagcccagatccgcatcagcggttctgcaccccacaccagcatgtgctcactgcctgtgccccgggagcccctgcgtcgcgtggctgtgactgggggcacgcatggcaacgagatgtcgggcgtctacctggcccggcactggctgcatgcccccgcagagctgcagagagccagcttctccgctgtgcctgtgctggccaacccggcagccacatccggctgccgccgctacgtggaccatgacctcaaccgcaccttcaccagcagcttcctcaattccaggcccaccccggacgacccatatgaggtgacaagagcccgagagctgaaccagctgctggggcccaaggcctcgggccaggcctttgactttgtccttgacctgcacaacaccacggccaacatgggcacctgcttaatcgcgaagtcctcccacgaagtctttgccatgcacctgtgccgccatctgcagctgcagtaccccgagctgtcctgccaggtcttcctgtaccagcggtctggggaggagagctacaacctggactctgtggccaaaaatggactgggtctggagctgggcccccagccacagggtgtgctgcgggctgacattttctcaaggatgaggaccctggtggccacagttctggacttcatcgaactcttcaaccagggtacggcctttcctgcctttgagatggaagcctatagacccgtgggcgtcgtggacttcccccgcaccgaggccgggcacctggcaggcactgtgcatcctcagctgcaggaccgagacttccagccactgcagcctggtgctcccatcttccagatgttcagtggggaggacctgctctatgagggagagtccacggtgtaccccgtgttcattaacgaggctgcctactatgagaagggcgttgcctttgtccagactgagaagttcacattcaccgtgcctgccatgcccgcgctgacccctgccccgagcccagcttcctaacccaagacacacctccccaacctcagtcttcccatctgaacgatgggtcctgaggcacagctctgagcacagaggtcccttctgccacctaccatgcaccatgttccttgccaggcctccccaacccctggcctcaatttccctttctataaaatggaagatgtccaga

SEQ ID NO: 106859 - DNA, 933 bp, Homo sapiens
  Payload ID: 986
  Gene Symbol: ACY3
  Gene Name: aminoacylase 3
  ENST ID: ENST00000529256
  CDS Start-End: 314-910
gaataccagcctgtctgcgagttagacgccagtcctggtggcccgggaagcccagatccgcatcagcgagctgcagagagccagcttctccgctgtgcctgtgctggccaacccggcagccacatccggctgccgccgctacgtggaccatgacctcaaccgcaccttcaccagcagcttcctcaattccaggcccaccccggacgacccatatgaggtgacaagagcccgagagctgaaccagctgctggggcccaaggcctcgggccaggcctttgactttgtccttgacctgcacaacaccacggccaacatgggcacctgcttaatcgcgaagtcctcccacgaagtctttgccatgcacctgtgccgccatctgcagctgcagtaccccgagctgtcctgccaggtcttcctgtaccagcggtctggggaggagagctacaacctggactctgtggccaaaaatggactgggtctggagctgggcccccagccacagggtgtgctgcgggctgacattttctcaaggatgaggaccctggtggccacagttctggacttcatcgaactcttcaaccagggtacggcctttcctgcctttgagatggaagcctatagacccgtgggcgtcgtggacttcccccgcaccgaggccgggcacctggcaggcactgtgcatcctcagctgcaggaccgagacttccagccactgcagcctggtgctcccatcttccagatgttcagtggggaggacctgctctatgagggagagtccacggtgtaccccgtgttcattaacgaggctgcctactatgagaagggcgttgcctttgtccagactgagaagttcacattcaccgtgcctgccatgcccgcgctgacccctgccccgagcccagcttcctaacccaagacacacctccccaacct

SEQ ID NO: 106860 - DNA, 2101 bp, Homo sapiens
  Payload ID: 987
  Gene Symbol: AADAT
  Gene Name: aminoadipate aminotransferase
  Uniprot ID: Q8N5Z0
  ENST ID: ENST00000353187
  CDS Start-End: 125-1402
agcccctgggctagcctctgggccggcgcctaggccggccaacgcggacgccgggttgcggtgattcccagcggcgagtcctcaaccactgaagaagaagcttgatgcttggctgtcagaagacatgaattacgcacggttcatcacggcagcgagcgcagccagaaacccttctcccatccggaccatgactgacatattgagcagaggaccaaaatcgatgatctccttggctggtggcttaccaaatccaaacatgtttccttttaagactgccgtaatcactgtagaaaatggaaagaccatccaatttggagaagagatgatgaagagagcacttcagtattctccgagtgctggaattccagagcttttgtcctggctaaaacagttacaaataaaattgcataatcctcctaccatccattacccacccagtcaaggacaaatggatctatgtgtcacatctggcagccaacaaggtctttgtaaggtgtttgaaatgatcattaatcctggagataatgtcctcctagatgaacctgcttattcaggaactcttcaaagtctgcacccactgggctgcaacattattaatgttgccagtgatgaaagtgggattgttccagattccctaagagacatactttccagatggaaaccagaagatgcaaagaatccccagaaaaacacccccaaatttctttatactgttccaaatggcaacaaccctactggaaactcattaaccagtgaacgcaaaaaggaaatctatgagcttgcaagaaaatatgatttcctcataatagaagatgatccttactattttctccagtttaacaagttcagggtaccaacatttctttccatggatgttgatggacgtgtcatcagagctgactctttttcaaaaatcatttcctctgggttgagaataggatttttaactggtccaaaacccttaatagagagagttattttacacatacaagtttcaacattgcaccccagcacttttaaccagctcatgatatcacagcttctacacgaatggggagaagaaggtttcatggctcatgtagacagggttattgatttctatagtaaccagaaggatgcaatactggcagctgcagacaagtggttaactggtttggcagaatggcatgttcctgctgctggaatgtttttatggattaaagttaaaggcattaatgatgtaaaagaactgattgaagaaaaggccgttaagatgggggtattaatgctccctggaaatgctttctacgtcgatagctcagctcctagcccttacttgagagcatccttctcttcagcttctccagaacagatggatgtggccttccaggtattagcacaacttataaaagaatctttatgaagaaattaaactaggttgggcatggtggctcacacctataatcccagcactttgggaggcagaggagggaggatcacttgaacccaggaattcaaggctgcagtaagctacgatcacaccactgcactctggcctgcatgcactctggcctgcatggcagaacaagaccctgtctctaaaaaaagagaaagaaatcaaactaatcatgctgctcatggatttttccaataaatttcttgttttggcaggaagaaatgaacactggtattagacttaaagattaaatttcctcaaacatgtcctatctgtagtagttcaactagacaccttttaaagtgcctctaaattcatcagatggccaaactgtatttataatccacttaggcattttgaaaaactttcaacctgtaaaaagttacttttatcttggatttattatgaagaactttgtagttgctttgtaatttcccataaattgtctttgaaactaacattttacactgaattattttgagattttaaagaagtaattaagtgcaaaatggtatataatgtgtactttttctacttttaggaaaatttaatgagagcttattgcaaaaattgttataatttggtcattataagtgacttttagtaaaagtaccataaaccttatgttatgccacagaaattcctttaaaataaaattcttaaact

SEQ ID NO: 106861 - DNA, 2261 bp, Homo sapiens
  Payload ID: 987
  Gene Symbol: AADAT
  Gene Name: aminoadipate aminotransferase
  Uniprot ID: Q8N5Z0
  ENST ID: ENST00000337664
  CDS Start-End: 278-1555
ctggcggccgcaggagcgcgtgcggcgtggactttgccgggctcgccacacagccccagacccgtttaggaccgggagaccgaacgcagcgtccagccggggagtttcggcggcgttctccgggcaccgcgcgcgggaagccagacgcagcggggggacacatctcgcggtggcgttgccagagtgaggagttagcaggcaggacttgacgaggctctttggtttttctagtcctcaaccactgaagaagaagcttgatgcttggctgtcagaagacatgaattacgcacggttcatcacggcagcgagcgcagccagaaacccttctcccatccggaccatgactgacatattgagcagaggaccaaaatcgatgatctccttggctggtggcttaccaaatccaaacatgtttccttttaagactgccgtaatcactgtagaaaatggaaagaccatccaatttggagaagagatgatgaagagagcacttcagtattctccgagtgctggaattccagagcttttgtcctggctaaaacagttacaaataaaattgcataatcctcctaccatccattacccacccagtcaaggacaaatggatctatgtgtcacatctggcagccaacaaggtctttgtaaggtgtttgaaatgatcattaatcctggagataatgtcctcctagatgaacctgcttattcaggaactcttcaaagtctgcacccactgggctgcaacattattaatgttgccagtgatgaaagtgggattgttccagattccctaagagacatactttccagatggaaaccagaagatgcaaagaatccccagaaaaacacccccaaatttctttatactgttccaaatggcaacaaccctactggaaactcattaaccagtgaacgcaaaaaggaaatctatgagcttgcaagaaaatatgatttcctcataatagaagatgatccttactattttctccagtttaacaagttcagggtaccaacatttctttccatggatgttgatggacgtgtcatcagagctgactctttttcaaaaatcatttcctctgggttgagaataggatttttaactggtccaaaacccttaatagagagagttattttacacatacaagtttcaacattgcaccccagcacttttaaccagctcatgatatcacagcttctacacgaatggggagaagaaggtttcatggctcatgtagacagggttattgatttctatagtaaccagaaggatgcaatactggcagctgcagacaagtggttaactggtttggcagaatggcatgttcctgctgctggaatgtttttatggattaaagttaaaggcattaatgatgtaaaagaactgattgaagaaaaggccgttaagatgggggtattaatgctccctggaaatgctttctacgtcgatagctcagctcctagcccttacttgagagcatccttctcttcagcttctccagaacagatggatgtggccttccaggtattagcacaacttataaaagaatctttatgaagaaattaaactaggttgggcatggtggctcacacctataatcccagcactttgggaggcagaggagggaggatcacttgaacccaggaattcaaggctgcagtaagctacgatcacaccactgcactctggcctgcatgcactctggcctgcatggcagaacaagaccctgtctctaaaaaaagagaaagaaatcaaactaatcatgctgctcatggatttttccaataaatttcttgttttggcaggaagaaatgaacactggtattagacttaaagattaaatttcctcaaacatgtcctatctgtagtagttcaactagacaccttttaaagtgcctctaaattcatcagatggccaaactgtatttataatccacttaggcattttgaaaaactttcaacctgtaaaaagttacttttatcttggatttattatgaagaactttgtagttgctttgtaatttcccataaattgtctttgaaactaacattttacactgaattattttgagattttaaagaagtaattaagtgcaaaatggtatataatgtgtactttttctacttttaggaaaatttaatgagagcttattgcaaaaattgttataatttggtcattataagtgacttttagtaaaagtaccataaaccttatgttatgccacagaaattcctttaaaataaaattcttaaactaaacata

SEQ ID NO: 106862 - DNA, 810 bp, Homo sapiens
  Payload ID: 987
  Gene Symbol: AADAT
  Gene Name: aminoadipate aminotransferase
  ENST ID: ENST00000507375
  CDS Start-End: 182-810
ccctgcagtggacccaagtcgccgccagatggttcccgaggattaggatcacgggcacttccggtcccctcggtcagcccctgggctagcctctgggccggcgcctaggccggccaacgcggacgccgggttgcgtcctcaaccactgaagaagaagcttgatgcttggctgtcagaagacatgaattacgcacggttcatcacggcagcgagcgcagccagaaacccttctcccatccggaccatgactgacatattgagcagaggaccaaaatcgatgatctccttggctggtggcttaccaaatccaaacatgtttccttttaagactgccgtaatcactgtagaaaatggaaagaccatccaatttggagaagagatgatgaagagagcacttcagtattctccgagtgctggaattccagagcttttgtcctggctaaaacagttacaaataaaattgcataatcctcctaccatccattacccacccagtcaaggacaaatggatctatgtgtcacatctggcagccaacaaggtctttgtaaggtgtttgaaatgatcattaatcctggagataatgtcctcctagatgaacctgcttattcaggaactcttcaaagtctgcacccactgggctgcaacattattaatgttgccagtgatgaaagtgggattgttccagattccctaagagacatactttccagatggaaaccagaagatgcaaagaatccccagaaaaacacccccaaatttctttatactgttccaaatggcaacaaccctactggaaactcattaaccag

SEQ ID NO: 106863 - DNA, 2113 bp, Homo sapiens
  Payload ID: 987
  Gene Symbol: AADAT
  Gene Name: aminoadipate aminotransferase
  Uniprot ID: Q8N5Z0
  ENST ID: ENST00000509167
  CDS Start-End: 118-1407
gggctagcctctgggccggcgcctaggccggccaacgcggacgccgggttgcggtgattcccagcggcgagtcctcaaccactgaagaagaagcttgatgcttggctgtcagaagacatgaattacgcacggttcatcacggcagcgagcgcagccagaaacccttctcccatccggaccatgagtgagaaacgggctgacatattgagcagaggaccaaaatcgatgatctccttggctggtggcttaccaaatccaaacatgtttccttttaagactgccgtaatcactgtagaaaatggaaagaccatccaatttggagaagagatgatgaagagagcacttcagtattctccgagtgctggaattccagagcttttgtcctggctaaaacagttacaaataaaattgcataatcctcctaccatccattacccacccagtcaaggacaaatggatctatgtgtcacatctggcagccaacaaggtctttgtaaggtgtttgaaatgatcattaatcctggagataatgtcctcctagatgaacctgcttattcaggaactcttcaaagtctgcacccactgggctgcaacattattaatgttgccagtgatgaaagtgggattgttccagattccctaagagacatactttccagatggaaaccagaagatgcaaagaatccccagaaaaacacccccaaatttctttatactgttccaaatggcaacaaccctactggaaactcattaaccagtgaacgcaaaaaggaaatctatgagcttgcaagaaaatatgatttcctcataatagaagatgatccttactattttctccagtttaacaagttcagggtaccaacatttctttccatggatgttgatggacgtgtcatcagagctgactctttttcaaaaatcatttcctctgggttgagaataggatttttaactggtccaaaacccttaatagagagagttattttacacatacaagtttcaacattgcaccccagcacttttaaccagctcatgatatcacagcttctacacgaatggggagaagaaggtttcatggctcatgtagacagggttattgatttctatagtaaccagaaggatgcaatactggcagctgcagacaagtggttaactggtttggcagaatggcatgttcctgctgctggaatgtttttatggattaaagttaaaggcattaatgatgtaaaagaactgattgaagaaaaggccgttaagatgggggtattaatgctccctggaaatgctttctacgtcgatagctcagctcctagcccttacttgagagcatccttctcttcagcttctccagaacagatggatgtggccttccaggtattagcacaacttataaaagaatctttatgaagaaattaaactaggttgggcatggtggctcacacctataatcccagcactttgggaggcagaggagggaggatcacttgaacccaggaattcaaggctgcagtaagctacgatcacaccactgcactctggcctgcatgcactctggcctgcatggcagaacaagaccctgtctctaaaaaaagagaaagaaatcaaactaatcatgctgctcatggatttttccaataaatttcttgttttggcaggaagaaatgaacactggtattagacttaaagattaaatttcctcaaacatgtcctatctgtagtagttcaactagacaccttttaaagtgcctctaaattcatcagatggccaaactgtatttataatccacttaggcattttgaaaaactttcaacctgtaaaaagttacttttatcttggatttattatgaagaactttgtagttgctttgtaatttcccataaattgtctttgaaactaacattttacactgaattattttgagattttaaagaagtaattaagtgcaaaatggtatataatgtgtactttttctacttttaggaaaatttaatgagagcttattgcaaaaattgttataatttggtcattataagtgacttttagtaaaagtaccataaaccttatgttatgccacagaaattcctttaaaataaaattcttaaactaaacata

SEQ ID NO: 106864 - DNA, 2193 bp, Homo sapiens
  Payload ID: 987
  Gene Symbol: AADAT
  Gene Name: aminoadipate aminotransferase
  Uniprot ID: Q8N5Z0
  ENST ID: ENST00000515480
  CDS Start-End: 210-1487
aaaatgcacagtcccagtgactgagaggaggccagcggagcgcgcgggaacgagggtggggccgctcccggctgggcgcagctcgggagccccctgcagtggacccaagtcgccgccagatggttcccgaggattaggatcacgggcacttccggtcccctcgtcctcaaccactgaagaagaagcttgatgcttggctgtcagaagacatgaattacgcacggttcatcacggcagcgagcgcagccagaaacccttctcccatccggaccatgactgacatattgagcagaggaccaaaatcgatgatctccttggctggtggcttaccaaatccaaacatgtttccttttaagactgccgtaatcactgtagaaaatggaaagaccatccaatttggagaagagatgatgaagagagcacttcagtattctccgagtgctggaattccagagcttttgtcctggctaaaacagttacaaataaaattgcataatcctcctaccatccattacccacccagtcaaggacaaatggatctatgtgtcacatctggcagccaacaaggtctttgtaaggtgtttgaaatgatcattaatcctggagataatgtcctcctagatgaacctgcttattcaggaactcttcaaagtctgcacccactgggctgcaacattattaatgttgccagtgatgaaagtgggattgttccagattccctaagagacatactttccagatggaaaccagaagatgcaaagaatccccagaaaaacacccccaaatttctttatactgttccaaatggcaacaaccctactggaaactcattaaccagtgaacgcaaaaaggaaatctatgagcttgcaagaaaatatgatttcctcataatagaagatgatccttactattttctccagtttaacaagttcagggtaccaacatttctttccatggatgttgatggacgtgtcatcagagctgactctttttcaaaaatcatttcctctgggttgagaataggatttttaactggtccaaaacccttaatagagagagttattttacacatacaagtttcaacattgcaccccagcacttttaaccagctcatgatatcacagcttctacacgaatggggagaagaaggtttcatggctcatgtagacagggttattgatttctatagtaaccagaaggatgcaatactggcagctgcagacaagtggttaactggtttggcagaatggcatgttcctgctgctggaatgtttttatggattaaagttaaaggcattaatgatgtaaaagaactgattgaagaaaaggccgttaagatgggggtattaatgctccctggaaatgctttctacgtcgatagctcagctcctagcccttacttgagagcatccttctcttcagcttctccagaacagatggatgtggccttccaggtattagcacaacttataaaagaatctttatgaagaaattaaactaggttgggcatggtggctcacacctataatcccagcactttgggaggcagaggagggaggatcacttgaacccaggaattcaaggctgcagtaagctacgatcacaccactgcactctggcctgcatgcactctggcctgcatggcagaacaagaccctgtctctaaaaaaagagaaagaaatcaaactaatcatgctgctcatggatttttccaataaatttcttgttttggcaggaagaaatgaacactggtattagacttaaagattaaatttcctcaaacatgtcctatctgtagtagttcaactagacaccttttaaagtgcctctaaattcatcagatggccaaactgtatttataatccacttaggcattttgaaaaactttcaacctgtaaaaagttacttttatcttggatttattatgaagaactttgtagttgctttgtaatttcccataaattgtctttgaaactaacattttacactgaattattttgagattttaaagaagtaattaagtgcaaaatggtatataatgtgtactttttctacttttaggaaaatttaatgagagcttattgcaaaaattgttataatttggtcattataagtgacttttagtaaaagtaccataaaccttatgttatgccacagaaattcctttaaaataaaattcttaaactaaacata

SEQ ID NO: 106865 - DNA, 806 bp, Homo sapiens
  Payload ID: 987
  Gene Symbol: AADAT
  Gene Name: aminoadipate aminotransferase
  ENST ID: ENST00000502392
  CDS Start-End: 267-806
actcaggagcccagctggcttcccccagtggagccggcactggggccacaggtggagctgcctgccagtcccgggctgtgagcccgcactcctcagcccttgggcgaactccatcgtcactccaaaatgctgagatcttcgagaaagtgatgttgaaattcgtcttggtcgccgggatgcttcccaggagagtgcccagagtttcactaacgaaagatggtcctcaaccactgaagaagaagcttgatgcttggctgtcagaagacatgaattacgcacggttcatcacggcagcgagcgcagccagaaacccttctcccatccggaccatgactgacatattgagcagaggaccaaaatcgatgatctccttggctggtggcttaccaaatccaaacatgtttccttttaagactgccgtaatcactgtagaaaatggaaagaccatccaatttggagaagagatgatgaagagagcacttcagtattctccgagtgctggaattccagagcttttgtcctggctaaaacagttacaaataaaattgcataatcctcctaccatccattacccacccagtcaaggacaaatggatctatgtgtcacatctggcagccaacaaggtctttgtaaggtgtttgaaatgatcattaatcctggagataatgtcctcctagatgaacctgcttattcaggaactcttcaaagtctgcacccactgggctgcaacattattaatgttgccagtgatgaaagtgggattgttccagattccctaagagacatactttccagatggaaacca

SEQ ID NO: 106866 - DNA, 755 bp, Homo sapiens
  Payload ID: 987
  Gene Symbol: AADAT
  Gene Name: aminoadipate aminotransferase
  ENST ID: ENST00000510340
  CDS Start-End: 95-755
agtagagagaggcgcagactgctgtggggcacggccttggaagggagggggcgtgctatcaagaaaggctcttcctgggaagctgagaaggggcatgcacagcgtgcagatgggtgtacagtggagagggccagctgacatattgagcagaggaccaaaatcgatgatctccttggctggtggcttaccaaatccaaacatgtttccttttaagactgccgtaatcactgtagaaaatggaaagaccatccaatttggagaagagatgatgaagagagcacttcagtattctccgagtgctggaattccagagcttttgtcctggctaaaacagttacaaataaaattgcataatcctcctaccatccattacccacccagtcaaggacaaatggatctatgtgtcacatctggcagccaacaaggtctttgtaaggtgtttgaaatgatcattaatcctggagataatgtcctcctagatgaacctgcttattcaggaactcttcaaagtctgcacccactgggctgcaacattattaatgttgccagtgatgaaagtgggattgttccagattccctaagagacatactttccagatggaaaccagaagatgcaaagaatccccagaaaaacacccccaaatttctttatactgttccaaatggcaacaaccctactggaaactcattaaccagtgaacgcaaaaaggaaatctatgagcttgcaagaaaatatgatttcctcataatagaag

SEQ ID NO: 106867 - DNA, 3590 bp, Homo sapiens
  Payload ID: 988
  Gene Symbol: AASDH
  Gene Name: aminoadipate-semialdehyde dehydrogenase
  Uniprot ID: Q4L235
  ENST ID: ENST00000205214
  CDS Start-End: 182-3478
ggaagatttacgtatggtgcctcgctctgggatagctttacggcttctgggagctgctgcttcgctgtgagaagtatccgcgacgagctatccgggaaagggccgaatgcgatcaaacctaatccgcgagacttgctaaggttctgtgctacaaattgatgtttagataaacttcagtgaaatgactcttcaggaattggtgcataaggctgcctcctgttatatggacagagtagctgtatgttttgatgaatgcaacaaccagcttccagtttactacacctacaagactgtggttaatgctgcttctgaattatcaaattttctgctgttacactgtgactttcaaggaattcgggaaattggtctctactgccaacctgggatagacttaccctcttggattttaggaattctccaagtcccggctgcttatgtacctatcgagccagattcaccaccgtcattatcaactcattttatgaaaaaatgtaatctaaagtatatccttgttgaaaaaaaacaaattaataaatttaaatcttttcatgaaacattattgaactatgatacatttacagtggaacataatgacctagtgctcttcagacttcactggaaaaatactgaggtgaacttgatgctaaatgatggaaaagagaaatatgaaaaagaaaaaataaaaagcataagttctgagcatgtcaatgaagaaaaagcagaagaacacatggatctgaggctaaagcattgcttagcctatgttctacatacatcagggactacagggataccgaagattgtcagagtgcctcataagtgtatagtaccaaatatccagcattttcgggtactttttgacatcacacaagaagatgttttgtttctggcttcacctctgaccttcgatccttctgttgtggaaatatttcttgctctatcaagtggtgcctctctgcttattgtaccaacttccgtcaagttgctcccatcaaaattagccagcgttctcttttcccatcatagagtgactgttttgcaggcaacaccaacattgcttagaagatttggatctcagcttatcaagtcaactgttttgtcagccactacttctcttcgagtattagcccttggtggtgaagcgtttccatcattgacagttctcagaagctggagaggagaaggcaataaaacacaaatatttaatgtttatggtatcacagaggtatcaagttgggcgaccatttataggattccagagaagactcttaactctactctcaaatgtgaattgcctgtacaactgggatttccacttcttggaacagtagttgaagtcagagatactaatggcttcacaattcaggaaggcagtggccaagtatttttaggtggcagaaacagagtgtgttttcttgatgatgaagtgacagtaccacttggcacaatgcgagctacaggagactttgtgactgtgaaagatggagagattttttttttgggacgaaaagacagtcagatcaaacgtcatggcaaacgtcttaacattgaacttgtgcaacaggttgctgaagagcttcagcaagtggagtcttgtgcagttacatggtataatcaggaaaaattaattctcttcatggtgtctaaagatgcttcagtaaaagaatacatctttaaagaactgcagaaatatcttccaagtcatgcagtcccggatgagcttgtattgatcgactctctaccatttacatcccacggcaaaattgatgtttctgagttaaacaagatatatttaaactacataaacttgaagtctgagaataagctcagtgggaaagaggacctttgggaaaaattacagtatttgtggaagtctactctgaatctcccagaagatcttttgagggttcctgatgagtcactcttcttaaatagtggtggagattccttaaagtccatccggctcctcagtgagattgaaaaacttgttggtacatcagtacctgggcttctggaaattattctcagcagttccattttagagatttataatcacatccttcaaacagtggttccagatgaagatgtgacattcaggaagagttgtgccacaaaaaggaaactcagcgacattaatcaagaggaagccagtggaacatctttacatcagaaagccatcatgactttcacttgccacaatgagattaatgcttttgttgtactgagcagagggagtcaaattttgtctctgaattccactaggtttttaacaaagttaggacattgctcttcagcctgtccttctgactcagtttcacagaccaacattcaaaatttgaaaggcttaaattctccagttcttattgggaagtcaaaagatccatcctgtgttgcaaaagtttctgaagaggggaaacctgcgatagggactcagaaaatggagttacatgtgaggtggaggtcagacacaggcaaatgtgtagatgcttcaccgctggttgtaatacccacttttgataagtcatctacaactgtgtacattggttcccattctcatagaatgaaggcagttgacttttactctgggaaggtaaaatgggaacagattttgggagatcgaattgaatcctcagcatgtgtatctaagtgtggaaactttattgtggtgggctgttataatggattagtttatgttctgaaaagtaatagtggagaaaaatactggatgtttactactgaagatgctgtcaaaagctcggcaaccatggatccaaccacaggactcatttacattggatctcatgaccagcacgcatatgctttagatatttatagaaagaagtgtgtttggaagtcaaaatgtggaggaactgtcttttcctctccgtgtttgaacctgattccacatcatttgtattttgctacattgggaggacttttactggctgtaaatcctgctactgggaacgttatttggaaacattcctgtggaaaaccactcttctcttccccacaatgttgctcacagtatatttgtattggctgtgtagatgggaatttactctgctttactcactttggagaacaggtttggcagttctctaccagtggaccaatcttttcatccccgtgtacctcaccatcagagcaaaaaatattttttggttcccatgattgctttatctactgttgtaacatgaaaggtcacctgcagtggaaatttgaaactacttcaagggtctatgcaacaccgtttgctttccataactacaatggcagcaatgaaatgttgctggcagcagcatctactgatgggaaagtgtggatcttggaatctcagagtggacaattgcaaagtgtttatgaacttcctggagaagtcttctcttctcctgtggtcctggaatcaatgctcattattgggtgtagagataattatgtttattgtctggatttattgggtggcaatcaaaaataatcaaatacagtccttatttgtataacaaatgtgagatatttgaaaatattttaccattatacatcatgtggacttattttatattaaagaagattatattttggctaagaaa

SEQ ID NO: 106868 - DNA, 3182 bp, Homo sapiens
  Payload ID: 988
  Gene Symbol: AASDH
  Gene Name: aminoadipate-semialdehyde dehydrogenase
  Uniprot ID: Q4L235
  ENST ID: ENST00000451613
  CDS Start-End: 190-2763
agcgacgcggaagatttacgtatggtgcctcgctctgggatagctttacggcttctgggagctgctgcttcgctgtgagaagtatccgcgacgagctatccgggaaagggccgaatgcgatcaaacctaatccgcgagacttgctaaggttctgtgctacaaattgatgtttagataaacttcagtgaaatgactcttcaggaattggtgcataaggctgcctcctgttatatggacagagtagctgtatgttttgatgaatgcaacaaccagcttccagtttactacacctacaagactgtggttaatgctgcttctgaattatcaaattttctgctgttacactgtgactttcaaggaattcgggaaattggtctctactgccaacctgggatagacttaccctcttggattttaggaattctccaagtcccggctgcttatgtacctatcgagccagattcaccaccgtcattatcaactcattttatgaaaaaatgtaatctaaagtatatccttgttgaaaaaaaacaaattaataaatttaaatcttttcatgaaacattattgaactatgatacatttacagtggaacataatgacctagtgctcttcagacttcactggaaaaatactgaggtgaacttgatgctaaatgatggaaaagagaaatatgaaaaagaaaaaataaaaagcataagttctgagcatgtcaatgaagaaaaagcagaagaacacatggatctgaggctaaagcattgcttagcctatgttctacatacatcagggactacagggataccgaagattgtcagagtgcctcataagtgtatagtaccaaatatccagcattttcgggtactttttgacatcacacaagaagatgttttgtttctggcttcacctctgaccttcgatccttctgttgtggaaatatttcttgctctatcaagtggtgcctctctgcttattgtaccaacttccgtcaagttgctcccatcaaaattagccagcgttctcttttcccatcatagagtgactgttttgcaggcaacaccaacattgcttagaagatttggatctcagcttatcaagtcaactgttttgtcagccactacttctcttcgagtattagcccttggtggtgaagcgtttccatcattgacagttctcagaagctggagaggagaaggcaataaaacacaaatatttaatgtttatggtatcacagaggtatcaagttgggcgaccatttataggattccagagaagactcttaactctactctcaaatgtgaattgcctgtacaactgggatttccacttcttggaacagtagttgaagtcagagatactaatggcttcacaattcaggaaggcagtggccaagtatttttaggtggcagaaacagagtgtgttttcttgatgatgaagtgacagtaccacttggcacaatgcgagctacaggagactttgtgactgtgaaagatggagagattttttttttgggacgaaaagacagtcagatcaaacgtcatggcaaacgtcttaacattgaacttgtgcaacaggttgctgaagagcttcagcaagtggagtcttgtgcagttacatggtataatcaggaaaaattaattctcttcatggtgtctaaagatgcttcagtaaaagaatacatctttaaagaactgcagaaatatcttccaagtcatgcagtcccggatgagcttgtattgatcgactctctaccatttacatcccacggcaaaattgatgtttctgagttaaacaagatatatttaaactacataaacttgaagtctgagaataagctcagtgggaaagaggacctttgggaaaaattacagtatttgtggaagtctactctgaatctcccagaagatcttttgagggttcctgatgagtcactcttcttaaatagtggtggagattccttaaagtccatccggctcctcagtgagattgaaaaacttgttggtacatcagtacctgggcttctggaaattattctcagcagttccattttagagatttataatcacatccttcaaacagtggttccagatgaagatgtgacattcaggaagagttgtgccacaaaaaggaaactcagcgacattaatcaagaggaagccagtggaacatctttacatcagaaagccatcatgactttcacttgccacaatgagattaatgcttttgttgtactgagcagagggagtcaaattttgtctctgaattccactaggtttttaacaaagttaggacattgctcttcagcctgtccttctgactcagtttcacagaccaacattcaaaatttgaaaggcttaaattctccagttcttattgggaagtcaaaagatccatcctgtgttgcaaaagtttctgaagaggggaaacctgcgatagggactcagaaaatggagttacatgtgaggtggaggtcagacacaggcaaatgtgtagatgcttcaccgctggttgtaatacccacttttgataagtcatctacaactgtgtacattggttcccattctcatagaatgaaggcagttgacttttactctgggaaggtaaaatgggaacagattttgggagatcgaattgaatcctcagcatgtgtatctaagtgtggaaactttattgtggtgggtttggcagttctctaccagtggaccaatcttttcatccccgtgtacctcaccatcagagcaaaaaatattttttggttcccatgattgctttatctactgttgtaacatgaaaggtcacctgcagtggaaatttgaaactacttcaagggtctatgcaacaccgtttgctttccataactacaatggcagcaatgaaatgttgctggcagcagcatctactgatgggaaagtgtggatcttggaatctcagagtggacaattgcaaagtgtttatgaacttcctggagaagtcttctcttctcctgtggtcctggaatcaatgctcattattgggtgtagagataattatgtttattgtctggatttattgggtggcaatcaaaaataatcaaatacagtccttatttgtataacaaatgtgagatatttgaaaatattttaccattatacatcatgtggacttattttatattaaagaagattatattttggctaagaaacgg

SEQ ID NO: 106869 - DNA, 3004 bp, Homo sapiens
  Payload ID: 988
  Gene Symbol: AASDH
  Gene Name: aminoadipate-semialdehyde dehydrogenase
  Uniprot ID: Q4L235
  ENST ID: ENST00000502617
  CDS Start-End: 182-2707
ggaagatttacgtatggtgcctcgctctgggatagctttacggcttctgggagctgctgcttcgctgtgagaagtatccgcgacgagctatccgggaaagggccgaatgcgatcaaacctaatccgcgagacttgctaaggttctgtgctacaaattgatgtttagataaacttcagtgaaatgactcttcaggaattggtgcataaggctgcctcctgttatatggacagagtagctgtatgttttgatgaatgcaacaaccagcttccagtttactacacctacaagactgtggttaatgctgcttctgaattatcaaattttctgctgttacactgtgactttcaaggaattcgggaaattggtctctactgccaacctgggatagacttaccctcttggattttaggaattctccaagtcccggctgcttatgtacctatcgagccagattcaccaccgtcattatcaactcattttatgaaaaaatgtaatctaaagtatatccttgttgaaaaaaaacaaattaataaatttaaatcttttcatgaaacattattgaactatgatacatttacagtggaacataatgacctagtgctcttcagacttcactggaaaaatactgaggtgaacttgatgctaaatgatggaaaagagaaatatgaaaaagaaaaaataaaaagcataagttctgagcatgtcaatgaagaaaaagcagaagaacacatggatctgaggctaaagcattgcttagcctatgttctacatacatcagggactacagggataccgaagattgtcagagtgcctcataagtgtatagtaccaaatatccagcattttcgggtactttttgacatcacacaagaagatgttttgtttctggcttcacctctgaccttcgatccttctgttgtggaaatatttcttgctctatcaagtggtgcctctctgcttattgtaccaacttccgtcaagttgctcccatcaaaattagccagcgttctcttttcccatcatagagtgactgttttgcaggcaacaccaacattgcttagaagatttggatctcagcttatcaagtcaactgttttgtcagccactacttctcttcgagtattagcccttggtggtgaagcgtttccatcattgacagttctcagaagctggagaggagaaggcaataaaacacaaatatttaatgtttatggtatcacagaggtatcaagttgggcgaccatttataggattccagagaagactcttaactctactctcaaatgtgaattgcctgtacaactgggatttccacttcttggaacagtagttgaagtcagagatactaatggcttcacaattcaggaaggcagtggccaagtatttttaggtggcagaaacagagtgtgttttcttgatgatgaagtgacagtaccacttggcacaatgcgagctacaggagactttgtgactgtgaaagatggagagattttttttttgggacgaaaagacagtcagatcaaacgtcatggcaaacgtcttaacattgaacttgtgcaacaggttgctgaagagcttcagcaagtggagtcttgtgcagttacatggtataatcaggaaaaattaattctcttcatggtgtctaaagatgcttcagtaaaagaatacatctttaaagaactgcagaaatatcttccaagtcatgcagtcccggatgagcttgtattgatcgactctctaccatttacatcccacggcaaaattgatgtttctgagttaaacaagatatatttaaactacataaacttgaagtctgagaataagctcagtgggaaagaggacctttgggaaaaattacagtatttgtggaagtctactctgaatctcccagaagatcttttgagggttcctgatgagtcactcttcttaaatagtggtggagattccttaaagtccatccggctcctcagtgagattgaaaaacttgttggtacatcagtacctgggcttctggaaattattctcagcagttccattttagagatttataatcacatccttcaaacagtggttccagatgaagatgtgacattcaggaagagttgtgccacaaaaaggaaactcagcgacattaatcaagaggaagccagtggaacatctttacatcagaaagccatcatgactttcacttgccacaatgagattaatgcttttgttgtactgagcagagggagtcaaattttgtctctgaattccactaggtttttaacaaagttaggacattgctcttcagcctgtccttctgactcagtttcacagaccaacattcaaaatttgaaaggcttaaattctccagttcttattgggaagtcaaaagatccatcctgtgttgcaaaagtttctgaagaggggaaacctgcgatagggactcagaaaatggagttacatgtgaggtggaggtcagacacaggcaaatgtgtagatgcttcaccgctggttgtaatacccacttttgataagtcatctacaactgtgtacattggttcccattctcatagaatgaaggcagttgacttttactctgggaaggtaaaatgggaacagattttgggagatcgaattgaatcctcagcatgtgtatctaagtgtggaaactttattgtggtgggtaagtttttgaatttgaggtttgtggagttaaattgaattaccatacaataatcttcataggcccaagttaaattttttaaaaatctaaatatgatgggtttggttgctgtccaaaaattatagttaaccctgtgctgattaatattgtgggccttggggtcaagagtccctggatttgaacctacctgtatagctattatgaactctgtgacctttggcaagttactgaacctcttagaatttcactttccttgtgggtaaaatgggaataataataaaatgtgttgctgtatcacaaataccccaaaactcaacaacctagaacaacacaaa

SEQ ID NO: 106870 - DNA, 2949 bp, Homo sapiens
  Payload ID: 988
  Gene Symbol: AASDH
  Gene Name: aminoadipate-semialdehyde dehydrogenase
  ENST ID: ENST00000503808
  CDS Start-End: 141-401
ggcttctgggagctgctgcttcgctgtgagaagtatccgcgacgagctatccgggaaagggccgaatgcgatcaaacctaatccgcgagacttgctaaggttctgtgctacaaattgatgtttagataaacttcagtgaaatgactcttcaggaattggtgcataaggctgcctcctgttatatggacagagtagctgtatgttttgatgaatgcaacaaccagcttccagtttactacacctacaagactgtggttaatgctgcttctgaattatcaaattttctgctgttacactgtgactttcaaggaattcgggaaattggtctctactgccaacctgggatagacttaccctcttggattttaggaaatttaaatcttttcatgaaacattattgaactatgatacatttacagtggaacataatgacctagtgctcttcagacttcactggaaaaatactgaggtgaacttgatgctaaatgatggaaaagagaaatatgaaaaagaaaaaataaaaagcataagttctgagcatgtcaatgaagaaaaagcagaagaacacatggatctgaggctaaagcattgcttagcctatgttctacatacatcagggactacagggataccgaagattgtcagagtgcctcataagtgtatagtaccaaatatccagcattttcgggtactttttgacatcacacaagaagatgttttgtttctggcttcacctctgaccttcgatccttctgttgtggaaatatttcttgctctatcaagtggtgcctctctgcttattgtaccaacttccgtcaagttgctcccatcaaaattagccagcgttctcttttcccatcatagagtgactgttttgcaggcaacaccaacattgcttagaagatttggatctcagcttatcaagtcaactgttttgtcagccactacttctcttcgagtattagcccttggtggtgaagcgtttccatcattgacagttctcagaagctggagaggagaaggcaataaaacacaaatatttaatgtttatggtatcacagaggtatcaagttgggcgaccatttataggattccagagaagactcttaactctactctcaaatgtgaattgcctgtacaactgggatttccacttcttggaacagtagttgaagtcagagatactaatggcttcacaattcaggaaggcagtggccaagtatttttaggtggcagaaacagagtgtgttttcttgatgatgaagtgacagtaccacttggcacaatgcgagctacaggagactttgtgactgtgaaagatggagagattttttttttgggacgaaaagacagtcagatcaaacgtcatggcaaacgtcttaacattgaacttgtgcaacaggttgctgaagagcttcagcaagtggagtcttgtgcagttacatggtataatcaggaaaaattaattctcttcatggtgtctaaagatgcttcagtaaaagaatacatctttaaagaactgcagaaatatcttccaagtcatgcagtcccggatgagcttgtattgatcgactctctaccatttacatcccacggcaaaattgatgtttctgagttaaacaagatatatttaaactacataaacttgaagtctgagaataagctcagtgggaaagaggacctttgggaaaaattacagtatttgtggaagtctactctgaatctcccagaagatcttttgagggttcctgatgagtcactcttcttaaatagtggtggagattccttaaagtccatccggctcctcagtgagattgaaaaacttgttggtacatcagtacctgggcttctggaaattattctcagcagttccattttagagatttataatcacatccttcaaacagtggttccagatgaagatgtgacattcaggaagagttgtgccacaaaaaggaaactcagcgacattaatcaagaggaagccagtggaacatctttacatcagaaagccatcatgactttcacttgccacaatgagattaatgcttttgttgtactgagcagagggagtcaaattttgtctctgaattccactaggtttttaacaaagttaggacattgctcttcagcctgtccttctgactcagtttcacagaccaacattcaaaatttgaaaggcttaaattctccagttcttattgggaagtcaaaagatccatcctgtgttgcaaaagtttctgaagaggggaaacctgcgatagggactcagaaaatggagttacatgtgaggtggaggtcagacacaggcaaatgtgtagatgcttcaccgctggttgtaatacccacttttgataagtcatctacaactgtgtacattggttcccattctcatagaatgaaggcagttgacttttactctgggaaggtaaaatgggaacagattttgggagatcgaattgaatcctcagcatgtgtatctaagtgtggaaactttattgtggtggagaaagaagtgtgtttggaagtcaaaatgtggaggaactgtcttttcctctccgtgtttgaacctgattccacatcatttgtattttgctacattgggaggacttttactggctgtaaatcctgctactgggaacgttatttggaaacattcctgtggaaaaccactcttctcttccccacaatgttgctcacagtatatttgtattggctgtgtagatgggaatttactctgctttactcactttggagaacaggtttggcagttctctaccagtggaccaatcttttcatccccgtgtacctcaccatcagagcaaaaaatattttttggttcccatgattgctttatctactgttgtaacatgaaaggtcacctgcagtggaaatttgaaactacttcaagggtctatgcaacaccgtttgctttccataactacaatg

SEQ ID NO: 106871 - DNA, 3241 bp, Homo sapiens
  Payload ID: 988
  Gene Symbol: AASDH
  Gene Name: aminoadipate-semialdehyde dehydrogenase
  Uniprot ID: Q4L235
  ENST ID: ENST00000513376
  CDS Start-End: 133-3129
ccgcgacgagctatccgggaaagggccgaatgcgatcaaacctaatccgcgagacttgctaaaattctccaagtcccggctgcttatgtacctatcgagccagattcaccaccgtcattatcaactcattttatgaaaaaatgtaatctaaagtatatccttgttgaaaaaaaacaaattaataaatttaaatcttttcatgaaacattattgaactatgatacatttacagtggaacataatgacctagtgctcttcagacttcactggaaaaatactgaggtgaacttgatgctaaatgatggaaaagagaaatatgaaaaagaaaaaataaaaagcataagttctgagcatgtcaatgaagaaaaagcagaagaacacatggatctgaggctaaagcattgcttagcctatgttctacatacatcagggactacagggataccgaagattgtcagagtgcctcataagtgtatagtaccaaatatccagcattttcgggtactttttgacatcacacaagaagatgttttgtttctggcttcacctctgaccttcgatccttctgttgtggaaatatttcttgctctatcaagtggtgcctctctgcttattgtaccaacttccgtcaagttgctcccatcaaaattagccagcgttctcttttcccatcatagagtgactgttttgcaggcaacaccaacattgcttagaagatttggatctcagcttatcaagtcaactgttttgtcagccactacttctcttcgagtattagcccttggtggtgaagcgtttccatcattgacagttctcagaagctggagaggagaaggcaataaaacacaaatatttaatgtttatggtatcacagaggtatcaagttgggcgaccatttataggattccagagaagactcttaactctactctcaaatgtgaattgcctgtacaactgggatttccacttcttggaacagtagttgaagtcagagatactaatggcttcacaattcaggaaggcagtggccaagtatttttaggtggcagaaacagagtgtgttttcttgatgatgaagtgacagtaccacttggcacaatgcgagctacaggagactttgtgactgtgaaagatggagagattttttttttgggacgaaaagacagtcagatcaaacgtcatggcaaacgtcttaacattgaacttgtgcaacaggttgctgaagagcttcagcaagtggagtcttgtgcagttacatggtataatcaggaaaaattaattctcttcatggtgtctaaagatgcttcagtaaaagaatacatctttaaagaactgcagaaatatcttccaagtcatgcagtcccggatgagcttgtattgatcgactctctaccatttacatcccacggcaaaattgatgtttctgagttaaacaagatatatttaaactacataaacttgaagtctgagaataagctcagtgggaaagaggacctttgggaaaaattacagtatttgtggaagtctactctgaatctcccagaagatcttttgagggttcctgatgagtcactcttcttaaatagtggtggagattccttaaagtccatccggctcctcagtgagattgaaaaacttgttggtacatcagtacctgggcttctggaaattattctcagcagttccattttagagatttataatcacatccttcaaacagtggttccagatgaagatgtgacattcaggaagagttgtgccacaaaaaggaaactcagcgacattaatcaagaggaagccagtggaacatctttacatcagaaagccatcatgactttcacttgccacaatgagattaatgcttttgttgtactgagcagagggagtcaaattttgtctctgaattccactaggtttttaacaaagttaggacattgctcttcagcctgtccttctgactcagtttcacagaccaacattcaaaatttgaaaggcttaaattctccagttcttattgggaagtcaaaagatccatcctgtgttgcaaaagtttctgaagaggggaaacctgcgatagggactcagaaaatggagttacatgtgaggtggaggtcagacacaggcaaatgtgtagatgcttcaccgctggttgtaatacccacttttgataagtcatctacaactgtgtacattggttcccattctcatagaatgaaggcagttgacttttactctgggaaggtaaaatgggaacagattttgggagatcgaattgaatcctcagcatgtgtatctaagtgtggaaactttattgtggtgggctgttataatggattagtttatgttctgaaaagtaatagtggagaaaaatactggatgtttactactgaagatgctgtcaaaagctcggcaaccatggatccaaccacaggactcatttacattggatctcatgaccagcacgcatatgctttagatatttatagaaagaagtgtgtttggaagtcaaaatgtggaggaactgtcttttcctctccgtgtttgaacctgattccacatcatttgtattttgctacattgggaggacttttactggctgtaaatcctgctactgggaacgttatttggaaacattcctgtggaaaaccactcttctcttccccacaatgttgctcacagtatatttgtattggctgtgtagatgggaatttactctgctttactcactttggagaacaggtttggcagttctctaccagtggaccaatcttttcatccccgtgtacctcaccatcagagcaaaaaatattttttggttcccatgattgctttatctactgttgtaacatgaaaggtcacctgcagtggaaatttgaaactacttcaagggtctatgcaacaccgtttgctttccataactacaatggcagcaatgaaatgttgctggcagcagcatctactgatgggaaagtgtggatcttggaatctcagagtggacaattgcaaagtgtttatgaacttcctggagaagtcttctcttctcctgtggtcctggaatcaatgctcattattgggtgtagagataattatgtttattgtctggatttattgggtggcaatcaaaaataatcaaatacagtccttatttgtataacaaatgtgagatatttgaaaatattttaccattatacatcatgtggacttattttatattaaagaagattatattttggctaagaaa

SEQ ID NO: 106872 - DNA, 2959 bp, Homo sapiens
  Payload ID: 988
  Gene Symbol: AASDH
  Gene Name: aminoadipate-semialdehyde dehydrogenase
  ENST ID: ENST00000514745
  CDS Start-End: 151-513
atagctttacggcttctgggagctgctgcttcgctgtgagaagtatccgcgacgagctatccgggaaagggccgaatgcgatcaaacctaatccgcgagacttgctaaggttctgtgctacaaattgatgtttagataaacttcagtgaaatgactcttcaggaattggtgcataaggctgcctcctgttatatggacagagtagctgtatgttttgatgaatgcaacaaccagcttccagtttactacacctacaagactgtggttaatgctgcttctgaattatcaaattttctgctgttacactgtgactttcaaggaattcgggaaattggtctctactgccaacctgggatagacttaccctcttggattttaggaattctccaagtcccggctgcttatgtacctatcgagccagattcaccaccgtcattatcaactcattttatgaaaaaatgtaatctaaagtatatccttgttgaaaaaaaacaaattaatggtactttttgacatcacacaagaagatgttttgtttctggcttcacctctgaccttcgatccttctgttgtggaaatatttcttgctctatcaagtggtgcctctctgcttattgtaccaacttccgtcaagttgctcccatcaaaattagccagcgttctcttttcccatcatagagtgactgttttgcaggcaacaccaacattgcttagaagatttggatctcagcttatcaagtcaactgttttgtcagccactacttctcttcgagtattagcccttggtggtgaagcgtttccatcattgacagttctcagaagctggagaggagaaggcaataaaacacaaatatttaatgtttatggtatcacagaggtatcaagttgggcgaccatttataggattccagagaagactcttaactctactctcaagttgctgaagagcttcagcaagtggagtcttgtgcagttacatggtataatcaggaaaaattaattctcttcatggtgtctaaagatgcttcagtaaaagaatacatctttaaagaactgcagaaatatcttccaagtcatgcagtcccggatgagcttgtattgatcgactctctaccatttacatcccacggcaaaattgatgtttctgagttaaacaagatatatttaaactacataaacttgaagtctgagaataagctcagtgggaaagaggacctttgggaaaaattacagtatttgtggaagtctactctgaatctcccagaagatcttttgagggttcctgatgagtcactcttcttaaatagtggtggagattccttaaagtccatccggctcctcagtgagattgaaaaacttgttggtacatcagtacctgggcttctggaaattattctcagcagttccattttagagatttataatcacatccttcaaacagtggttccagatgaagatgtgacattcaggaagagttgtgccacaaaaaggaaactcagcgacattaatcaagaggaagccagtggaacatctttacatcagaaagccatcatgactttcacttgccacaatgagattaatgcttttgttgtactgagcagagggagtcaaattttgtctctgaattccactaggtttttaacaaagttaggacattgctcttcagcctgtccttctgactcagtttcacagaccaacattcaaaatttgaaaggcttaaattctccagttcttattgggaagtcaaaagatccatcctgtgttgcaaaagtttctgaagaggggaaacctgcgatagggactcagaaaatggagttacatgtgaggtggaggtcagacacaggcaaatgtgtagatgcttcaccgctggttgtaatacccacttttgataagtcatctacaactgtgtacattggttcccattctcatagaatgaaggcagttgacttttactctgggaaggtaaaatgggaacagattttgggagatcgaattgaatcctcagcatgtgtatctaagtgtggaaactttattgtggtgggctgttataatggattagtttatgttctgaaaagtaatagtggagaaaaatactggatgtttactactgaagatgctgtcaaaagctcggcaaccatggatccaaccacaggactcatttacattggatctcatgaccagcacgcatatgctttagatatttatagaaagaagtgtgtttggaagtcaaaatgtggaggaactgtcttttcctctccgtgtttgaacctgattccacatcatttgtattttgctacattgggaggacttttactggctgtaaatcctgctactgggaacgttatttggaaacattcctgtggaaaaccactcttctcttccccacaatgttgctcacagtatatttgtattggctgtgtagatgggaatttactctgctttactcactttggagaacaggtttggcagttctctaccagtggaccaatcttttcatccccgtgtacctcaccatcagagcaaaaaatattttttggttcccatgattgctttatctactgttgtaacatgaaaggtcacctgcagtggaaatttgaaactacttcaagggtctatgcaacaccgtttgctttccataactacaatggcagcaatgaaatgttgctggcagcagcatctactgatgggaaagtgtggatcttggaatctcagagtggacaattgcaaagtgtttatgaacttcctggagaagtcttctcttctcctgtggtcctggaatcaatgctcattattgggtgtagagataattatgtttattgtctggatttattgggtggcaatcaaaaataatcaaatacagtccttatttgtataacaaatgtgagatatttgaaaatattttaccattatacatcatgtggacttattttatattaaagaagattatattttggctaag

SEQ ID NO: 106873 - DNA, 3480 bp, Homo sapiens
  Payload ID: 988
  Gene Symbol: AASDH
  Gene Name: aminoadipate-semialdehyde dehydrogenase
  ENST ID: ENST00000602986
  CDS Start-End: 528-3365
agcgacgcggaagatttacgtatggtgcctcgctctgggatagctttacggcttctgggagctgctgcttcgctgtgagaagtatccgcgacgagctatccgggaaagggccgaatgcgatcaaacctaatccgcgagacttgctaaggttctgtgctacaaattgatgtttagataaacttcagtgaaatgactcttcaggaattggtgcataaggctgcctcctgttatatggacagagtagctgtatgttttgatgaatgcaacaaccagcttccagtttactacacctacaagactgtggttaatgctgcttctgaattatcaaattttctgctgttacactgtgactttcaaggaattcgggaaattggtctctactgccaacctgggatagacttaccctcttggattttaggaaatttaaatcttttcatgaaacattattgaactatgatacatttacagtggaacataatgacctagtgctcttcagacttcactggaaaaatactgaggtgaacttgatgctaaatgatggaaaagagaaatatgaaaaagaaaaaataaaaagcataagttctgagcatgtcaatgaagaaaaagcagaagaacacatggatctgaggctaaagcattgcttagcctatgttctacatacatcagggactacagggataccgaagattgtcagagtgcctcataagtgtatagtaccaaatatccagcattttcgggtactttttgacatcacacaagaagatgttttgtttctggcttcacctctgaccttcgatccttctgttgtggaaatatttcttgctctatcaagtggtgcctctctgcttattgtaccaacttccgtcaagttgctcccatcaaaattagccagcgttctcttttcccatcatagagtgactgttttgcaggcaacaccaacattgcttagaagatttggatctcagcttatcaagtcaactgttttgtcagccactacttctcttcgagtattagcccttggtggtgaagcgtttccatcattgacagttctcagaagctggagaggagaaggcaataaaacacaaatatttaatgtttatggtatcacagaggtatcaagttgggcgaccatttataggattccagagaagactcttaactctactctcaaatgtgaattgcctgtacaactgggatttccacttcttggaacagtagttgaagtcagagatactaatggcttcacaattcaggaaggcagtggccaagtatttttaggtggcagaaacagagtgtgttttcttgatgatgaagtgacagtaccacttggcacaatgcgagctacaggagactttgtgactgtgaaagatggagagattttttttttgggacgaaaagacagtcagatcaaacgtcatggcaaacgtcttaacattgaacttgtgcaacaggttgctgaagagcttcagcaagtggagtcttgtgcagttacatggtataatcaggaaaaattaattctcttcatggtgtctaaagatgcttcagtaaaagaatacatctttaaagaactgcagaaatatcttccaagtcatgcagtcccggatgagcttgtattgatcgactctctaccatttacatcccacggcaaaattgatgtttctgagttaaacaagatatatttaaactacataaacttgaagtctgagaataagctcagtgggaaagaggacctttgggaaaaattacagtatttgtggaagtctactctgaatctcccagaagatcttttgagggttcctgatgagtcactcttcttaaatagtggtggagattccttaaagtccatccggctcctcagtgagattgaaaaacttgttggtacatcagtacctgggcttctggaaattattctcagcagttccattttagagatttataatcacatccttcaaacagtggttccagatgaagatgtgacattcaggaagagttgtgccacaaaaaggaaactcagcgacattaatcaagaggaagccagtggaacatctttacatcagaaagccatcatgactttcacttgccacaatgagattaatgcttttgttgtactgagcagagggagtcaaattttgtctctgaattccactaggtttttaacaaagttaggacattgctcttcagcctgtccttctgactcagtttcacagaccaacattcaaaatttgaaaggcttaaattctccagttcttattgggaagtcaaaagatccatcctgtgttgcaaaagtttctgaagaggggaaacctgcgatagggactcagaaaatggagttacatgtgaggtggaggtcagacacaggcaaatgtgtagatgcttcaccgctggttgtaatacccacttttgataagtcatctacaactgtgtacattggttcccattctcatagaatgaaggcagttgacttttactctgggaaggtaaaatgggaacagattttgggagatcgaattgaatcctcagcatgtgtatctaagtgtggaaactttattgtggtgggctgttataatggattagtttatgttctgaaaagtaatagtggagaaaaatactggatgtttactactgaagatgctgtcaaaagctcggcaaccatggatccaaccacaggactcatttacattggatctcatgaccagcacgcatatgctttagatatttatagaaagaagtgtgtttggaagtcaaaatgtggaggaactgtcttttcctctccgtgtttgaacctgattccacatcatttgtattttgctacattgggaggacttttactggctgtaaatcctgctactgggaacgttatttggaaacattcctgtggaaaaccactcttctcttccccacaatgttgctcacagtatatttgtattggctgtgtagatgggaatttactctgctttactcactttggagaacaggtttggcagttctctaccagtggaccaatcttttcatccccgtgtacctcaccatcagagcaaaaaatattttttggttcccatgattgctttatctactgttgtaacatgaaaggtcacctgcagtggaaatttgaaactacttcaagggtctatgcaacaccgtttgctttccataactacaatggcagcaatgaaatgttgctggcagcagcatctactgatgggaaagtgtggatcttggaatctcagagtggacaattgcaaagtgtttatgaacttcctggagaagtcttctcttctcctgtggtcctggaatcaatgctcattattgggtgtagagataattatgtttattgtctggatttattgggtggcaatcaaaaataatcaaatacagtccttatttgtataacaaatgtgagatatttgaaaatattttaccattatacatcatgtggacttattttatattaaagaagattatattttggctaagaaacgg

SEQ ID NO: 106874 - DNA, 2955 bp, Homo sapiens
  Payload ID: 989
  Gene Symbol: AASDHPPT
  Gene Name: aminoadipate-semialdehyde dehydrogenase-phosphopantetheinyl transferase
  Uniprot ID: Q9NRN7
  ENST ID: ENST00000278618
  CDS Start-End: 223-1152
atacaatgccgcaaagcgcagggctgatctccgtctccgcccccagctgctttctccgagaggaggtggctgagtcgggggcgggctgggagggctgtcggtgggccagtctgcgtagcgacggcccgtcccctgcgcacggacgccgggaagaagggggtggggccacgtttgcgtccgcgccatcaggcccgagatagcggcgaggtccgctttcagtgtatggttttccctgccaaacggttctgcttggtgccatccatggagggcgtgcgctgggccttttcctgcggcacttggctgccgagccgagccgaatggctgctggcagtgcgatcgattcagcccgaggagaaggagcgcattggccagttcgtctttgcccgggacgctaaggcagccatggctggtcgtctgatgataaggaaattagttgcagagaaattgaatatcccttggaatcatattcgtttgcaaagaactgcaaaaggaaaaccagttcttgcaaaggactcatcgaatccttacccgaatttcaactttaacatctctcatcaaggagactatgcagtgcttgctgctgaacctgagctgcaagttggaattgatataatgaagactagttttccaggtcgtggttcaattccagaattctttcatattatgaaaagaaagtttaccaacaaagaatgggaaacaatcagaagctttaaggatgagtggactcagctggatatgttttataggaattgggcacttaaggaaagcttcataaaagccattggtgttggactaggatttgaattgcagcggcttgaatttgatctatctccattaaacttggatataggccaagtttataaagaaacacgtttattcctggatggagaggaagaaaaagaatgggcatttgaggaaagcaaaatagatgagcaccattttgttgcagttgctcttaggaaacccgatggatctagacatcaggatgttccatctcaggatgattccaaaccaacccagaggcaatttactattctcaactttaatgatttaatgtcatctgccgttcccatgacacctgaagatccttcattttgggactgtttttgcttcacagaagaaattccaatacgaaatggtacaaagtcatgatgattccctgagtaacaaagggaaatgaaaactgtttgtgatcttccgtattcactgaaaaataaatgcttgtttagtatcaaattttatttcacgaaagtttttttaaagaacagaaacttttccaattaaaaaaaaaaagcagacttctggttcaagatagctcactggaatacatgtttacctctttctttcctaaattgcattgaattgataggaaggatggcggaatcttaaagtgatacatgctaactgtagaaaaaaatagaaaatgcacataagcaaaaggaaacatttaaatgctatctttcaaagataactactcttaaaaccttgagtatcttttcagacctttttcttggcaaatgaatccatattgacatatttgatttttttaaaaacatggaaacgtactgttttgtaaattctttttaactgcacatctactgttcataaatatacctctgtaacataactttttgtggttctaatgtactctgttgtatagctaatacaagttaggatgcttttggccagaggtaacagtgtccaaatataattggcctaagtaacctaggaaattgtttgacataacacagggttcaggggtgtcattaaagacacactttttttgccttgacctcagttggtttgttttgccttaggctattccacctctcgatcacaagagctgctgctataacttccagttttacatctttgtaaaattgtatctcaaaggcagaaaaggccatttcgtctctcatttgttttatccatgaggaagatttttaacaaaagcctccagaagatttcccctcagtttccattgacttagatcaggttacagagaaaggcaatgtctgacatttttggtctctgttagaagtagactctgttgaaaagaaagaagctaagctaggtgtgaagaatggaattggaagcccactgccttcccataagaaaggtttaccataatttactcacttttttctgtgttagacattttgattatctgcagtttattactacaagcagtggcagagtgaatgtccttgtacattttgagttacatgcttaattatgtccttgagaaagtttctaaaagtggaatgattggtttgactggttcatagggctttaattatacaatttacccctctaattagtactatatgtatgtgacttccctccccctgccagaatactccttggtcaattgtaggtattctttttggtttaatttttgccaatgtaattaaaaaatggtatgtcatttttaaaatttgtatttctttcattacaaataagattgttatgtcagtattgttattggcttttcgtattcctcttaacgtgaaccgtctgttcattgtttttacctgttttcgttttagcaagtagtacttaatttaaagtgtgaacttaatatataagatgccaggaccatcatattgatgacaaaaatctattatgtggttgtagtgcatgtcttggagttaaactcttaagtatcaagaagtaaaataatttcattgtttctgttactaacattaaaagtgtgcaaattgtataaaattaggtacttcgattagtaaaagaaaaaaatttgaatgttttttttttttattttattaagcatgcccagttatgccaagcatagtaaataaaggtcaagtagcatttataatagaggaagtattgttatccctagcatgagtgtaatggtgatatgaaaaactttgtcttgtcattataataataaaaaaatgaacatttattatggaatttctatgagcctga

SEQ ID NO: 106875 - DNA, 629 bp, Homo sapiens
  Payload ID: 989
  Gene Symbol: AASDHPPT
  Gene Name: aminoadipate-semialdehyde dehydrogenase-phosphopantetheinyl transferase
  ENST ID: ENST00000524411
  CDS Start-End: 60-629
gcagctggtaagcagattttcaacatggcagctgacacaggcttttggctggtcgtctgatgataaggaaattagttgcagagaaattgaatatcccttggaatcatattcgtttgcaaagaactgcaaaaggaaaaccagttcttgcaaaggactcatcgaatccttacccgaatttcaactttaacatctctcatcaaggagactatgcagtgcttgctgctgaacctgagctgcaagttggaattgatataatgaagactagttttccaggtcgtggttcaattccagaattctttcatattatgaaaagaaagtttaccaacaaagaatgggaaacaatcagaagctttaaggatgagtggactcagctggatatgttttataggaattgggcacttaaggaaagcttcataaaagccattggtgttggactaggatttgaattgcagcggcttgaatttgatctatctccattaaacttggatataggccaagtttataaagaaacacgtttattcctggatggagaggaagaaaaagaatgggcatttgaggaaagcaaaatagatgagcaccattttgttgcagttgctcttaggaaacccgatggatctagacatcaggat

SEQ ID NO: 106876 - DNA, 1252 bp, Homo sapiens
  Payload ID: 989
  Gene Symbol: AASDHPPT
  Gene Name: aminoadipate-semialdehyde dehydrogenase-phosphopantetheinyl transferase
  Uniprot ID: Q9NRN7
  ENST ID: ENST00000525660
  CDS Start-End: 54-470
gtttgcgtccgcgccatcaggcccgagatagcggcgaggtccgctttcagtgtatggttttccctgccaaacggttctgcttggtgccatccatggagggcgtgcgctgggccttttcctgcggcacttggctgccgagccgagccgaatggctgctggcagtgcgatcgattcagcccgaggagaaggagcgcattggccagttcgtctttgcccgggacgctaaggcagccatggctggtcgtctgatgataaggaaattagttgcagagaaattgaatatcccttggaatcatattcgtttgcaaagaactgcaaaaggaaaaccagttcttgcaaaggactcatcgaatccttacccgaatttcaactttaacatctctcatcaaggagactatgcagtgcttgctgctgaacctgagctgcaagttggaattgatataatgaagactagttttccaggcacttaaggaaagcttcataaaagccattggtgttggactaggatttgaattgcagcggcttgaatttgatctatctccattaaacttggatataggccaagtttataaagaaacacgtttattcctggatggagaggaagaaaaagaatgggcatttgaggaaagcaaaatagatgagcaccattttgttgcagttgctcttaggaaacccgatggatctagacatcaggatgttccatctcaggatgattccaaaccaacccagaggcaatttactattctcaactttaatgatttaatgtcatctgccgttcccatgacacctgaagatccttcattttgggactgtttttgcttcacagaagaaattccaatacgaaatggtacaaagtcatgatgattccctgagtaacaaagggaaatgaaaactgtttgtgatcttccgtattcactgaaaaataaatgcttgtttagtatcaaattttatttcacgaaagtttttttaaagaacagaaacttttccaattaaaaaaaaaaagcagacttctggttcaagatagctcactggaatacatgtttacctctttctttcctaaattgcattgaattgataggaaggatggcggaatcttaaagtgatacatgctaactgtagaaaaaaatagaaaatgcacataagcaaaaggaaacatttaaatgctatctttcaaagataactactcttaaaaccttgagtatcttttcagacctttttcttggcaaatgaatccatattgacatatttgatt

SEQ ID NO: 106877 - DNA, 568 bp, Homo sapiens
  Payload ID: 989
  Gene Symbol: AASDHPPT
  Gene Name: aminoadipate-semialdehyde dehydrogenase-phosphopantetheinyl transferase
  ENST ID: ENST00000533423
  CDS Start-End: 89-568
aataggagagacgtcataaggcaatactagaataactgccaaatgaattacataaacaatactgttttggaaaaaggctggtcgtctgatgataaggaaattagttgcagagaaattgaatatcccttggaatcatattcgtttgcaaagaactgcaaaaggaaaaccagttcttgcaaaggactcatcgaatccttacccgaatttcaactttaacatctctcatcaaggagactatgcagtgcttgctgctgaacctgagctgcaagttggaattgatataatgaagactagttttccaggtcgtggttcaattccagaattctttcatattatgaaaagaaagtttaccaacaaagaatgggaaacaatcagaagctttaaggatgagtggactcagctggatatgttttataggaattgggcacttaaggaaagcttcataaaagccattggtgttggactaggatttgaattgcagcggcttgaatttgatctatctccattaaacttggatataggccaagtttataaagaaacacgtttattcctggatggagaggaagaa

SEQ ID NO: 106878 - DNA, 3126 bp, Homo sapiens
  Payload ID: 990
  Gene Symbol: AASS
  Gene Name: aminoadipate-semialdehyde synthase
  ENST ID: ENST00000358954
  CDS Start-End: 56-2254
gctgccttttgttgctctgctctttacattgtctttacagtcaccaggtgtcaagatgctgcaagtacataggactggactgggcaggctgggggtcagcctctccaagggtcttcaccacaaagctgtgttggccgtccggagggaggatgtgaacgcctgggagagaagggccccgctagctcccaagcacatcaaaggcatcaccaatctgggatacaaggtcttgatacagccttcgaatcggcgggccattcatgataaggactatgtcaaagctggtggcattcttcaggaggatatttctgaagcttgtctaattttaggagttaaaagacctccagaggaaaaattaatgtccaggaagacttatgcatttttctcccacacaataaaagctcaggaggccaatatgggcttgttggatgagattctaaaacaggaaattcgccttattgattatgagaaaatggtggatcatagaggagtacgggtagtggcatttggacagtgggctggtgtggcaggaatgatcaacattttacatggaatgggtttaaggctccttgctttgggacatcacacaccttttatgcacattggcatggctcataactacaggaatagcagtcaggctgtgcaagctgtccgtgatgctggctatgaaatatctttgggtttgatgcctaagtcaataggacccttaacatttgtgttcacaggaactggtaatgtttctaagggagcccaagcaatctttaatgagctaccttgtgaatatgtggagccccatgaattaaaagaagtttcccaaactggagacctcagaaaagtgtatgggacggtgttaagtcgtcatcatcatcttgtcaggaaaacagatgctgtgtatgatcctgcagagtatgacaaacatccggagcgctacataagtcgttttaatactgatattgcaccctatacaacttgcttaattaatggaatctactgggaacaaaacactcctcgcctcctaacccgccaagatgctcagagtctcctggctccgggcaagttctcacctgctggtgtggaaggctgccctgcattaccacacaaactcgtggcaatatgtgacatttcagctgacacaggagggtctatagagtttatgactgagtgtacaacaatagagcatcccttttgcatgtatgatgcagaccagcatattattcatgacagtgttgaaggctcggggatcctgatgtgttccattgacaatttgccggcacagctcccaattgaagctacagaatgctttggagacatgctttacccttatgttgaagaaatgatattatcagacgcgacacagcctcttgaaagtcagaatttttctcctgtggtgagagatgcagtgattacatccaacggtacattacctgataaatataaatatatccagacactccgggagagcagggaacgtgctcagtcactttcaatgggcaccaggagaaaggttttggttcttggatctggctacatatctgagcctgtattagaatatttatcaagagatggcaatatagaaataacagtaggatctgacatgaagaatcaaattgaacagttaggcaagaaatataatattaatcctgttagcatggacatttgtaaacaagaagagaagctgggcttcttggtggcaaaacaggatcttgtcatcagcttgttgccttatgtattgcaccctcttgtggccaaggcctgcatcacaaacaaagttaacatggtcactgcaagctacatcacaccagcactaaaagaattggaaaagagtgtggaagatgctggcatcacaatcattggtgaattgggattggaccctggtctggatcacatgttagcaatggaaacaatagataaagccaaggaagtgggagccacgattgaatcatatatttcctactgtggtgggcttccagcccctgaacattcaaacaatccattgagatataaatttagctggagtccagtgggagttttgatgaatgtaatgcagtctgccacctatctgctcgatggaaaggttgtgaatgttgcaggaggcatctcctttcttgatgccgttacgtccatggatttttttccaggattaaatttggaaggctatcctaacagagacagtacgaaatatgctgagatttatggcatttcttctgctcacactttgttgcgggggacactgagatataagggattggaatgctgaataatggattggaatgttgaataatgttgaataccttcctatggtatcctccctaactccttccccttgaaccacccagccccatctatggatatatgaaagctttgaatggatttgtaaaattaggtcttataaacagagaagcgcttcctgcctttagacctgaggccaaccctctcacctggaaacaactcctctgtgacctagttgggatttcaccctcctctgagcatgatgtgttgaaggaagctgttcttaagaaactaggaggagacaatacccagttggaggctgctgaatggttgggcttacttggggatgaacaagttcctcaggcagagtccattctggatgccctctccaagcatttggtcatgaagctttcctatggtcctgaagaaaaagatatgattgtgatgagagacagctttggaatcagacatccttctggacatttagaacataaaacgattgatcttgtggcttatggggacatcaatggcttttcagccatggctaaaaccgtggggttacccaccgccatggcagccaaaatgttgcttgatggtgaaattggagccaaaggcctaatggggcccttttcaaaggagatctatggaccaatattggagcgaattaaagcagaaggcattatatatactacacagagtacaattaaaccataattgggaattatattttgtttttttcttcccaggcaatacacctctgaacatgtgtgtgataaatgggtttgctaatgtgctgttttaaagtataaagcataatatgttttggttaacacaatgtactttttgaactataaatctttattttaatatggaaatgtttggaacaggagatgcaagcca

SEQ ID NO: 106879 - DNA, 3233 bp, Homo sapiens
  Payload ID: 990
  Gene Symbol: AASS
  Gene Name: aminoadipate-semialdehyde synthase
  Uniprot ID: Q9UDR5
  ENST ID: ENST00000393376
  CDS Start-End: 97-2877
cctcagatttctcaggagaccagaactgatctgccagccttgctgccttttgttgctctgctctttacattgtctttacagtcaccaggtgtcaagatgctgcaagtacataggactggactgggcaggctgggggtcagcctctccaagggtcttcaccacaaagctgtgttggccgtccggagggaggatgtgaacgcctgggagagaagggccccgctagctcccaagcacatcaaaggcatcaccaatctgggatacaaggtcttgatacagccttcgaatcggcgggccattcatgataaggactatgtcaaagctggtggcattcttcaggaggatatttctgaagcttgtctaattttaggagttaaaagacctccagaggaaaaattaatgtccaggaagacttatgcatttttctcccacacaataaaagctcaggaggccaatatgggcttgttggatgagattctaaaacaggaaattcgccttattgattatgagaaaatggtggatcatagaggagtacgggtagtggcatttggacagtgggctggtgtggcaggaatgatcaacattttacatggaatgggtttaaggctccttgctttgggacatcacacaccttttatgcacattggcatggctcataactacaggaatagcagtcaggctgtgcaagctgtccgtgatgctggctatgaaatatctttgggtttgatgcctaagtcaataggacccttaacatttgtgttcacaggaactggtaatgtttctaagggagcccaagcaatctttaatgagctaccttgtgaatatgtggagccccatgaattaaaagaagtttcccaaactggagacctcagaaaagtgtatgggacggtgttaagtcgtcatcatcatcttgtcaggaaaacagatgctgtgtatgatcctgcagagtatgacaaacatccggagcgctacataagtcgttttaatactgatattgcaccctatacaacttgcttaattaatggaatctactgggaacaaaacactcctcgcctcctaacccgccaagatgctcagagtctcctggctccgggcaagttctcacctgctggtgtggaaggctgccctgcattaccacacaaactcgtggcaatatgtgacatttcagctgacacaggagggtctatagagtttatgactgagtgtacaacaatagagcatcccttttgcatgtatgatgcagaccagcatattattcatgacagtgttgaaggctcggggatcctgatgtgttccattgacaatttgccggcacagctcccaattgaagctacagaatgctttggagacatgctttacccttatgttgaagaaatgatattatcagacgcgacacagcctcttgaaagtcagaatttttctcctgtggtgagagatgcagtgattacatccaacggtacattacctgataaatataaatatatccagacactccgggagagcagggaacgtgctcagtcactttcaatgggcaccaggagaaaggttttggttcttggatctggctacatatctgagcctgtattagaatatttatcaagagatggcaatatagaaataacagtaggatctgacatgaagaatcaaattgaacagttaggcaagaaatataatattaatcctgttagcatggacatttgtaaacaagaagagaagctgggcttcttggtggcaaaacaggatcttgtcatcagcttgttgccttatgtattgcaccctcttgtggccaaggcctgcatcacaaacaaagttaacatggtcactgcaagctacatcacaccagcactaaaagaattggaaaagagtgtggaagatgctggcatcacaatcattggtgaattgggattggaccctggtctggatcacatgttagcaatggaaacaatagataaagccaaggaagtgggagccacgattgaatcatatatttcctactgtggtgggcttccagcccctgaacattcaaacaatccattgagatataaatttagctggagtccagtgggagttttgatgaatgtaatgcagtctgccacctatctgctcgatggaaaggttgtgaatgttgcaggaggcatctcctttcttgatgccgttacgtccatggatttttttccaggattaaatttggaaggctatcctaacagagacagtacgaaatatgctgagatttatggcatttcttctgctcacactttgttgcgggggacactgagatataagggatatatgaaagctttgaatggatttgtaaaattaggtcttataaacagagaagcgcttcctgcctttagacctgaggccaaccctctcacctggaaacaactcctctgtgacctagttgggatttcaccctcctctgagcatgatgtgttgaaggaagctgttcttaagaaactaggaggagacaatacccagttggaggctgctgaatggttgggcttacttggggatgaacaagttcctcaggcagagtccattctggatgccctctccaagcatttggtcatgaagctttcctatggtcctgaagaaaaagatatgattgtgatgagagacagctttggaatcagacatccttctggacatttagaacataaaacgattgatcttgtggcttatggggacatcaatggcttttcagccatggctaaaaccgtggggttacccaccgccatggcagccaaaatgttgcttgatggtgaaattggagccaaaggcctaatggggcccttttcaaaggagatctatggaccaatattggagcgaattaaagcagaaggcattatatatactacacagagtacaattaaaccataattgggaattatattttgtttttttcttcccaggcaatacacctctgaacatgtgtgtgataaatgggtttgctaatgtgctgttttaaagtataaagcataatatgttttggttaacacaatgtactttttgaactataaatctttattttaatatggaaatgtttggaacaggagatgcaagccactaacagagaactttaataattctaccctgtattttataaatacgtatgtgaaagtgatgatcatgctatttgttaatttattgtgccactttttttcttttgttttttttttgttgttgttgttttttgagatggagtctcgctctgtcacccaggctggagtgcagtg

SEQ ID NO: 106880 - DNA, 722 bp, Homo sapiens
  Payload ID: 990
  Gene Symbol: AASS
  Gene Name: aminoadipate-semialdehyde synthase
  ENST ID: ENST00000426162
  CDS Start-End: 1-66
tggattggaatgttgaataatgttgaataccttcctatggtatcctccctaactccttccccttgaaccacccagccccatctatggatatatgaaagctttgaatggatttgtaaaattaggtcttataaacagagaagcgcttcctgcctttagacctgaggccaaccctctcacctggttgggatttcaccctcctctgagcatgatgtgttgaaggaagctgttcttaagaaactaggaggagacaatacccagttggaggctgctgaatggagatttggagtagtcatagaatattacatgaaaacattctttcatatgaccgctgtggcatcctgctggtatacctaatgttggagaactaacctataaattaatctcataaagatctttgtaagaacatgggattacaatccatcatctctgccctgctccagggagcagtgcctgggttgggcttacttggggatgaacaagttcctcaggcagagtccattctggatgccctctccaagcatttggtcatgaagctttcctatggtcctgaagaaaaagatatgattgtgatgagagacagctttggaatcagacatccttctggacatttagaacataaaacgattgatcttgtggcttatggggacatcaatggcttttcagccatggctaaaaccgtggggttacccaccgccatggcagccaaaatgttgcttgatggt

SEQ ID NO: 106881 - DNA, 3163 bp, Homo sapiens
  Payload ID: 990
  Gene Symbol: AASS
  Gene Name: aminoadipate-semialdehyde synthase
  Uniprot ID: Q9UDR5
  ENST ID: ENST00000417368
  CDS Start-End: 136-2916
aaacacctcctacttcccggccttccatcccagtttcttctaggaattcggagcctcccctgcagcgactcggaagattcgaggcggcgggggacaagtcggcgccccagagcggacgagtcaccaggtgtcaagatgctgcaagtacataggactggactgggcaggctgggggtcagcctctccaagggtcttcaccacaaagctgtgttggccgtccggagggaggatgtgaacgcctgggagagaagggccccgctagctcccaagcacatcaaaggcatcaccaatctgggatacaaggtcttgatacagccttcgaatcggcgggccattcatgataaggactatgtcaaagctggtggcattcttcaggaggatatttctgaagcttgtctaattttaggagttaaaagacctccagaggaaaaattaatgtccaggaagacttatgcatttttctcccacacaataaaagctcaggaggccaatatgggcttgttggatgagattctaaaacaggaaattcgccttattgattatgagaaaatggtggatcatagaggagtacgggtagtggcatttggacagtgggctggtgtggcaggaatgatcaacattttacatggaatgggtttaaggctccttgctttgggacatcacacaccttttatgcacattggcatggctcataactacaggaatagcagtcaggctgtgcaagctgtccgtgatgctggctatgaaatatctttgggtttgatgcctaagtcaataggacccttaacatttgtgttcacaggaactggtaatgtttctaagggagcccaagcaatctttaatgagctaccttgtgaatatgtggagccccatgaattaaaagaagtttcccaaactggagacctcagaaaagtgtatgggacggtgttaagtcgtcatcatcatcttgtcaggaaaacagatgctgtgtatgatcctgcagagtatgacaaacatccggagcgctacataagtcgttttaatactgatattgcaccctatacaacttgcttaattaatggaatctactgggaacaaaacactcctcgcctcctaacccgccaagatgctcagagtctcctggctccgggcaagttctcacctgctggtgtggaaggctgccctgcattaccacacaaactcgtggcaatatgtgacatttcagctgacacaggagggtctatagagtttatgactgagtgtacaacaatagagcatcccttttgcatgtatgatgcagaccagcatattattcatgacagtgttgaaggctcggggatcctgatgtgttccattgacaatttgccggcacagctcccaattgaagctacagaatgctttggagacatgctttacccttatgttgaagaaatgatattatcagacgcgacacagcctcttgaaagtcagaatttttctcctgtggtgagagatgcagtgattacatccaacggtacattacctgataaatataaatatatccagacactccgggagagcagggaacgtgctcagtcactttcaatgggcaccaggagaaaggttttggttcttggatctggctacatatctgagcctgtattagaatatttatcaagagatggcaatatagaaataacagtaggatctgacatgaagaatcaaattgaacagttaggcaagaaatataatattaatcctgttagcatggacatttgtaaacaagaagagaagctgggcttcttggtggcaaaacaggatcttgtcatcagcttgttgccttatgtattgcaccctcttgtggccaaggcctgcatcacaaacaaagttaacatggtcactgcaagctacatcacaccagcactaaaagaattggaaaagagtgtggaagatgctggcatcacaatcattggtgaattgggattggaccctggtctggatcacatgttagcaatggaaacaatagataaagccaaggaagtgggagccacgattgaatcatatatttcctactgtggtgggcttccagcccctgaacattcaaacaatccattgagatataaatttagctggagtccagtgggagttttgatgaatgtaatgcagtctgccacctatctgctcgatggaaaggttgtgaatgttgcaggaggcatctcctttcttgatgccgttacgtccatggatttttttccaggattaaatttggaaggctatcctaacagagacagtacgaaatatgctgagatttatggcatttcttctgctcacactttgttgcgggggacactgagatataagggatatatgaaagctttgaatggatttgtaaaattaggtcttataaacagagaagcgcttcctgcctttagacctgaggccaaccctctcacctggaaacaactcctctgtgacctagttgggatttcaccctcctctgagcatgatgtgttgaaggaagctgttcttaagaaactaggaggagacaatacccagttggaggctgctgaatggttgggcttacttggggatgaacaagttcctcaggcagagtccattctggatgccctctccaagcatttggtcatgaagctttcctatggtcctgaagaaaaagatatgattgtgatgagagacagctttggaatcagacatccttctggacatttagaacataaaacgattgatcttgtggcttatggggacatcaatggcttttcagccatggctaaaaccgtggggttacccaccgccatggcagccaaaatgttgcttgatggtgaaattggagccaaaggcctaatggggcccttttcaaaggagatctatggaccaatattggagcgaattaaagcagaaggcattatatatactacacagagtacaattaaaccataattgggaattatattttgtttttttcttcccaggcaatacacctctgaacatgtgtgtgataaatgggtttgctaatgtgctgttttaaagtataaagcataatatgttttggttaacacaatgtactttttgaactataaatctttattttaatatggaaatgtttggaacaggagatgcaagccactaacagagaactttaataattctaccctgtattttataaatacgtatgtgaaagtgatga

SEQ ID NO: 106882 - DNA, 2922 bp, Homo sapiens
  Payload ID: 990
  Gene Symbol: AASS
  Gene Name: aminoadipate-semialdehyde synthase
  ENST ID: ENST00000431170
  CDS Start-End: 56-1591
gctgccttttgttgctctgctctttacattgtctttacagtcaccaggtgtcaagatgctgcaagtacataggactggactgggcaggctgggggtcagcctctccaagggtcttcaccacaaagctgtgttggccgtccggagggaggatgtgaacgcctgggagagaagggccccgctagctcccaagcacatcaaaggcatcaccaatctgggatacaaggtcttgatacagccttcgaatcggcgggccattcatgataaggactatgtcaaagctggtggcattcttcaggaggatatttctgaagcttgtctaattttaggagttaaaagacctccagaggaaaaattaatgtccaggaagacttatgcatttttctcccacacaataaaagctcaggaggccaatatgggcttgttggatgagattctaaaacaggaaattcgccttattgattatgagaaaatggtggatcatagaggagtacgggtagtggcatttggacagtgggctggtgtggcaggaatgatcaacattttacatggaatgggtttaaggctccttgctttgggacatcacacaccttttatgcacattggcatggctcataactacaggaatagcagtcaggctgtgcaagctgtccgtgatgctggctatgaaatatctttgggtttgatgcctaagtcaataggacccttaacatttgtgttcacaggaactggtaatgtttctaagggagcccaagcaatctttaatgagctaccttgtgaatatgtggagccccatgaattaaaagaagtttcccaaactggagacctcagaaaagtgtatgggacggtgttaagtcgtcatcatcatcttgtcaggaaaacagatgctgtgtatgatcctgcagagtatgacaaacatccggagcgctacataagtcgttttaatactgatattgcaccctatacaacttgcttaattaatggaatctactgggaacaaaacactcctcgcctcctaacccgccaagatgctcagagtctcctggctccgggcaagttctcacctgctggtgtggaaggctgccctgcattaccacacaaactcgtggcaatatgtgacatttcagctgacacaggagggtctatagagtttatgactgagtgtacaacaatagagcatcccttttgcatgtatgatgcagaccagcatattattcatgacagtgttgaaggctcggggatcctgatgtgttccattgacaatttgccggcacagctcccaattgaagctacagaatgctttggagacatgctttacccttatgttgaagaaatgatattatcagacgcgacacagcctcttgaaagtcagaatttttctcctgtggtgagagatgcagtgattacatccaacggtacattacctgataaatataaatatatccagacactccgggagagcagggaacgtgctcagtcactttcaatgggcaccaggagaaaggttttggttcttggatctggctacatatctgagcctgtattagaatatttatcaagagatggcaatatagaaataacagatctgacatgaagaatcaaattgaacagttaggcaagaaatataatattaatcctgttagcatggacatttgtaaacaagaagagaagctgggcttcttggtggcaaaacaggatcttgtcatcagcttgttgccttatgtattgcaccctcttgtggccaaggcctgcatcacaaacaaagttaacatggtcactgcaagctacatcacaccagcactaaaagaattggaaaagagtgtggaagatgctggcatcacaatcattggtgaattgggattggaccctggtctggatcacatgttagcaatggaaacaatagataaagccaaggaagtgggagccacgattgaatcatatatttcctactgtggtgggcttccagcccctgaacattcaaacaatccattgagatataaatttagctggagtccagtgggagttttgatgaatgtaatgcagtctgccacctatctgctcgatggaaaggttgtgaatgttgcaggaggcatctcctttcttgatgccgttacgtccatggatttttttccaggattaaatttggaaggctatcctaacagagacagtacgaaatatgctgagatttatggcatttcttctgctcacactttgttgcgggggacactgagatataagaaacaactcctctgtgacctagttgggatttcaccctcctctgagcatgatgtgttgaaggaagctgttcttaagaaactaggaggagacaatacccagttggaggctgctgaatggttgggcttacttggggatgaacaagttcctcaggcagagtccattctggatgccctctccaagcatttggtcatgaagctttcctatggtcctgaagaaaaagatatgattgtgatgagagacagctttggaatcagacatccttctggacatttagaacataaaacgattgatcttgtggcttatggggacatcaatggcttttcagccatggctaaaaccgtggggttacccaccgccatggcagccaaaatgttgcttgatggtgaaattggagccaaaggcctaatggggcccttttcaaaggagatctatggaccaatattggagcgaattaaagcagaaggcattatatatactacacagagtacaattaaaccataattgggaattatattttgtttttttcttcccaggcaatacacctctgaacatgtgtgtgataaatgggtttgctaatgtgctgttttaaagtataaagcataatatgttttggttaacacaatgtactttttgaactataaatctttattttaatatggaaatgtttggaacaggagatgcaagcca

SEQ ID NO: 106883 - DNA, 1321 bp, Homo sapiens
  Payload ID: 991
  Gene Symbol: ACMSD
  Gene Name: aminocarboxymuconate semialdehyde decarboxylase
  Uniprot ID: Q8TDX5
  ENST ID: ENST00000356140
  CDS Start-End: 137-1147
gggttgggcaggcctactgactgctgcctgaaggttgctgtaaagggactaagtaaatcaattaactccacagttttcacaaaggtctcttgatatcaaaacttctttccttgcatgcttctctgatcctgtggagatgaaaattgacatccatagtcatattctaccaaaagaatggccagatctaaaaaagaggtttggctacggaggctgggtgcagctccaacaccacagcaagggagaagcaaagttgttgaaagatgggaaagtcttcagagtggtgcgagagaattgctgggatccagaagttcgtattagagaaatggaccaaaaaggagtaacagtgcaagccctttccacagttcctgtcatgtttagctactgggccaaacctgaggacactttaaacctgtgccagcttttaaacaacgaccttgccagcaccgttgtgagctaccccaggaggttcgtgggtctggggacgttgcccatgcaggcccctgagctggcggtcaaggagatggagcgctgtgtgaaagagctgggctttcccggggtccaaattggcacccacgtcaacgagtgggacctgaacgcgcaggagctctttcctgtctatgcggcagccgaaaggctgaagtgttccctgttcgtgcatccctgggacatgcagatggatggacgaatggccaaatactggctcccttggcttgtaggaatgccagcagagaccaccatagccatttgctccatgatcatgggtggagtatttgagaagtttcccaaactgaaagtgtgtttcgcacatggtggtggtgccttccccttcacagtgggaagaatctcccatggattcagcatgcgcccagatctgtgtgcccaggacaaccccatgaacccgaagaaataccttggttccttttacacagatgctttggttcatgatcctctgtccctcaagctgttaacagatgtcataggaaaggataaagtcattttgggaaccgattacccctttccactaggtgagctggaacctgggaaactaatagagtccatggaagaatttgatgaagaaacaaagaataaactcaaagccggcaatgccctggcatttttgggtcttgagagaaaacaatttgaatgactgaatttactacaaaggcaaactttcaaaaggatatctcatttttgtttctaaatatgtatcaacaggtatcaacaaaatcctattttgaactattttactcagaaatgaatgtcccaaatatcctaaattattcataataaaaatgatttgtaagtgttttcattctgaaaa

SEQ ID NO: 106884 - DNA, 1307 bp, Homo sapiens
  Payload ID: 991
  Gene Symbol: ACMSD
  Gene Name: aminocarboxymuconate semialdehyde decarboxylase
  Uniprot ID: Q8TDX5
  ENST ID: ENST00000392928
  CDS Start-End: 297-1133
agttttcacaaaggtctcttgatatcaaaacttctttccttgcatgcttctctgatcctgtggagatgaaaattgacatccatagtcatattctaccaaaagaatggccagatctaaaaaagaccctgagacaaggattcagatgcaagtagtttgctttggaggtgatcccaggaaacaccagtagagtgaggaagtgagacagggaaaacagggcagccagtgaaagaggtttggctacggaggctgggtgcagctccaacaccacagcaagggagaagcaaagttgttgaaagatgggaaagtcttcagagtggtgcgagagaattgctgggatccagaagttcgtattagagaaatggaccaaaaaggccaaacctgaggacactttaaacctgtgccagcttttaaacaacgaccttgccagcaccgttgtgagctaccccaggaggttcgtgggtctggggacgttgcccatgcaggcccctgagctggcggtcaaggagatggagcgctgtgtgaaagagctgggctttcccggggtccaaattggcacccacgtcaacgagtgggacctgaacgcgcaggagctctttcctgtctatgcggcagccgaaaggctgaagtgttccctgttcgtgcatccctgggacatgcagatggatggacgaatggccaaatactggctcccttggcttgtaggaatgccagcagagaccaccatagccatttgctccatgatcatgggtggagtatttgagaagtttcccaaactgaaagtgtgtttcgcacatggtggtggtgccttccccttcacagtgggaagaatctcccatggattcagcatgcgcccagatctgtgtgcccaggacaaccccatgaacccgaagaaataccttggttccttttacacagatgctttggttcatgatcctctgtccctcaagctgttaacagatgtcataggaaaggataaagtcattttgggaaccgattacccctttccactaggtgagctggaacctgggaaactaatagagtccatggaagaatttgatgaagaaacaaagaataaactcaaagccggcaatgccctggcatttttgggtcttgagagaaaacaatttgaatgactgaatttactacaaaggcaaactttcaaaaggatatctcatttttgtttctaaatatgtatcaacaggtatcaacaaaatcctattttgaactattttactcagaaatgaatgtcccaaatatcctaaattattcataataaaaatgatttgtaagtgttttcattctgaaaa

SEQ ID NO: 106885 - DNA, 3173 bp, Homo sapiens
  Payload ID: 992
  Gene Symbol: ALAD
  Gene Name: aminolevulinate dehydratase
  Uniprot ID: P13716
  ENST ID: ENST00000409155
  CDS Start-End: 198-1190
gggggcggaccgtggggaagctgcttccgggtgagccccccccgctcttacgcggtctgtgggagaccggagcgggagacagcggtgacaggagcagcggccgggagcccttagggaggcagacagagcctgcagccaatgccccaggagccctcggttccaaccaactgatgcccctgtgcccactggcccacgccatgcagccccagtccgttctgcacagcggctacttccacccactacttcgggcctggcagacagccaccaccaccctcaatgcctccaacctcatctaccccatctttgtcacggatgttcctgatgacatacagcctatcaccagcctcccaggagtggccaggtatggtgtgaagcggctggaagagatgctgaggcccttggtggaagagggcctacgctgtgtcttgatctttggcgtccccagcagagttcccaaggacgagcggggttccgcagctgactccgaggagtccccagctattgaggcaatccatctgttgaggaagaccttccccaacctcctggtggcctgtgatgtctgcctgtgtccctacacctcccatggtcactgcgggctcctgagtgaaaacggagcattccgggctgaggagagccgccagcggctggctgaggtggcattggcgtatgccaaggcaggatgtcaggtggtagccccgtcggacatgatggatggacgcgtggaagccatcaaagaggccctgatggcacatggacttggcaacagggtatcggtgatgagctacagtgccaaatttgcttcctgtttctatggccctttccgggatgcagctaagtcaagcccagcttttggggaccgccgctgctaccagctgccccctggagcacgaggcctggctctccgagctgtggaccgggatgtacgggaaggagctgacatgctcatggtgaagccgggaatgccctacctggacatcgtgcgggaggtaaaggacaagcaccctgacctccctctcgccgtgtaccacgtctctggagagtttgccatgctgtggcatggagcccaggccggggcatttgatctcaaggctgccgtactggaggccatgactgccttccgcagagcaggtgctgacatcatcatcacctactacacaccgcagctgctgcagtggctgaaggaggaatgatggagacagtgccaggcccaagaactagaactttaaaacgttcccggggcctcagacaagtgaaaaccaaagtaaatgctgcttttagaactgtgccctcatgccctcttcctgctcacatgctagcggggcccagcagccctgggtggttttgccagcatgctaactcttgtaactcgcagctgcatcctatgagctctcccaagcttccccgcccctcccctgggtcagccgtgaggcccacctttgccaccctcagctctttcctctggtgtggcttcagcttgaaagcaacctggagtcgggggcacagcctttggggcctggctgggagagggtcttggagcattaggggaagaagagagcagtgggatcttggggcctgagaagccttggaacgcttctggcagcagagctgggtgtgggaatgaggcctagatcgatatccctgggttagagttgaaatttgccgcaattccactggaaggcatttcccacgaggccagaggttgccaggctgcctgaggtctcctattctactctgaaccataaacccagagaagaattactcattaaccagcataaatactgcctgaggatcaaaactcagaggcaaagagggagttcctgactgctagaggtgccaccaccacaaacactttttattcaggagatactttttgagaatctctgctctgttcctaggttcagtgctgggtcctgggaatacagcaggacagacctcagcttatctcttcatagaaattatacaaagagaattggggagacagctaagaagaaaacaaagaaataaagcagttacaaattgtgataagtgctttgaaggaaagaaggggtctgagacaacaacagggaaggggcctctcttgaaacagtagttgggaaggaggcagacatgcaccagtgatgtggtgacaggtgctctgaaggaggtcaccaggacctgacctctttgaaggatcagaaaatacttccctgaaggactgacatttgagcctagacctgaagggtgagccatcaagctaagacaattggggaagagcattccagggagagggaggagttgtgcaaaggccctggggctccttctagctggaggaatgcaaggctagcttgtctggagcactgagaggatggcctgaactgagtggagagagacagaccaggaccaaaccatgcagaggtcaagggccacattcaccttttcagagtgactcaatcaaatttgtagtttgtaaaagtattttaacagctctgcggcaaagtgcaaatgaaaagtcttgatggcatggactggagcggggacagtggggatggagaaaggggaatggattgtggatgtgtttagaaggtagattcgatgtgaaggatgaatctggcttgaccttctgggtggctgatgggccatttactgagatggggcagcctggaagaggaacagaagcagggtcggggtggagggagaatactaaacttagcttgagacattttgcaataaggaagctatatctagagtgcttatgtgactcacctaaggccactcaacaagtttgtggcagaactggattagaactgcacagaaaacagccaagctgggatttgaacccatgtagtccaactccaaggcctctgcccctaaccactgtgccataccacctcccaataatcaacagcaaaattataggtctaacaatgttttatagacacccctccatttatgtgatgggtttgcatcctgataaacccatcataagttgaaaatatgatcataagttgaaaatatgatcataagtcaaaaatgtatttaatatacctaacctaccaaacatcatagcttagcctagcctgccttaaacatgctcagaacacttacattagcctacagtgggcaaaactatccaacacaaaatctatattgtaataaagttgtaaagaattttgaataaaaattcaatatttgaa

SEQ ID NO: 106886 - DNA, 536 bp, Homo sapiens
  Payload ID: 992
  Gene Symbol: ALAD
  Gene Name: aminolevulinate dehydratase
  ENST ID: ENST00000448137
  CDS Start-End: 175-536
gctcttacgcggtctgtgggagaccggagcgggagacagcggtgacaggagcagcggccgggagcccttagggaggcagcacccaaagcagaaacagtatgggcagagagacgcctactgaatcagacagagcctgcagccaatgccccaggagccctcggttccaaccaactgatgcccctgtgcccactggcccacgccatgcagccccagtccgttctgcacagcggctacttccacccactacttcgggcctggcagacagccaccaccaccctcaatgcctccaacctcatctaccccatctttgtcacggatgttcctgatgacatacagcctatcaccagcctcccaggagtggccaggtatggtgtgaagcggctggaagagatgctgaggcccttggtggaagagggcctacgctgtgtcttgatctttggcgtccccagcagagttcccaaggacgagcggggttccgcagctgactccgaggagtccccagctattgaggcaatccatctgttgaggaagacctt

SEQ ID NO: 106887 - DNA, 703 bp, Homo sapiens
  Payload ID: 992
  Gene Symbol: ALAD
  Gene Name: aminolevulinate dehydratase
  ENST ID: ENST00000445750
  CDS Start-End: 662-703
acctcctctccaagcccagctccccactgccctcttcctgccctgtccctgtctccgctgccctttagatcaggcaggcaggcaggcctagagcatccgccctgagacactgcctgttggctgccttaagacgccccttccttctctgcccgcagcctccccagcctctgcattcctctgcttcctgtctgctctgctcagcctgcaggattgatcttcccaaagccaggtgtcaaccaggccactaaccctacccactgctcagaaatcttcccacagcctcagcctggccccctcttatccatcccctccatacacacttgcctcagctcctcaaaacagtccacagccatcctccttccccacctttgcccctttcttcccttcctaaggaaatattggcccccttctctccaccaggctgaacccactcatcctgcaaaaccaagttcaacgccctgtcattttcttttttttttttttttttgagatggagtctcacactgtcgcccaggctagagtgcaatgggtgcactctcggctcactgcaacctctgcctcctaggttcaatcgattcttctgcctcagcctccagaggaactctgactacagacagagcctgcagccaatgccccaggagccctcggttccaaccaactgatgcccctgtgcccactggcccacgccatgcagccccagtcc

SEQ ID NO: 106888 - DNA, 583 bp, Homo sapiens
  Payload ID: 992
  Gene Symbol: ALAD
  Gene Name: aminolevulinate dehydratase
  ENST ID: ENST00000452726
  CDS Start-End: 406-583
aggaagactggataaaatgggcccctgagatggctgaaggcagctaaaggggcctaagagactatggggagaagggcagccagttcctaggcagccctgccccactgtttctgataagcaggaggcagttgttccctcagcctcctgaaagcaatgaggagttgaggccacgggaatgcagctttggattccagaagccaaggacctgttacaaaggtggttttctgggaagcaaattagagggattagacctggcttcgacatctgacttgactccaacctaccaaaggatctcccagttcacctgggagttaacacaccagggttctagtccttttgctcgctgtgtggctttggacagagcctgcagccaatgccccaggagccctcggttccaaccaactgatgcccctgtgcccactggcccacgccatgcagccccagtccgttctgcacagcggctacttccacccactacttcgggcctggcagacagccaccaccaccctcaatgcctccaacctcatctaccccatctttgtcacggatgttcctgatgacatacagcctatcaccagcctcc

SEQ ID NO: 106889 - DNA, 2276 bp, Homo sapiens
  Payload ID: 993
  Gene Symbol: AMT
  Gene Name: aminomethyltransferase
  Uniprot ID: P48728
  ENST ID: ENST00000273588
  CDS Start-End: 304-1515
agacagggcggttctgcagggggcggtctagcccctagctttgttctgggcagcccaatcagctctggattgcccgagctgccctgaagagtcagccgaaagagctggaggcttcttccctgtggttgcgggttcctgcattctctgctctaaatcccagcctgcccttggggctgcccacgcccccttcagatcctttgctccggagagagacctgtccgagcagaggcctggactacatctcccggcgtgcctggcagtgtggtggcctctgtgcgccgtctgcactcgttgcaggcgacgatgcagagggctgtaagtgtggtggcccgtctgggctttcgcctgcaggcattccccccggccttgtgtcgtccacttagttgcgcacaggaggtgctccgcaggacaccgctctatgacttccacctggcccacggcgggaaaatggtggcgtttgcgggttggagtctgccagtgcagtaccgggacagtcacactgactcgcacctgcacacacgccagcactgctcgctctttgacgtgtctcatatgctgcagaccaagatacttggtagtgaccgggtgaagctgatggagagtctagtggttggagacattgcagagctaagaccaaaccaggggacactgtcgctgtttaccaacgaggctggaggcatcttagatgacttgattgtaaccaatacttctgagggccacctgtatgtggtgtccaacgctggctgctgggagaaagatttggccctcatgcaggacaaggtcagggagcttcagaaccagggcagagatgtgggcctggaggtgttggataatgccctgctagctctgcaaggccccactgcagcccaggtactacaggccggcgtggcagatgacctgaggaaactgcccttcatgaccagtgctgtgatggaggtgtttggcgtgtctggctgccgcgtgacccgctgtggctacacaggagaggatggtgtggagatctcggtgccggtagcgggggcagttcacctggcaacagctattctgaaaaacccagaggtgaagctggcagggctggcagccagggacagcctgcgcctggaggcaggcctctgcctgtatgggaatgacattgatgaacacactacacctgtggagggcagcctcagttggacactggggaagcgccgccgagctgctatggacttccctggagccaaggtcattgttccccagctgaagggcagggtgcagcggaggcgtgtggggttgatgtgtgagggggcccccatgcgggcacacagtcccatcctgaacatggagggtaccaagattggtactgtgactagtggctgcccctccccctctctgaagaagaatgtggcgatgggttatgtgccctgcgagtacagtcgtccagggacaatgctgctggtagaggtgcggcggaagcagcagatggctgtagtcagcaagatgccctttgtgcccacaaactactataccctcaagtgaagctggctcagggtggggctgtcccttccaggagttttgcccctacaaggggttagtcaagaagctgaggcagaactcactgggggtgggcagttaaggtggaggctgattctaattgtctggttgaggggccacaccacctattccccccacctaactcatgccattccagcttccttcaggaccctgcttctgagtgacggaccagctcacacaatgtcttgtttcagtccatgatcccactgacctactcttgcctgctggagggtaatgagaagctttggttctgccatctctcccactctgccaggtgctggctgtggagcaaaggctcacctttgtggagaggataaaacctgcccaacctacctcaccatggtttttcacattgcaaagggtaataacatgggcagtgcggacttaggctaccccctccagtttgctttccgtaaatgcaaattgtccttactgcaagtcaggaatgattgctgactcacagtagggctgctatgcctgtgtgtaaacttggggatggctgagggaacatagactcactcttccacattcccaagttggtctagtgtgctgcccagtagcaaaccatggcagactcaccacctattctgagttccagggctgctgtagggcagggtgggcttcctcccagacttgccttaccctgggctgatctttgcccctggtatgcattaatggactccactgaatcctgaaaaaaaaattaaacttccttcttacttgcc

SEQ ID NO: 106890 - DNA, 1955 bp, Homo sapiens
  Payload ID: 993
  Gene Symbol: AMT
  Gene Name: aminomethyltransferase
  Uniprot ID: P48728
  ENST ID: ENST00000395338
  CDS Start-End: 229-1389
gagctgccctgaagagtcagccgaaagagctggaggcttcttccctgtggttgcgggttcctgcattctctgctctaaatcccagcctgcccttggggctgcccacgcccccttcagatcctttgctccggagagagacctgtccgagcagaggcctggactacatctcccggcgtgcctggcagtgtggtggcctctgtgcgccgtctgcactcgttgcaggcgacgatgcagagggctgtaagtgtggtggcccgtctgggctttcgcctgcaggcattccccccggccttgtgtcgtccacttagttgcgcacaggaggtgctccgcaggacaccgctctatgacttccacctggcccacggcgggaaaatggtggcgtttgcgggttggagtctgccagtgcagtaccgggacagtcacactgactcgcacctgcacacacgccagcactgctcgctctttgacgtgtctcatatgctgcagaccaagatacttggtagtgaccgggtgaagctgatggagagtctagtggttggagacattgcagagctaagaccaaaccaggggacactgtcgctgtttaccaacgaggctggaggcatcttagatgacttgattgtaaccaatacttctgagggccacctgtatgtggtgtccaacgctggctgctgggagaaagatttggccctcatgcaggacaaggtcagggagcttcagaaccagggcagagatgtgggcctggaggtgttggataatgccctgctagctctgcaaggccccactgcagcccaggtactacaggccggcgtggcagatgacctgaggaaactgcccttcatgaccagtgctgtgatggaggtgtttggcgtgtctggctgccgcgtgacccgctgtggctacacaggagaggatggtgtggagatctcggtgccggtagcgggggcagttcacctggcaacagctattctgaaaaacccagaggtgaagctggcagggctggcagccagggacagcctgcgcctggaggcaggcctctgcctgtatgggaatgacattgatgaacacactacacctgtggagggcagcctcagttggacactggggaagcgccgccgagctgctatggacttccctggagccaaggtcattgttccccagctgaagggcagggtgcagcggaggcgtgtggggttgatgtgtgagggggcccccatgcgggcacacagtcccatcctgaacatggagggtaccaagattggtactgtgactagtggctgcccctccccctctctgaagaagaatgtggcgatgggttatgtgccctgcgagtacagtcgtccagggacaatgctgctggtagagcttccttcaggaccctgcttctgagtgacggaccagctcacacaatgtcttgtttcagtccatgatcccactgacctactcttgcctgctggagggtaatgagaagctttggttctgccatctctcccactctgccaggtgctggctgtggagcaaaggctcacctttgtggagaggataaaacctgcccaacctacctcaccatggtttttcacattgcaaagggtaataacatgggcagtgcggacttaggctaccccctccagtttgctttccgtaaatgcaaattgtccttactgcaagtcaggaatgattgctgactcacagtagggctgctatgcctgtgtgtaaacttggggatggctgagggaacatagactcactcttccacattcccaagttggtctagtgtgctgcccagtagcaaaccatggcagactcaccacctattctgagttccagggctgctgtagggcagggtgggcttcctcccagacttgccttaccctgggctgatctttgcccctggtatgcattaatggactccactgaatcctgaaaaaaaaattaaacttccttcttacttgcca

SEQ ID NO: 106891 - DNA, 811 bp, Homo sapiens
  Payload ID: 993
  Gene Symbol: AMT
  Gene Name: aminomethyltransferase
  ENST ID: ENST00000430521
  CDS Start-End: 24-811
gtctgcactcgttgcaggcgacgatgcagagggctgtaagtgtggtggcccgtctgggctttcgcctgcaggcattccccccggccttgtgtcgtccacttagttgcgcacagaccaagatacttggtagtgaccgggtgaagctgatggagagtctagtggttggagacattgcagagctaagaccaaaccaggggacactgtcgctgtttaccaacgaggctggaggcatcttagatgacttgattgtaaccaatacttctgagggccacctgtatgtggtgtccaacgctggctgctgggagaaagatttggccctcatgcaggacaaggtcagggagcttcagaaccagggcagagatgtgggcctggaggtgttggataatgccctgctagctctgcaaggccccactgcagcccaggtactacaggccggcgtggcagatgacctgaggaaactgcccttcatgaccagtgctgtgatggaggtgtttggcgtgtctggctgccgcgtgacccgctgtggctacacaggagaggatggtgtggagatctcggtgccggtagcgggggcagttcacctggcaacagctattctgaaaaacccagaggtgaagctggcagggctggcagccagggacagcctgcgcctggaggcaggcctctgcctgtatgggaatgacattgatgaacacactacacctgtggagggcagcctcagttggacactggggaagcgccgccgagctgctatggacttccctggagccaaggtcattgttccccagctgaagggcagggtgcagcggag

SEQ ID NO: 106892 - DNA, 1123 bp, Homo sapiens
  Payload ID: 993
  Gene Symbol: AMT
  Gene Name: aminomethyltransferase
  ENST ID: ENST00000399379
  CDS Start-End: 2-121
gatgcagagggctgtaagtgtggtggcccgtctgggctttcgcctgcaggcattccccccggccttgtgtcgtccacttagttgcgcacagtggtccactccttggctttgtttgctgtgaactggattccaaggacagccttctcagaagagctagagaccaagatacttggtagtgaccgggtgaagctgatggagagtctagtggttggagacattgcagagctaagaccaaaccaggggacactgtcgctgtttaccaacgaggctggaggcatcttagatgacttgattgtaaccaatacttctgagggccacctgtatgtggtgtccaacgctggctgctgggagaaagatttggccctcatgcaggacaaggtcagggagcttcagaaccagggcagagatgtgggcctggaggtgttggataatgccctgctagctctgcaaggccccactgcagcccaggtactacaggccggcgtggcagatgacctgaggaaactgcccttcatgaccagtgctgtgatggaggtgtttggcgtgtctggctgccgcgtgacccgctgtggctacacaggagaggatggtgtggagatctcggtgccggtagcgggggcagttcacctggcaacagctattctgaaaaacccagaggtgaagctggcagggctggcagccagggacagcctgcgcctggaggcaggcctctgcctgtatgggaatgacattgatgaacacactacacctgtggagggcagcctcagttggacactggggaagcgccgccgagctgctatggacttccctggagccaaggtcattgttccccagctgaagggcagggtgcagcggaggcgtgtggggttgatgtgtgagggggcccccatgcgggcacacagtcccatcctgaacatggagggtaccaagattggtactgtgactagtggctgcccctccccctctctgaagaagaatgtggcgatgggttatgtgccctgcgagtacagtcgtccagggacaatgctgctggtagaggtgcggcggaagcagcagatggctgtagtcagcaagatgccctttgtgcccacaaactactataccctcaagtgaagctggctca

SEQ ID NO: 106893 - DNA, 1719 bp, Homo sapiens
  Payload ID: 993
  Gene Symbol: AMT
  Gene Name: aminomethyltransferase
  ENST ID: ENST00000427987
  CDS Start-End: 1-1153
ggctgtaagtgtggtggcccgtctgggctttcgcctgcaggcattccccccggccttgtgtcgtccacttagttgcgcacaggaggtgctccgcaggacaccgctctatgacttccacctggcccacggcgggaaaatggtggcgtttgcgggttggagtctgccagtgcagtaccgggacagtcacactgactcgcacctgcacacacgccagcactgctcgctctttgacgtgtctcatatgctgcagaccaagatacttggtagtgaccgggtgaagctgatggagagtctagtggttggagacattgcagagctaagaccaaaccaggggacactgtcgctgtttaccaacgaggctggaggcatcttagatgacttgattgtaaccaatacttctgagggccacctgtatgtggtgtccaacgctggctgctgggagaaagatttggccctcatgcaggacaaggtcagggagcttcagaaccagggcagagatgtgggcctggaggtgttggataatgccctgctagctctgcaaggccccactgcagcccaggtactacaggccggcgtggcagatgacctgaggaaactgcccttcatgaccagtgctgtgatggaggtgtttggcgtgtctggctgccgcgtgacccgctgtggctacacaggagaggatggtgtggagatctcggtgccggtagcgggggcagttcacctggcaacagctattctgaaaaacccagaggtgaagctggcagggctggcagccagggacagcctgcgcctggaggcaggcctctgcctgtatgggaatgacattgatgaacacactacacctgtggagggcagcctcagttggacactggggaagcgccgccgagctgctatggacttccctggagccaaggtcattgttccccagctgaagggcagggtgcagcggaggcgtgtggggttgatgtgtgagggggcccccatgcgggcacacagtcccatcctgaacatggagggtaccaagattggtactgtgactagtggctgcccctccccctctctgaagaagaatgtggcgatgggttatgtgccctgcgagtacagtcgtccagggacaatgctgctggtagagcttccttcaggaccctgcttctgagtgacggaccagctcacacaatgtcttgtttcagtccatgatcccactgacctactcttgcctgctggagggtaatgagaagctttggttctgccatctctcccactctgccaggtgctggctgtggagcaaaggctcacctttgtggagaggataaaacctgcccaacctacctcaccatggtttttcacattgcaaagggtaataacatgggcagtgcggacttaggctaccccctccagtttgctttccgtaaatgcaaattgtccttactgcaagtcaggaatgattgctgactcacagtagggctgctatgcctgtgtgtaaacttggggatggctgagggaacatagactcactcttccacattcccaagttggtctagtgtgctgcccagtagcaaaccatggcagactcaccacctattctgagttccagggctgctgtagggcagggtgggcttcctcccagacttgccttaccctgggctgatctttgcccctggtatgcattaatggactccactgaatcctgaaaaaaaaattaaacttccttcttacttgcca

SEQ ID NO: 106894 - DNA, 1860 bp, Homo sapiens
  Payload ID: 993
  Gene Symbol: AMT
  Gene Name: aminomethyltransferase
  Uniprot ID: P48728
  ENST ID: ENST00000458307
  CDS Start-End: 20-1099
gcactcgttgcaggcgacgatgcagagggctgtaagtgtggtggcccgtctgggctttcgcctgcaggcattccccccggccttgtgtcgtccacttagttgcgcacaggaggtgctccgcaggacaccgctctatgacttccacctggcccacggcgggaaaatggtggcgtttgcgggttggagtctgccagtgcagtaccgggacagtcacactgactcgcacctgcacacacgccagcactgctcgctctttgacgtgtctcatatgctgcagaccaagatacttggtagtgaccgggtgaagctgatggagagtctagtggttggagacattgcagagctaagaccaaaccaggacaaggtcagggagcttcagaaccagggcagagatgtgggcctggaggtgttggataatgccctgctagctctgcaaggccccactgcagcccaggtactacaggccggcgtggcagatgacctgaggaaactgcccttcatgaccagtgctgtgatggaggtgtttggcgtgtctggctgccgcgtgacccgctgtggctacacaggagaggatggtgtggagatctcggtgccggtagcgggggcagttcacctggcaacagctattctgaaaaacccagaggtgaagctggcagggctggcagccagggacagcctgcgcctggaggcaggcctctgcctgtatgggaatgacattgatgaacacactacacctgtggagggcagcctcagttggacactggggaagcgccgccgagctgctatggacttccctggagccaaggtcattgttccccagctgaagggcagggtgcagcggaggcgtgtggggttgatgtgtgagggggcccccatgcgggcacacagtcccatcctgaacatggagggtaccaagattggtactgtgactagtggctgcccctccccctctctgaagaagaatgtggcgatgggttatgtgccctgcgagtacagtcgtccagggacaatgctgctggtagaggtgcggcggaagcagcagatggctgtagtcagcaagatgccctttgtgcccacaaactactataccctcaagtgaagctggctcagggtggggctgtcccttccaggagttttgcccctacaaggggttagtcaagaagctgaggcagaactcactgggggtgggcagttaaggtggaggctgattctaattgtctggttgaggggccacaccacctattccccccacctaactcatgccattccagcttccttcaggaccctgcttctgagtgacggaccagctcacacaatgtcttgtttcagtccatgatcccactgacctactcttgcctgctggagggtaatgagaagctttggttctgccatctctcccactctgccaggtgctggctgtggagcaaaggctcacctttgtggagaggataaaacctgcccaacctacctcaccatggtttttcacattgcaaagggtaataacatgggcagtgcggacttaggctaccccctccagtttgctttccgtaaatgcaaattgtccttactgcaagtcaggaatgattgctgactcacagtagggctgctatgcctgtgtgtaaacttggggatggctgagggaacatagactcactcttccacattcccaagttggtctagtgtgctgcccagtagcaaaccatggcagactcaccacctattctgagttccagggctgctgtagggcagggtgggcttcctcccagacttgccttaccctgggctgatctttgcccctggtatgcattaatggactccactgaatcctgaaaaaaaaattaaacttccttcttacttgcc

SEQ ID NO: 106895 - DNA, 2033 bp, Homo sapiens
  Payload ID: 993
  Gene Symbol: AMT
  Gene Name: aminomethyltransferase
  Uniprot ID: P48728
  ENST ID: ENST00000538581
  CDS Start-End: 229-1272
gagctgccctgaagagtcagccgaaagagctggaggcttcttccctgtggttgcgggttcctgcattctctgctctaaatcccagcctgcccttggggctgcccacgcccccttcagatcctttgctccggagagagacctgtccgagcagaggcctggactacatctcccggcgtgcctggcagtgtggtggcctctgtgcgccgtctgcactcgttgcaggcgacgatgcagagggctgtaagtgtggtggcccgtctgggctttcgcctgcaggcattccccccggccttgtgtcgtccacttagttgcgcacagaccaagatacttggtagtgaccgggtgaagctgatggagagtctagtggttggagacattgcagagctaagaccaaaccaggggacactgtcgctgtttaccaacgaggctggaggcatcttagatgacttgattgtaaccaatacttctgagggccacctgtatgtggtgtccaacgctggctgctgggagaaagatttggccctcatgcaggacaaggtcagggagcttcagaaccagggcagagatgtgggcctggaggtgttggataatgccctgctagctctgcaaggccccactgcagcccaggtactacaggccggcgtggcagatgacctgaggaaactgcccttcatgaccagtgctgtgatggaggtgtttggcgtgtctggctgccgcgtgacccgctgtggctacacaggagaggatggtgtggagatctcggtgccggtagcgggggcagttcacctggcaacagctattctgaaaaacccagaggtgaagctggcagggctggcagccagggacagcctgcgcctggaggcaggcctctgcctgtatgggaatgacattgatgaacacactacacctgtggagggcagcctcagttggacactggggaagcgccgccgagctgctatggacttccctggagccaaggtcattgttccccagctgaagggcagggtgcagcggaggcgtgtggggttgatgtgtgagggggcccccatgcgggcacacagtcccatcctgaacatggagggtaccaagattggtactgtgactagtggctgcccctccccctctctgaagaagaatgtggcgatgggttatgtgccctgcgagtacagtcgtccagggacaatgctgctggtagaggtgcggcggaagcagcagatggctgtagtcagcaagatgccctttgtgcccacaaactactataccctcaagtgaagctggctcagggtggggctgtcccttccaggagttttgcccctacaaggggttagtcaagaagctgaggcagaactcactgggggtgggcagttaaggtggaggctgattctaattgtctggttgaggggccacaccacctattccccccacctaactcatgccattccagcttccttcaggaccctgcttctgagtgacggaccagctcacacaatgtcttgtttcagtccatgatcccactgacctactcttgcctgctggagggtaatgagaagctttggttctgccatctctcccactctgccaggtgctggctgtggagcaaaggctcacctttgtggagaggataaaacctgcccaacctacctcaccatggtttttcacattgcaaagggtaataacatgggcagtgcggacttaggctaccccctccagtttgctttccgtaaatgcaaattgtccttactgcaagtcaggaatgattgctgactcacagtagggctgctatgcctgtgtgtaaacttggggatggctgagggaacatagactcactcttccacattcccaagttggtctagtgtgctgcccagtagcaaaccatggcagactcaccacctattctgagttccagggctgctgtagggcagggtgggcttcctcccagacttgccttaccctgggctgatctttgcccctggtatgcattaatggactccactgaatcctgaaaaaaaaattaaacttccttcttacttgcc

SEQ ID NO: 106896 - DNA, 4353 bp, Homo sapiens
  Payload ID: 994
  Gene Symbol: NPEPPS
  Gene Name: aminopeptidase puromycin sensitive
  Uniprot ID: P55786
  ENST ID: ENST00000322157
  CDS Start-End: 238-2997
gggcgcgcccggccggcggggccgcgcacgcagccgccgccaccacttccccctctccctccctccttgcgggccctcctccccttccctcccctccgcccccttccccgtaggcagcccgcccgccagtccgcccgcaccgcctccttcccagcccctagcgctccggctgggtctctcccccgccccccaggctcccccggtcgctctcctccggcggtcgcccgcgctcggtggatgtggctggcagctgccgccccctccctcgctcgccgcctgctcttcctcggccctccgcctcctcccctcctccttctcgtcttcagccgctcctctcgccgccgcctccacagcctgggcctcgccgcgatgccggagaagaggcccttcgagcggctgcctgccgatgtctcccccatcaactacagcctttgcctcaagcccgacttgctggacttcaccttcgagggcaagctggaggccgccgcccaggtgaggcaggcgactaatcagattgtgatgaattgtgctgatattgatattattacagcttcatatgcaccagaaggagatgaagaaatacatgctacaggatttaactatcagaatgaagatgaaaaagtcaccttgtctttccctagtactctgcaaacaggtacgggaaccttaaagatagattttgttggagagctgaatgacaaaatgaaaggtttctatagaagtaaatatactaccccttctggagaggtgcgctatgctgctgtaacacagtttgaggctactgatgcccgaagggcttttccttgctgggatgagcctgctatcaaagcaacttttgatatctcattggttgttcctaaagacagagtagctttatcaaacatgaatgtaattgaccggaaaccataccctgatgatgaaaatttagtggaagtgaagtttgcccgcacacctgttatgtctacatatctggtggcatttgttgtgggtgaatatgactttgtagaaacaaggtcaaaagatggtgtgtgtgtccgtgtttacactcctgttggcaaagcagagcaaggaaaatttgcgttagaggttgctgctaaaaccttgcctttttataaggactacttcaatgttccttatcctctacctaaaattgatctcattgctattgcagactttgcagctggtgccatggagaactggggccttgttacttatagggagactgcattgcttattgatccaaaaaattcctgttcttcatcccgccagtgggttgctctggttgtgggacatgaactcgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccacagaggatctctgggaaagtttagaaaatgctagtggtaaacctatagcagctgtgatgaatacctggaccaaacaaatgggatttcccctcatttatgtggaagctgaacaggtagaagatgacagattattgaggttgtcccaaaagaagttctgtgctggtgggtcatatgttggtgaagattgtccccagtggatggtccctatcacaatctctactagtgaagaccccaaccaggccaaactaaaaattctaatggacaagccagagatgaatgtggttttgaaaaatgtcaaaccagaccaatgggtgaagttaaacttaggaacagttgggttttatcggacccagtacagctctgccatgctggaaagtttattaccaggcattcgtgacctttctctgccccctgtggatcgacttggattacagaatgacctcttctccttggctcgagctggaatcattagcactgtagaggttctaaaagtcatggaggcttttgtgaatgagcccaattatactgtatggagcgacctgagctgtaacctggggattctctcaactctcttgtcccacacagacttctatgaggaaatccaggagtttgtgaaagatgtcttttcacctataggggagagactgggctgggaccccaaacctggagaaggtcatctcgatgcactcctgaggggcttggttctgggaaaactaggaaaagcaggacataaggcaacgttagaagaagcccgtcgtcggtttaaggaccacgtggaaggaaaacagattctctccgctgatctgaggagtcctgtctatctgactgttttgaagcatggtgatggcactactttagatattatgttaaaacttcataaacaagcagatatgcaagaagagaaaaaccgaatcgaaagagtccttggcgctactcttttgcctgacctgattcaaaaagtcctcacgtttgcactttcagaagaggtacgtccacaggacactgtatcggtaattggtggagtagctggaggcagcaagcatggtaggaaagctgcttggaaattcataaaggacaactgggaagaactttataaccgataccagggaggattcttaatatccagactaataaagctatcagttgagggatttgcagttgataaaatggctggagaggttaaggctttcttcgagagtcacccagctccttcagctgagcgtaccatccagcagtgttgtgaaaatattctgctgaatgctgcctggctaaagcgagatgctgagagcatccaccagtacctccttcagcggaaggcctcaccacccacagtgtgaatcctgaggtgccgccattggcggttctgctgcttcgctgcagggataaggtggagctaccgaacagctgattcatatgccaagaatttggagtcttctttcaaaccagtgggggttggacaatgaatgtagttaactggttcctgctcacactccagaattaaattctattgaaaaaggaaaatcagcaattcagcaaaaaataaataaaaaataaaaatgtaaatatgatagtaataaaatagagcataacgaaactgtgaaactttctgaagccttgtcagtggttaaaagtatttaacactctactgttaatgacagatgttctgtttttataacctaccaaaaggaaactagaggcttcttggtgaagagcatttttgtgaagtgggttctgcaaggagcctataaagccaagggtggtgtccatttctgggaatggttaaacacaaaaggctgatagctggtatcacatagttggagtcagtgcataattccaagtggctttttttttttttggcacggggactgatcaggaagatatattcctgcataactcaatctgaaccaaggattgtagtttagttttcctccttgccttcccttctgtgtgaccgaccccttggccaaaaaaaaacaaaaagcaaaaaacaaaaacctaccctgttctggtttttttcctccctttagttccacccccaacccccattccctggtgtccttcttagagatgaagaaataataaggaaacatctttcatagccacattaaataagagaaactgatatacattatttttttctttttaaagatgacttataagaaccctgaaatttatataggtgagacaatagaaataaaaagatcttcagccaggcctttctgaaggagttattctgctaaaaatggtcttagttgtctgaaaagccagctcttgaacctcttcacaacagtatcaacactggcttctcccggttcattttatgcgtgcgagaagtcagtggtaactgctgcagggcttaatacattagtggtaactggtttaaaaaacaaagactgtaagcctgtgtgtgccactgtttgcttcaacagtatatcctaataagcctcacctatttaatccaatgagttttaaatctaaatctcattcccttcttctttccctaccttttttttctttttttcttaaaaaaatattttgtgttattaacagaaattcatatttggtgtggcttaacggtatttcagaaggtcatcagattgtgagactgcttccttgaaacatttttgtgctattgttttaaaaaaataattaaaaaacagttggcgttaataaaaatgtcaatgtgaaactga

SEQ ID NO: 106897 - DNA, 534 bp, Homo sapiens
  Payload ID: 994
  Gene Symbol: NPEPPS
  Gene Name: aminopeptidase puromycin sensitive
  ENST ID: ENST00000525048
  CDS Start-End: 1-197
tgaaaaatgtcaaaccagaccaatgggtgaagttaaacttaggaacagttgggttttatcggacccagtacagctctgccatgctggaaagtttattaccaggcattcgtgacctttctctgccccctgtggatcgacttggattacagaatgacctcttctccttgacttctatgaggaaatccaggagtttgtgaaagatgtcttttcacctataggggagagactgggctgggaccccaaacctggagaaggtcatctcgatgcactcctgaggggcttggttctgggaaaactaggaaaagcaggacataaggcaacgttagaagaagcccgtcgtcggtttaaggaccacgtggaaggaaaacagattctctccgctgatctgaggagtcctgtctatctgactgttttgaagcatggtgatggcactactttagatattatgttaaaacttcataaacaagcagatatgcaagaagagaaaaaccgaatcgaaagagtccttggcgctactcttttgcctgacctgat

SEQ ID NO: 106898 - DNA, 2864 bp, Homo sapiens
  Payload ID: 994
  Gene Symbol: NPEPPS
  Gene Name: aminopeptidase puromycin sensitive
  ENST ID: ENST00000530173
  CDS Start-End: 31-2778
aagttacggaagagtcaaggctgggacctcatggcatcattttccatggattgctctccaagtttttgtgttcctggcctttggaaccccttcatcatattccgcagccgctcctctcgccgccgcctccacagcctgggcctcgccgcgatgccggagaagaggcccttcgagcggctgcctgccgatgtctcccccatcaactacagcctttgcctcaagcccgacttgctggacttcaccttcgagggcaagctggaggccgccgcccaggtgaggcaggcgactaatcagattgtgatgaattgtgctgatattgatattattacagcttcatatgcaccagaaggagatgaagaaatacatgctacaggatttaactatcagaatgaagatgaaaaagtcaccttgtctttccctagtactctgcaaacaggtacgggaaccttaaagatagattttgttggagagctgaatgacaaaatgaaaggtttctatagaagtaaatatactaccccttctggagaggtgcgctatgctgctgtaacacagtttgaggctactgatgcccgaagggcttttccttgctgggatgagcctgctatcaaagcaacttttgatatctcattggttgttcctaaagacagagtagctttatcaaacatgaatgtaattgaccggaaaccataccctgatgatgaaaatttagtggaagtgaagtttgcccgcacacctgttatgtctacatatctggtggcatttgttgtgggtgaatatgactttgtagaaacaaggtcaaaagatggtgtgtgtgtccgtgtttacactcctgttggcaaagcagagcaaggaaaatttgcgttagaggttgctgctaaaaccttgcctttttataaggactacttcaatgttccttatcctctacctaaaattgatctcattgctattgcagactttgcagctggtgccatggagaactggggccttgttacttatagggagactgcattgcttattgatccaaaaaattcctgttcttcatcccgccagtgggttgctctggttgtgggacatgaactcgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccacagaggatctctgggaaagtttagaaaatgctagtggtaaacctatagcagctgtgatgaatacctggaccaaacaaatgggatttcccctcatttatgtggaagctgaacaggtagaagatgacagattattgaggttgtcccaaaagaagttctgtgctggtgggtcatatgttggtgaagattgtccccagtggatggtccctatcacaatctctactagtgaagaccccaaccaggccaaactaaaaattctaatggacaagccagagatgaatgtggttttgaaaaatgtcaaaccagaccaatgggtgaagttaaacttaggaacagttgggttttatcggacccagtacagctctgccatgctggaaagtttattaccaggcattcgtgacctttctctgccccctgtggatcgacttggattacagaatgacctcttctccttggctcgagctggaatcattagcactgtagaggttctaaaagtcatggaggcttttgtgaatgagcccaattatactgtatggagcgacctgagctgtaacctggggattctctcaactctcttgtcccacacagacttctatgaggaaatccaggagtttgtgaaagatgtcttttcacctataggggagagactgggctgggaccccaaacctggagaaggtcatctcgatgcactcctgaggggcttggttctgggaaaactaggaaaagcaggacataaggcaacgttagaagaagcccgtcgtcggtttaaggaccacgtggaaggaaaacagattctctccgctgatctgaggagtcctgtctatctgactgttttgaagcatggtgatggcactactttagatattatgttaaaacttcataaacaagcagatatgcaagaagagaaaaaccgaatcgaaagagtccttggcgctactcttttgcctgacctgattcaaaaagtcctcacgtttgcactttcagaagaggtacgtccacaggacactgtatcggtaattggtggagtagctggaggcagcaagcatggtaggaaagctgcttggaaattcataaaggacaactgggaagaactttataaccgataccagggaggattcttaatatccagactaataaagctatcagttgagggatttgcagttgataaaatggctggagaggttaaggctttcttcgagagtcacccagctccttcagctgagcgtaccatccagcagtgttgtgaaaatattctgctgaatgctgcctggctaaagcgagatgctgagagcatccaccagtacctccttcagcggaaggcctcaccacccacagtgtgaatcctgaggtgccgccattggcggttctgctgcttcgctgcagggataaggtggagctaccgaacagctgattcatatgccaagaa

SEQ ID NO: 106899 - DNA, 558 bp, Homo sapiens
  Payload ID: 994
  Gene Symbol: NPEPPS
  Gene Name: aminopeptidase puromycin sensitive
  ENST ID: ENST00000528565
  CDS Start-End: 1-510
cttcataaacaagcagatatgcaagaagagaaaaaccgaatcgaaagagtccttggcgctactcttttgcctgacctgattcaaaaagtcctcacgtttgcactttcagaagaggtacgtccacaggacactgtatcggtaattggtggagtagctggaggcagcaagcatggtaggaaagctgcttggaaattcataaaggacaactgggaagaactttataaccgataccagggaggattcttaatatccagactaataaaggtgcagtggctcacgcctgtaataccagcactttgggacgccgagctatcagttgagggatttgcagttgataaaatggctggagaggttaaggctttcttcgagagtcacccagctccttcagctgagcgtaccatccagcagtgttgtgaaaatattctgctgaatgctgcctggctaaagcgagatgctgagagcatccaccagtacctccttcagcggaaggcctcaccacccacagtgtgaatcctgaggtgccgccattggcggttctgctgcttcgctgcagggata

SEQ ID NO: 106900 - DNA, 548 bp, Homo sapiens
  Payload ID: 994
  Gene Symbol: NPEPPS
  Gene Name: aminopeptidase puromycin sensitive
  ENST ID: ENST00000534691
  CDS Start-End: 1-426
agccgctcctctcgccgccgcctccacagcctgggcctcgccgcgatgccggagaagaggcccttcgagcggctgcctgccgatgtctcccccatcaactacagcctttgcctcaagcccgacttgctggacttcaccttcgagggcaagctggaggccgccgcccaggtgaggcaggcgactaatcagattgtgatgaattgtgctgatattgatattattacagcttcatatgcaccagaaggagatgaagaaatacatgctacaggatttaactatcagaatgaagatgaaaaagtcaccttgtctttccctagtactctgcaaacaggtacgggaaccttaaagatagattttgttggagagctgaatgacaaaatgaaaggtttctatagaattaatgcctggcttgttgcctggcactgaagagaaagtaaatatttgaacaagggaatgaatgaatgacagagggaaatggtgactgctttatgaaataacttgttaggttaattctaagacagagtagctttatcaaacatgaatgtaat

SEQ ID NO: 106901 - DNA, 678 bp, Homo sapiens
  Payload ID: 994
  Gene Symbol: NPEPPS
  Gene Name: aminopeptidase puromycin sensitive
  ENST ID: ENST00000526247
  CDS Start-End: 20-424
gagtcaaggctgggacctcatggcatcattttccatggattgctctccaagtttttgtgttcctggcctttggaaccccttcatcatattccgcagccgctcctctcgccgccgcctccacagcctgggcctcgccgcgatgccggagaagaggcccttcgagcggctgcctgccgatgtctcccccatcaactacagcctttgcctcaagcccgacttgctggacttcaccttcgagggcaagctggaggccgccgcccaggtgaggcaggcgactaatcagattgtgatgaattgtgctgatattgatattattacagcttcatatgcaccagaaggagatgaagtgtctgggcttcagatgttcagaagtttaatcacattccacttgtggactgcttttcttcttgttcatctttcctgaaatacatgctacaggatttaactatcagaatgaagatgaaaaagtcaccttgtctttccctagtactctgcaaacagtatgccactttttggaagtggtcactgtcaatatcttgttatggtttgatggccttggagatttaaaaccgagtaaaagtgtacgggaaccttaaagatagattttgttggagagctgaatgacaaaatgaaaggtttctatagaagctactgatgcccgaagggcttttccttgct

SEQ ID NO: 106902 - DNA, 711 bp, Homo sapiens
  Payload ID: 994
  Gene Symbol: NPEPPS
  Gene Name: aminopeptidase puromycin sensitive
  ENST ID: ENST00000532729
  CDS Start-End: 11-547
ctgggacctcatggcatcattttccatggattgctctccaagtttttgtgttcctggcctttggaaccccttcatcatattccgcagccgctcctctcgccgccgcctccacagcctgggcctcgccgcgatgccggagaagaggcccttcgagcggctgcctgccgatgtctcccccatcaactacagcctttgcctcaagcccgacttgctggacttcaccttcgagggcaagctggaggccgccgcccaggtgaggcaggcgactaatcagattgtgatgaattgtgctgatattgatattattacagcttcatatgcaccagaaggagatgaagaaatacatgctacaggatttaactatcagaatgaagatgaaaaagtcaccttgtctttccctagtactctgcaaacaggtaataactctttccaatactttgtattttgtttagtatgccactttttggaagtggtcactgtcaatatcttgttatggtttgatggccttggagatttaaaaccgagtaaaagtgtacgggaaccttaaagatagattttgttggagagctgaatgacaaaatgaaaggtttctatagaagtaaatatactaccccttctggagaggtgcgctatgctgctgtaacacagtttgaggctactgatgcccgaagggcttttccttgctgggatgagcctgctatcaaagcaact

SEQ ID NO: 106903 - DNA, 1569 bp, Homo sapiens
  Payload ID: 994
  Gene Symbol: NPEPPS
  Gene Name: aminopeptidase puromycin sensitive
  ENST ID: ENST00000527298
  CDS Start-End: 20-511
ggtcgcccgcgctcggtggatgtggctggcagctgccgccccctccctcgctcgccgcctgctcttcctcggccctccgcctcctcccctcctccttctcgtcttcagccgctcctctcgccgccgcctccacagcctgggcctcgccgcgatgccggagaagaggcccttcgagcggctgcctgccgatgtctcccccatcaactacagcctttgcctcaagcccgacttgctggacttcaccttcgagggcaagctggaggccgccgcccaggtgaggcaggcgactaatcagattgtgatgaattgtgctgatattgatattattacagcttcatatgcaccagaaggagatgaagaaatacatgctacaggatttaactatcagaatgaagatgaaaaagtcaccttgtctttccctagtactctgcaaacaggtacgggaaccttaaagatagattttgttggagagctgaatgacaaaatgaaaggtttctatagaagctactgatgcccgaagggcttttccttgctgggatgagcctgctatcaaagcaacttttgatatctcattggttgttcctaaagacagagtagctttatcaaacatgaatgtaattgaccggaaaccataccctgatgatgaaaatttagtggaagtgaagtttgcccgcacacctgttatgtctacatatctggtggcatttgttgtgggtgaatatgactttgtagaaacaaggtcaaaagatggtgtgtgtgtccgtgtttacactcctgttggcaaagcagagcaaggaaaatttgcgttagaggtaaatgtacttgaagaggattgttccaacagtccataactccaggttgctgctaaaaccttgcctttttataaggactacttcaatgttccttatcctctacctaaaattgatctcattgctattgcagactttgcagctggtgccatggagaactggggccttgttacttatagggagactgcattgcttattgatccaaaaaattcctgttcttcatcccgccagtgggttgctctggttgtgggacatgaactcgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccacaggtaatctctaatagcttgagatagaaatggagagaaagtattgtcactctatccaggctgggacattttatttttgttctgaatacttaaggtcaggatccatgtaataaataaattagccttatttgaagctgt

SEQ ID NO: 106904 - DNA, 554 bp, Homo sapiens
  Payload ID: 994
  Gene Symbol: NPEPPS
  Gene Name: aminopeptidase puromycin sensitive
  ENST ID: ENST00000527964
  CDS Start-End: 80-554
attttgtgacttttgatgcaagagtatatatatatatatatatatcaataaatgtttatatttattttgtgaaggtgccatggagaactggggccttgttacttatagggagactgcattgcttattgatccaaaaaattcctgttcttcatcccgccagtgggttgctctggttgtgggacatgaactcgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccacag

SEQ ID NO: 106905 - DNA, 534 bp, Homo sapiens
  Payload ID: 994
  Gene Symbol: NPEPPS
  Gene Name: aminopeptidase puromycin sensitive
  ENST ID: ENST00000527360
  CDS Start-End: 18-534
tattttgtgaaggtgccatggagaactggggccttgttacttatagtagtttcatagctatttatccagcttggagaaccttccctaatttcatatcttctagccaagtttttacatgtctgtcaccacaacataaacattgggttgctctggttgtgggacatgaactcgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccacag

SEQ ID NO: 106906 - DNA, 2092 bp, Homo sapiens
  Payload ID: 994
  Gene Symbol: NPEPPS
  Gene Name: aminopeptidase puromycin sensitive
  ENST ID: ENST00000530514
  CDS Start-End: 35-418
caataaatgtttatatttattttgtgaaggtgccatggagaactggggccttgttacttatagggagactgcattgcttattgatccaaaaaattcctgttcttcatcccgccagtgggttgctctggttgtgggacatgaactcgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaatattacaggctatctgcttcctgtcataaccctgaatcacactgtctgccaggtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccacagaggatctctgggaaagtttagaaaatgctagtggtaaacctatagcagctgtgatgaatacctggaccaaacaaatgggatttcccctcatttatgtggaagctgaacaggtagaagatgacagattattgaggttgtcccaaaagaagttctgtgctggtgggtcatatgttggtgaagattgtccccagtggatggtccctatcacaatctctactagtgaagaccccaaccaggccaaactaaaaattctaatggacaagccagagatgaatgtggttttgaaaaatgtcaaaccagaccaatgggtgaagttaaacttaggaacagttgggttttatcggacccagtacagctctgccatgctggaaagtttattaccaggcattcgtgacctttctctgccccctgtggatcgacttggattacagaatgacctcttctccttggctcgagctggaatcattagcactgtagaggttctaaaagtcatggaggcttttgtgaatgagcccaattatactgtatggagcgacctgagctgtaacctggggattctctcaactctcttgtcccacacagacttctatgaggaaatccaggagtttgtgaaagatgtcttttcacctataggggagagactgggctgggaccccaaacctggagaaggtcatctcgatgcactcctgaggggcttggttctgggaaaactaggaaaagcaggacataaggcaacgttagaagaagcccgtcgtcggtttaaggaccacgtggaaggaaaacagattctctccgctgatctgaggagtcctgtctatctgactgttttgaagcatggtgatggcactactttagatattatgttaaaacttcataaacaagcagatatgcaagaagagaaaaaccgaatcgaaagagtccttggcgctactcttttgcctgacctgattcaaaaagtcctcacgtttgcactttcagaagaggtacgtccacaggacactgtatcggtaattggtggagtagctggaggcagcaagcatggtaggaaagctgcttggaaattcataaaggacaactgggaagaactttataaccgataccagggaggattcttaatatccagactaataaagctatcagttgagggatttgcagttgataaaatggctggagaggttaaggctttcttcgagagtcacccagctccttcagctgagcgtaccatccagcagtgttgtgaaaatattctgctgaatgctgcctggctaaagcgagatgctgagagcatccaccagtacctccttcagcggaaggcctcaccacccacagtgtgaatcctgaggtgccgccattggcggttctgctgcttcgctgcagggataaggtggagctaccgaacagctgattcatatgccaagaatttggagtcttctttcaaaccagtgggggttggacaatgaatgtagttaactggttcctgctcacactccagaattaaattctattgaaaaaggaaaatcagcaattcagc

SEQ ID NO: 106907 - DNA, 649 bp, Homo sapiens
  Payload ID: 994
  Gene Symbol: NPEPPS
  Gene Name: aminopeptidase puromycin sensitive
  ENST ID: ENST00000525007
  CDS Start-End: 46-649
ttcaacagccattttaagttacggaagagtcaaggctgggacctcatggcatcattttccatggattgctctccaagtttttgtgttcctggcctttggaaccccttcatcatattccgcagcctgggcctcgccgcgatgccggagaagaggcccttcgagcggctgcctgccgatgtctcccccatcaactacagcctttgcctcaagcccgacttgctggacttcaccttcgagggcaagctggaggccgccgcccaggtgaggcaggcgactaatcagattgtgatgaattgtgctgatattgatattattacagcttcatatgcaccagaaggagatgaagaaatacatgctacaggatttaactatcagaatgaagatgaaaaagtcaccttgtctttccctagtactctgcaaacaggtacgggaaccttaaagatagattttgttggagagctgaatgacaaaatgaaaggtttctatagaagtaaatatactaccccttctggagaggtgcgctatgctgctgtaacacagtttgaggctactgatgcccgaagggcttttccttgctgggatgagcctgctatcaaagcaacttttgatatctcattggttgttcctaaagacagagtagctttatcaa

SEQ ID NO: 106908 - DNA, 2378 bp, Homo sapiens
  Payload ID: 995
  Gene Symbol: NPEPL1
  Gene Name: aminopeptidase-like 1
  Uniprot ID: Q8NDH3
  ENST ID: ENST00000356091
  CDS Start-End: 289-1860
tggaggccgggcgcgcgggccctactcggcagggcctgctcggggccggcttcgggcctgcccggccgggcctgcccgcacccttccgcccggcctggccggcgccccctcgcgccccgggcgggccctgcacgtctcgcgagcagcccggagcggcgggggaggcggggcccgcgggctgccgggcagggccggggcggtgccgaggccgggccggagcggggcgaagggggccgagcggcgggccgggccgggccgggcagggccggggcgtgggccggcaggaagatggcgaacgtggggctgcagttccaggcgagcgcgggggactcggacccacagagccggcccctgctgctgctcgggcagctgcaccacctgcaccgcgtgccctggagccacgtccgcgggaagctgcagccccgggtcaccgaggagctctggcaggctgccctgagcacgctcaaccccaaccccacggacagctgtcccctctacctgaactacgccaccgtggctgccctgccctgcagggtgagccggcacaacagcccctcggccgcccacttcatcacgcggctggtgcggacctgcctgccgcccggagcgcatcgctgcattgtgatggtctgcgagcagccggaggtctttgcttccgcctgtgccctggcccgggccttcccgctgttcacccaccgctcaggtgcctctcggcgcttggagaagaagacggtcaccgtggagtttttcctggtgggacaagacaacgggccggtggaggtgtccacattgcagtgcttagcgaatgccacagacggcgtgcggctagcagcccgcatcgtggacacaccctgcaatgagatgaacaccgacaccttcctcgaggagattaacaaagttggaaaggagctggggatcatcccaaccatcatccgggatgaggaactgaagacgagaggatttggaggaatctatggggttggcaaagccgccctgcatcccccagccctggccgtcctcagccacaccccagatggagccacgcagaccatcgcctgggtgggcaaaggcatcgtctatgacactggaggcctcagcatcaaagggaagactaccatgccggggatgaagcgagactgcgggggtgctgcggccgtcctgggggccttcagagccgcaatcaagcagggtttcaaagacaacctccacgctgtgttctgcttggctgagaactcggtggggcccaatgcgacaaggccagatgacatccacctgctgtactcagggaagacggtggaaatcaacaacacggatgccgagggcaggctggtgctggcagatggcgtgtcctatgcttgcaaggacctgggggccgacatcatcctggacatggccaccctgaccggggctcagggcattgccacagggaagtaccacgccgcggtgctcaccaacagcgctgagtgggaggccgcctgtgtgaaggcgggcaggaagtgtggggacctggtgcacccgctggtctactgccccgagctgcacttcagcgagttcacctcagctgtggcggacatgaagaactcagtggcggaccgagacaacagccccagctcctgtgctggcctcttcatcgcctcacacatcggcttcgactggcccggagtctgggtccacctggacattgctgcaccggtgcatgctggtgagcgagccacaggcttcggtgtggccctcctgctggcgctcttcggccgtgcctctgaggaccctctgctgaacctggtgtccccactgggctgtgaggtggatgtcgaggagggggacctggggagggactccaagagacgcaggcttgtgtgagcctcctgcctcggccctgacaaacggggatcttttacctcactttgcactgattaattttaagcaattgaaagattgcccttcatatgggttttggtttgtctttctggtcgtcagcgtggtggtggaaacagctgaagttttaggagacagcttagggtttggtgcgggccacggggaggggaccgggaagcgctggggcttgtttctgtttgttacttacaggactgagacatcttctgtaaactgctacccctggggccttctgcaccccggggtgaggcctcctgcctgcctggtgccctgtcccagccccaggtcctgtgcagggcacctgcgtggctgacagccaggctcttactccagccggggctgccagcgcatccagccagcccagccctgtgaaagatggagctgacttgctgcaggggacctgatttatagggcaagagaagtcacactccggcctctcagaattcacttgaggttcaattaaatacagtcacaccgccccctca

SEQ ID NO: 106909 - DNA, 1917 bp, Homo sapiens
  Payload ID: 995
  Gene Symbol: NPEPL1
  Gene Name: aminopeptidase-like 1
  Uniprot ID: Q8NDH3
  ENST ID: ENST00000525967
  CDS Start-End: 123-1610
cttccttgcttccacttcaggcctgcctgaggcacttccactggtctccagttacttgcaaggtcaagtacaacctgcaaggctggttatgaagaagaaactcaaaataacaggagtggcttatggaactacatggaggtaacagaggagggtaccaaccaaaggcccttgagcaatcaggatgttggctctggcaggctgccctgagcacgctcaaccccaaccccacggacagctgtcccctctacctgaactacgccaccgtggctgccctgccctgcagggtgagccggcacaacagcccctcggccgcccacttcatcacgcggctggtgcggacctgcctgccgcccggagcgcatcgctgcattgtgatggtctgcgagcagccggaggtctttgcttccgcctgtgccctggcccgggccttcccgctgttcacccaccgctcaggtgcctctcggcgcttggagaagaagacggtcaccgtggagtttttcctggtgggacaagacaacgggccggtggaggtgtccacattgcagtgcttagcgaatgccacagacggcgtgcggctagcagcccgcatcgtggacacaccctgcaatgagatgaacaccgacaccttcctcgaggagattaacaaagttggaaaggagctggggatcatcccaaccatcatccgggatgaggaactgaagacgagaggatttggaggaatctatggggttggcaaagccgccctgcatcccccagccctggccgtcctcagccacaccccagatggagccacgcagaccatcgcctgggtgggcaaaggcatcgtctatgacactggaggcctcagcatcaaagggaagactaccatgccggggatgaagcgagactgcgggggtgctgcggccgtcctgggggccttcagagccgcaatcaagcagggtttcaaagacaacctccacgctgtgttctgcttggctgagaactcggtggggcccaatgcgacaaggccagatgacatccacctgctgtactcagggaagacggtggaaatcaacaacacggatgccgagggcaggctggtgctggcagatggcgtgtcctatgcttgcaaggacctgggggccgacatcatcctggacatggccaccctgaccggggctcagggcattgccacagggaagtaccacgccgcggtgctcaccaacagcgctgagtgggaggccgcctgtgtgaaggcgggcaggaagtgtggggacctggtgcacccgctggtctactgccccgagctgcacttcagcgagttcacctcagctgtggcggacatgaagaactcagtggcggaccgagacaacagccccagctcctgtgctggcctcttcatcgcctcacacatcggcttcgactggcccggagtctgggtccacctggacattgctgcaccggtgcatgctggtgagcgagccacaggcttcggtgtggccctcctgctggcgctcttcggccgtgcctctgaggaccctctgctgaacctggtgtccccactgggctgtgaggtggatgtcgaggagggggacctggggagggactccaagagacgcaggcttgtgtgagcctcctgcctcggccctgacaaacggggatcttttacctcactttgcactgattaattttaagcaattgaaagattgcccttcatatgggttttggtttgtctttctggtcgtcagcgtggtggtggaaacagctgaagttttaggagacagcttagggtttggtgcgggccacggggaggggaccgggaagcgctggggcttgtttctgtttgttacttacaggactgagacatcttctgtaaactgctacccctggggccttctgcaccccggggtgaggcctcctgcctgcctggtgccctgt

SEQ ID NO: 106910 - DNA, 899 bp, Homo sapiens
  Payload ID: 995
  Gene Symbol: NPEPL1
  Gene Name: aminopeptidase-like 1
  ENST ID: ENST00000533788
  CDS Start-End: 1-541
gatggtctgcgagcagccggaggtctttgcttccgcctgtgccctggcccgggccttcccgctgttcacccaccgctcaggtgcctctcggcgcttggagaagaagacggtcaccgtggagtttttcctggtgggacaagacaacgggccggtggaggtgtccacattgcagtgcttagcgaatgccacagacggcgtgcggctagcagcccgcatcgtggacacaccctgcaatgagatgaacaccgacaccttcctcgaggagattaacaaagttggaaaggagctggggatcatcccaaccatcatccgggatgaggaactgaagacgagaggatttggaggaatctatggggttggcaaagccgccctgcatcccccagccctggccgtcctcagccacaccccagatggagccacgcagaccatcgcctgggtgggcaaaggcatcgtctatgacactggaggcctcagcatcaaagggaagagggcacggaaacgaatacagtggctcccggacctctttgggactgtggcctgatactccagcacagggggtactaccatgccggggatgaagcgagactgcgggggtgctgcggccgtcctgggggccttcagagccgcaatcaagcagggtttcaaagacaacctccacgctgtgttctgcttggctgagaactcggtggggcccaatgcgacaaggccagatgacatccacctgctgtactcagggaagacggtggaaatcaacaacacggatgccgagggcaggctggtgctggcagatggcgtgtcctatgcttgcaaggacctgggggccgacatcatcctggacatggccaccctgaccggggctcaggtgagtgctccctggatccaccccttagctgtagtcc

SEQ ID NO: 106911 - DNA, 1780 bp, Homo sapiens
  Payload ID: 995
  Gene Symbol: NPEPL1
  Gene Name: aminopeptidase-like 1
  Uniprot ID: Q8NDH3
  ENST ID: ENST00000525817
  CDS Start-End: 129-1556
cttgcttccacttcaggcctgcctgaggcacttccactggtctccagttacttgcaaggtcaagtacaacctgcaaggctggttatgaagaagaaactcaaaataacaggagtggcttatggaactacatggagctctggcaggctgccctgagcacgctcaaccccaaccccacggacagctgtcccctctacctgaactacgccaccgtggctgccctgccctgcagggtgagccggcacaacagcccctcggccgcccacttcatcacgcggctggtgcggacctgcctgccgcccggagcgcatcgctgcattgtgatggtctgcgagcagccggaggtctttgcttccgcctgtgccctggcccgggccttcccgctgttcacccaccgctcaggtgcctctcggcgcttggagaagaagacggtcaccgtggagtttttcctggtgggacaagacaacgggccggtggaggtgtccacattgcagtgcttagcgaatgccacagacggcgtgcggctagcagcccgcatcgtggacacaccctgcaatgagatgaacaccgacaccttcctcgaggagattaacaaagttggaaaggagctggggatcatcccaaccatcatccgggatgaggaactgaagacgagaggatttggaggaatctatggggttggcaaagccgccctgcatcccccagccctggccgtcctcagccacaccccagatggagccacgcagaccatcgcctgggtgggcaaaggcatcgtctatgacactggaggcctcagcatcaaagggaagactaccatgccggggatgaagcgagactgcgggggtgctgcggccgtcctgggggccttcagagccgcaatcaagcagggtttcaaagacaacctccacgctgtgttctgcttggctgagaactcggtggggcccaatgcgacaaggccagatgacatccacctgctgtactcagggaagacggtggaaatcaacaacacggatgccgagggcaggctggtgctggcagatggcgtgtcctatgcttgcaaggacctgggggccgacatcatcctggacatggccaccctgaccggggctcagggcattgccacagggaagtaccacgccgcggtgctcaccaacagcgctgagtgggaggccgcctgtgtgaaggcgggcaggaagtgtggggacctggtgcacccgctggtctactgccccgagctgcacttcagcgagttcacctcagctgtggcggacatgaagaactcagtggcggaccgagacaacagccccagctcctgtgctggcctcttcatcgcctcacacatcggcttcgactggcccggagtctgggtccacctggacattgctgcaccggtgcatgctggtgagcgagccacaggcttcggtgtggccctcctgctggcgctcttcggccgtgcctctgaggaccctctgctgaacctggtgtccccactgggctgtgaggtggatgtcgaggagggggacctggggagggactccaagagacgcaggcttgtgtgagcctcctgcctcggccctgacaaacggggatcttttacctcactttgcactgattaattttaagcaattgaaagattgcccttcatatgggttttggtttgtctttctggtcgtcagcgtggtggtggaaacagctgaagttttaggagacagcttagggtttggtgcgggccacggggaggggaccgggaagcgctggggcttgtttctgtttgttacttaca

SEQ ID NO: 106912 - DNA, 1884 bp, Homo sapiens
  Payload ID: 996
  Gene Symbol: AES
  Gene Name: amino-terminal enhancer of split
  Uniprot ID: Q08117
  ENST ID: ENST00000221561
  CDS Start-End: 181-975
attctcccggctggtttttctgcagaactgtccccaccatctgacctgccaggaattcagcttgtgaatttgtctctgtctgtctccaggcaccaccaccagggcagggacccacccccgccccgccccaccccagggccctggagcagcggggcctggcacacagtaggcgttctataaatgtgtcacaagaatggcttccctcaggaaggcggcattaccgctgcctttctgcagaaaaggaaactaaggctcagcaagaaccaccgcccagccagagccaaggtcacagagcacgtccgtggcacgcgtccaggtcgtgccacagcagggccggcggcttcgacgcgggcagccgggtcccttttctttgacagatggggaaaccgaggcccggccggctgccggggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacaggctgagatcgtcaaaaggctgaacgggatttgtgcccaggtcctgccctacctctcccaagagcaccagcagcaggtcttgggagccattgagagggccaagcaggtcaccgctcccgagctgaactctatcatccgacagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacagggaggttgggaggggggacagaggggagacagaggcacggagagaaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtactaaagttgtcttggtttttattttattattatttttttctttttccagtatactagcttgtcttttaagaaaggggatattaaaaaaaaaaaaagacaaaagtgtttttaaaaaaaagcaacacccacacctgtgtctgtatatagtcagcttatctcgtgttcaatcgtctgatctctacagagagaagtggaaaatgctgtatcaagggtgggcttagctgtgcctttccaataaagatgtgagaagcttc

SEQ ID NO: 106913 - DNA, 1608 bp, Homo sapiens
  Payload ID: 996
  Gene Symbol: AES
  Gene Name: amino-terminal enhancer of split
  Uniprot ID: Q08117
  ENST ID: ENST00000327141
  CDS Start-End: 358-951
gcgcacggggcacgggcggcggcaggtggagccgaagcctccgcagcagccgagccgcggccactgccggcgtcgccgccattagacaatagcggtggggccggggagcggggaggcgggcggcggggaggggcggggaggggcgccgggcgcgcaggaagcggggcccggggcgcgccggggccgggcgcgcggggagggggcgcaggaagcgggcgaggccgggcgcgggaggcggcggcggccccgggagctgccgatcggcgccgggacaaaggcgcggccgcccggcgcccccagcagcccgagccggggcgcacagccggggcgcagcccgcgccccccgccgcgattgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacaggctgagatcgtcaaaaggctgaacgggatttgtgcccaggtcctgccctacctctcccaagagcaccagcagcaggtcttgggagccattgagagggccaagcaggtcaccgctcccgagctgaactctatcatccgacagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacagggaggttgggaggggggacagaggggagacagaggcacggagagaaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtact

SEQ ID NO: 106914 - DNA, 1666 bp, Homo sapiens
  Payload ID: 996
  Gene Symbol: AES
  Gene Name: amino-terminal enhancer of split
  ENST ID: ENST00000586742
  CDS Start-End: 1-793
tgcctttctgcagaaaaggaaactaaggctcagcaagaaccaccgcccagccagagccaaggtcacagagcacgtccgtggcacgcgtccaggtcgtgccacagcagggccggcggcttcgacgcgggcagccgggtcccttttctttgacagatggggaaaccgaggcccggccggctgccggggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacaggctgagatcgtcaaaaggctgaacgggatttgtgcccaggtcctgccctacctctcccaagagcaccagcagcaggtcttgggagccattgagagggccaagcaggtcaccgctcccgagctgaactctatcatccgagtatgtatggggacctgggcgggtgggcgggggacaggtgggccccaggcagctaatgttcccctcccccgccctgcagcagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacagggaggttgggaggggggacagaggggagacagaggcacggagagaaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtactaaagttgtcttggtttttattttattattatttttttctttttccagtatactagcttgtcttttaagaaaggggatattaaaaaaaaaaaaagacaaaagtgtttttaaaaaaaagcaacacccacacctgtgtctgtatatagtcagcttatctcgtgttcaatcgtctgatctcta

SEQ ID NO: 106915 - DNA, 491 bp, Homo sapiens
  Payload ID: 996
  Gene Symbol: AES
  Gene Name: amino-terminal enhancer of split
  ENST ID: ENST00000585557
  CDS Start-End: 211-357
gggcgcgcaggaagcggggcccggggcgcgccggggccgggcgcgcggggagggggcgcaggaagcgggcgaggccgggcgcgggaggcggcggcggccccgggagctgccgatcggcgccgggacaaaggcgcggccgcccggcgcccccagcagcccgagccggggcgcacagccggggcgcagcccgcgccccccgccgcgattgacatgatgtttccacaaagcaggcattcgggctcctcgcacctaccccagcaactcaaattcaccacctcggactcctgcgaccgcatcaaagacgaatttcagctactgcaagctcagtaccacaggctgagatcgtcaaaaggctgaacgggatttgtgcccaggtcctgccctacctctcccaagagcaccagcagcaggtcttgggagccattgagagggccaagcaggtcaccgctcccgagctgaactctatcatccgacagcagctccaagcccac

SEQ ID NO: 106916 - DNA, 942 bp, Homo sapiens
  Payload ID: 996
  Gene Symbol: AES
  Gene Name: amino-terminal enhancer of split
  ENST ID: ENST00000586839
  CDS Start-End: 289-714
ggggtcgcgccaggggccgtaaacacgggcccaggaagtggggcaggagggggggcgccgcagctgcgcggccgctccctcctagccggcccttgaggggggtccagcccacgcctgggcctgacccgggccgccccatccctacagggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacaggctgagatcgtcaaaaggctgaacgggatttgtgcccaggtcctgccctacctctcccaagagcaccagcagcaggtcttgggagccattgagagggccaagcaggtcaccgctcccgagctgaactctatcatccgacagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacagggaggttgggaggggggacagaggggagacagaggcacggagagaaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtgg

SEQ ID NO: 106917 - DNA, 4658 bp, Homo sapiens
  Payload ID: 997
  Gene Symbol: AMMECR1L
  Gene Name: AMMECR1-like
  Uniprot ID: Q6DCA0
  ENST ID: ENST00000272647
  CDS Start-End: 262-1194
ggccagcttctctcgggagcccccacccaggcgcatggctccatgaagcaagaggaggaggcagagcgcgagaggtcccgtccgccccagccgcgtctgggccaggagaaaaggtacaggaagaaggaatggaatcggaaggaagaaaattcattccagagacaaaatagctcccctcctctgttgtagctgttcctctggcaatacaaactttctgctttcaggttctgcagcattccagaccttgagcactgaatcaggatgggaaaaagacgttgtgttcctccactcgagcccaagttggcagcaggctgttgtggggtcaagaagcccaaattatctggaagtggaacgcacagtcacgggaatcagtccacaactgtccccggctctagttcaggacctcttcaaaaccaccagcatgtggacagcagcagtggacgggagaatgtgtcagacttaactctgggacctggaaactctcccatcacacgaatgaatcccgcatcgggagcgctgagccctcttccccggcctaatggaactgccaacaccactaagaatctggtggtgactgcagagatgtgctgctactgcttcgacgtactctactgtcacctctatggcttcccacagccacgacttcctagattcaccaatgacccctatccgctctttgtgacgtggaagacagggcgggacaagcggcttcgtggctgcattgggaccttctcagccatgaatcttcattcaggactcagggaatacacgttaaccagtgcacttaaggacagccgatttccccccctgacccgagaggagctgcctaaacttttctgctctgtctccctccttactaactttgaggatgccagtgattacctggactgggaggtaggggtccatgggattcgaattgaattcattaatgaaaaaggtgtcaaacgcacagccacatatttacctgaggttgctaaggaacaagactgggatcagatccagacaatagactccttgctcaggaaaggtggctttaaagctccaattaccagtgaattcagaaaaacgatcaaactcaccaggtaccgaagtgagaaggtgacaatcagttacgcagagtatattgcttcccgacagcactgtttccagaacggcactcttcatgccccgcccctctacaatcattactcctgacacacggctgcatgaccagtcccacccccccgtggccaccaatggctatgacatcattggagcagatgcctcctcttcctggtccagttacttctattactgcaccattttatgatgctagcttccgttgccaagtctgcctcccgctgactgagggagggtagggttaccttgaacgaaacagaacttgaggggcccaagccttatctcagcctttcctcaatatggggttccgttggattggggctcctccatgactagtgggaattactgtgggttcagaagacccttgtctggtatttgccacatggggtattggccacacgctggaagctgaaattgatgatccctgaaggttgaacccacacacacccctgcagcctccccagatgaagtaggtgtattcccctggcagtctgggcaacggagaccaagaaacatttttaggttgttttaaattcctttttttaaacttccagtttattgcgtaccaagagttgattacaacctccatgcttcataagcggacgccacgttagggttggacgtgggcaccacgagtcctttgaggctcctggacagagacccacatcaagatcggaagccctttgggtggcgttgcagatctcattgctcagtaggccgtgaagattttcatcctcatcccactctcagttggattttctggcactcttcctgcattgagtctcctgattactgaacagagctccgtcatgtagcctgctgaggaatggaatggaatggagatgcccacaggaggtcctgatgtcatcactgcacgcaggtgtgagaggagagacctcttctgcaccgcctggctacctcactcctctgctggtagcagtgcctatagctggacctaagttctcagaagcgtagatgtgcaaacaagcgattgagttgggctttaggaggacacatcataggagagaatccagggtctgtaagctggttttcttttcaggtgacatcctgaggggcctgtaagcaggggagctcctttttctagtttgcctgtagaggtgggaagactgttggtgtttctgtcctttacaggacattaggaaacagttgtgtaattacacaaggtggacctttatcttgcctgacatgctgggaatcttcaccccaccagggcaaatttccaaatagctcattttattctaggtctttcaaactttcatgtgacatatttccctttcccattgttgctgatttccaaatcgctgtcagcaattttttcctctctccttgcctattcttcactcatttggtggcaaagttcatagaactaggggacttggaagatgctttgaaaatattgttacaaaggcactgctaaaatgattcacagggagagtggccagttggaagaaggatcctaaggatgtgacactggttttcaacaacatgcttagagaactcatgaagtggattgggtgtcaacccagtgaacatgtttttatttaatttattttttgaagtttatgtggtgatggtgtggctttccgaaatgggcaaatattcagaagatcttttgcattttcttctgtcaggaatggggaaggggagtgggggcacaatctgagaaaggacacctgtgctgttctaggcatcgctggcaagtttgtgggaagggatgggcaagggtgagtgggtttgctccacaccgtcctgtgctgctcgagaggacctgggacgtgcgagggaaacgtgggtgacggtgcctaggctgcggcccttcactgctgtgctgggttcctgcagcctgctacgtttcccttggcaatgtaaatgaagatggaggggtcgtttcgtgatttcctgctgctgagaataaatgtcttgttaaaaacgtggcaacggttactcttaggtgccatggatcgatgtcagggtggtcagctctggactaagccacccacctccaatttgtacaacagtattgatacatagggctacactcattactgttcaagtgttctatgttaagagttgtgtttaatttctaaagattaaaaaaagcaaaaaaattggtgctaaaccttcacccctgagcacgctcagtgagactggtcatgcaagcatttacagtgccatgctcctcaagccgattttttcttgtagaaatgttgccctatttgtcttctccaatgtatggtatgttattttattttattattttattttattttattttattttatcgagggggggtacgatacctgccatttaagaaaatgaatagaaaattttaaaacccgagaaatggggaaaaaaaaatcagtgcacaagaattgggctggttaggcccagcaccacactgaagtgggctcagtggtttttggagtgaagaagccttactccctgcacattccctcatgctcccacacaagtccagcaatggaaatgcttgggttcctcttgctttgtcaggggactcaggagtcgaccaagggaaaccatttggccccgtgaggaatgggcattgtcagtatccgtcctgaacggggcctagtcaggaagcggtctagaagtgtacggtcacggtcgcctcatgaaagtgtgtagcaggtggctctcaggaaaaataccaagtctggatcatccatgtggcagctttgcatagggagaggatagctccgaactggaactgaactgccttctctgcacgcttgaccaaagcagtgatgagggcggccagtacctgcggtgtgcgtggtaggtttaaagaaaagggaatgttttctgctgagtgtttcctttgtccttgggctgctcgagctggacagtaggtaaccactgttttcaaggaccagcccaatttctctggcttggttcggagttcgtttcatccctagctgtgagtgccttttggtctggaaagttggcttgtctcataatacccacagctaggacattctctctgtaattatgaattgtccttgttttacattaaaagagaatgtctttgatcactagagtctgtcggtgttggattatttccactgtgagattcttaaaacttttttgcttcataataataaaacaactcatgttagagaccctttcaacatgaaaggtttgtagttgagacattacatatattttattgtttataataaaaatcatctatacaaaagaagtcctgggtgttaatattttgcacaagatctgttttccatgatgtgttgacatctacaatttcactaactgttgacgttattttctattgagattctggagcctagggagctatgtgttctttttgttcatttcgttcttacttccctgaagcaagagactatatggccttcagtgcaaagacttcagaccaattctttgtattacacttggttgcctcttggctatataacttctgagtgcaaatcattgaacactttaacgaagtattgtagagaataaatcataatggataaaaa

SEQ ID NO: 106918 - DNA, 4641 bp, Homo sapiens
  Payload ID: 997
  Gene Symbol: AMMECR1L
  Gene Name: AMMECR1-like
  Uniprot ID: Q6DCA0
  ENST ID: ENST00000393001
  CDS Start-End: 252-1184
gttggtgaagagatcaggaagagatttcttcgagactaaggatggatgacccttagcaacagtgaccgtctcctcccggcatagcaagatggcctgccctcaggtacaggaagaaggaatggaatcggaaggaagaaaattcattccagagacaaaatagctcccctcctctgttgtagctgttcctctggcaatacaaactttctgctttcaggttctgcagcattccagaccttgagcactgaatcaggatgggaaaaagacgttgtgttcctccactcgagcccaagttggcagcaggctgttgtggggtcaagaagcccaaattatctggaagtggaacgcacagtcacgggaatcagtccacaactgtccccggctctagttcaggacctcttcaaaaccaccagcatgtggacagcagcagtggacgggagaatgtgtcagacttaactctgggacctggaaactctcccatcacacgaatgaatcccgcatcgggagcgctgagccctcttccccggcctaatggaactgccaacaccactaagaatctggtggtgactgcagagatgtgctgctactgcttcgacgtactctactgtcacctctatggcttcccacagccacgacttcctagattcaccaatgacccctatccgctctttgtgacgtggaagacagggcgggacaagcggcttcgtggctgcattgggaccttctcagccatgaatcttcattcaggactcagggaatacacgttaaccagtgcacttaaggacagccgatttccccccctgacccgagaggagctgcctaaacttttctgctctgtctccctccttactaactttgaggatgccagtgattacctggactgggaggtaggggtccatgggattcgaattgaattcattaatgaaaaaggtgtcaaacgcacagccacatatttacctgaggttgctaaggaacaagactgggatcagatccagacaatagactccttgctcaggaaaggtggctttaaagctccaattaccagtgaattcagaaaaacgatcaaactcaccaggtaccgaagtgagaaggtgacaatcagttacgcagagtatattgcttcccgacagcactgtttccagaacggcactcttcatgccccgcccctctacaatcattactcctgacacacggctgcatgaccagtcccacccccccgtggccaccaatggctatgacatcattggagcagatgcctcctcttcctggtccagttacttctattactgcaccattttatgatgctagcttccgttgccaagtctgcctcccgctgactgagggagggtagggttaccttgaacgaaacagaacttgaggggcccaagccttatctcagcctttcctcaatatggggttccgttggattggggctcctccatgactagtgggaattactgtgggttcagaagacccttgtctggtatttgccacatggggtattggccacacgctggaagctgaaattgatgatccctgaaggttgaacccacacacacccctgcagcctccccagatgaagtaggtgtattcccctggcagtctgggcaacggagaccaagaaacatttttaggttgttttaaattcctttttttaaacttccagtttattgcgtaccaagagttgattacaacctccatgcttcataagcggacgccacgttagggttggacgtgggcaccacgagtcctttgaggctcctggacagagacccacatcaagatcggaagccctttgggtggcgttgcagatctcattgctcagtaggccgtgaagattttcatcctcatcccactctcagttggattttctggcactcttcctgcattgagtctcctgattactgaacagagctccgtcatgtagcctgctgaggaatggaatggaatggagatgcccacaggaggtcctgatgtcatcactgcacgcaggtgtgagaggagagacctcttctgcaccgcctggctacctcactcctctgctggtagcagtgcctatagctggacctaagttctcagaagcgtagatgtgcaaacaagcgattgagttgggctttaggaggacacatcataggagagaatccagggtctgtaagctggttttcttttcaggtgacatcctgaggggcctgtaagcaggggagctcctttttctagtttgcctgtagaggtgggaagactgttggtgtttctgtcctttacaggacattaggaaacagttgtgtaattacacaaggtggacctttatcttgcctgacatgctgggaatcttcaccccaccagggcaaatttccaaatagctcattttattctaggtctttcaaactttcatgtgacatatttccctttcccattgttgctgatttccaaatcgctgtcagcaattttttcctctctccttgcctattcttcactcatttggtggcaaagttcatagaactaggggacttggaagatgctttgaaaatattgttacaaaggcactgctaaaatgattcacagggagagtggccagttggaagaaggatcctaaggatgtgacactggttttcaacaacatgcttagagaactcatgaagtggattgggtgtcaacccagtgaacatgtttttatttaatttattttttgaagtttatgtggtgatggtgtggctttccgaaatgggcaaatattcagaagatcttttgcattttcttctgtcaggaatggggaaggggagtgggggcacaatctgagaaaggacacctgtgctgttctaggcatcgctggcaagtttgtgggaagggatgggcaagggtgagtgggtttgctccacaccgtcctgtgctgctcgagaggacctgggacgtgcgagggaaacgtgggtgacggtgcctaggctgcggcccttcactgctgtgctgggttcctgcagcctgctacgtttcccttggcaatgtaaatgaagatggaggggtcgtttcgtgatttcctgctgctgagaataaatgtcttgttaaaaacgtggcaacggttactcttaggtgccatggatcgatgtcagggtggtcagctctggactaagccacccacctccaatttgtacaacagtattgatacatagggctacactcattactgttcaagtgttctatgttaagagttgtgtttaatttctaaagattaaaaaaagcaaaaaaattggtgctaaaccttcacccctgagcacgctcagtgagactggtcatgcaagcatttacagtgccatgctcctcaagccgattttttcttgtagaaatgttgccctatttgtcttctccaatgtatggtatgttattttattttattattttattttattttattttattttatcgagggggggtacgatacctgccatttaagaaaatgaatagaaaattttaaaacccgagaaatggggaaaaaaaaatcagtgcacaagaattgggctggttaggcccagcaccacactgaagtgggctcagtggtttttggagtgaagaagccttactccctgcacattccctcatgctcccacacaagtccagcaatggaaatgcttgggttcctcttgctttgtcaggggactcaggagtcgaccaagggaaaccatttggccccgtgaggaatgggcattgtcagtatccgtcctgaacggggcctagtcaggaagcggtctagaagtgtacggtcacggtcgcctcatgaaagtgtgtagcaggtggctctcaggaaaaataccaagtctggatcatccatgtggcagctttgcatagggagaggatagctccgaactggaactgaactgccttctctgcacgcttgaccaaagcagtgatgagggcggccagtacctgcggtgtgcgtggtaggtttaaagaaaagggaatgttttctgctgagtgtttcctttgtccttgggctgctcgagctggacagtaggtaaccactgttttcaaggaccagcccaatttctctggcttggttcggagttcgtttcatccctagctgtgagtgccttttggtctggaaagttggcttgtctcataatacccacagctaggacattctctctgtaattatgaattgtccttgttttacattaaaagagaatgtctttgatcactagagtctgtcggtgttggattatttccactgtgagattcttaaaacttttttgcttcataataataaaacaactcatgttagagaccctttcaacatgaaaggtttgtagttgagacattacatatattttattgtttataataaaaatcatctatacaaaagaagtcctgggtgttaatattttgcacaagatctgttttccatgatgtgttgacatctacaatttcactaactgttgacgttattttctattgagattctggagcctagggagctatgtgttctttttgttcatttcgttcttacttccctgaagcaagagactatatggccttcagtgcaaagacttcagaccaattctttgtattacacttggttgcctcttggctatataacttctgagtgcaaatcattgaacactttaacgaagtattgtagagaataaatcataatgg

SEQ ID NO: 106919 - DNA, 1907 bp, Homo sapiens
  Payload ID: 998
  Gene Symbol: AMN
  Gene Name: amnion associated transmembrane protein
  Uniprot ID: Q9BXJ7
  ENST ID: ENST00000299155
  CDS Start-End: 34-1395
gtctcctggtggggtgcaaggagccgaggcgagatgggcgtcctgggccgggtcctgctgtggctgcagctctgcgcactgacccaggcggtctccaaactctgggtccccaacacggacttcgacgtcgcagccaactggagccagaaccggaccccgtgcgccggcggcgccgttgagttcccggcggacaagatggtgtcagtcctggtgcaagaaggtcacgccgtctcagacatgctcctgccgctggatggggaactcgtcctggcttcaggagccggattcggcgtctcagacgtgggctcgcacctggactgtggcgcgggcgaacctgccgtcttccgcgactctgaccgcttctcctggcatgacccgcacctgtggcgctctggggacgaggcacctggcctcttcttcgtggacgccgagcgcgtgccctgccgccacgacgacgtcttctttccgcctagtgcctccttccgcgtggggctcggccctggcgctagccccgtgcgtgtccgcagcatctcggctctgggccggacgttcacgcgcgacgaggacctggctgttttcctggcgtcccgcgcgggccgcctacgcttccacgggccgggcgcgctgagcgtgggccccgaggactgcgcggacccgtcgggctgcgtctgcggcaacgcggaggcgcagccgtggatctgcgcggccctgctccagcccctgggcggccgctgcccccaggccgcctgccacagcgccctccggccccaggggcagtgctgtgacctctgtggagccgttgtgttgctgacccacggccccgcatttgacctggagcggtaccgggcgcggatactggacaccttcctgggtctgcctcagtaccacgggctgcaggtggccgtgtccaaggtgccacgctcgtcccggctccgtgaggccgatacggagatccaggtggtgctggtggagaatgggcccgagacaggcggagcggggcggctggcccgggccctcctggcggacgtcgccgagaacggcgaggccctcggcgtcctggaggcgaccatgcgggagtcgggcgcacacgtctggggcagctccgcggctgggctggcgggcggcgtggcggctgccgtgctgctggcgctgctggtcctgctggtggcgccgccgctgctgcgccgcgcggggaggctcaggtggaggaggcacgaggcggcggccccggctggagcgcccctcggcttccgcaacccggtgttcgacgtgacggcctccgaggagctgcccctgccgcggcggctcagcctggttccgaaggcggccgcagacagcaccagccacagttacttcgtcaaccctctgttcgccggggccgaggccgaggcctgagcggccgcctgaccgtcgaccttggggctctccacccgctctggccccagtcgaactgggggctagccacctcctcgtccagcccccaaacctccccttcctttccccctcctccgggggccaaggacagggtggccttactcagtaaaggtgtttcctgcacctgctgtcagcctggctatgccgccaccggccccgcccatgaggactaggagcccagccttgcgccgcattcgcactgggggacatgggaggggtctagctggccactgctggaggcagcgctggtcgtcacctgggcggccagaggctgggatctgcgaagttgaacccagaactaggagtggggcttcccccgccttccggtgaggggagggtgaggagctggagggaggggcgggagagaggcaaggggtggacggagccaaaggccgtgcctggtggggcggacggaaaaggggtgggcatccctcctggtaccaagctgctgggtgcgaaggcagatcatatgg

SEQ ID NO: 106920 - DNA, 393 bp, Homo sapiens
  Payload ID: 998
  Gene Symbol: AMN
  Gene Name: amnion associated transmembrane protein
  ENST ID: ENST00000559789
  CDS Start-End: 1-393
aggcacctggcctcttcttcgtggacgccgagcgcgtgccctgccgccacgacgacgtcttctttccgcctagtgcctccttccgcgtggggctcggccctggcgctagccccgtgcgtgtccgcagcgaggccctcggcgtcctggaggcgaccatgcgggagtcgggcgcacacgtctggggcagctccgcggctgggctggcgggcggcgtggcggctgccgtgctgctggcgctgctggtcctgctggtggcgccgccgctgctgcgccgcgcggggaggctcaggtggaggaggcacgaggcggcggccccggctggagcgcccctcggcttccgcaacccggtgttcgacgtgacggcctccgaggagctgcccctgccgcggcggc

SEQ ID NO: 106921 - DNA, 320 bp, Homo sapiens
  Payload ID: 998
  Gene Symbol: AMN
  Gene Name: amnion associated transmembrane protein
  ENST ID: ENST00000559525
  CDS Start-End: 1-320
acctgtggcgctctggggacgaggcacctggcctcttcttcgtggacgccgagcgcgtgccctgccgccacgacgacgtcttctttccgcctagtgcctccttccgcgtggggctcggccctggcgctagccccacgttcacgcgcgacgaggacctggctgttttcctggcgtcccgcgcgggccgcctacgcttccacgggccgggcgcgctgagcgtgggccccgaggactgcgcggacccgtcgggctgcgtctgcggcaacgcggaggcgcagccgtggatctgcgcggccctgctccagcccctgggcggccgc

SEQ ID NO: 106922 - DNA, 3145 bp, Homo sapiens
  Payload ID: 999
  Gene Symbol: AMPH
  Gene Name: amphiphysin
  Uniprot ID: P49418
  ENST ID: ENST00000325590
  CDS Start-End: 70-2031
cccgctcctccgcgccgccgccagccccgctgcgcgctctgctcttcgcagctccccggacccgcagccatggccgacatcaagacgggcatcttcgccaagaacgtccagaagcgactcaaccgcgcgcaggaaaaggtcctccaaaagctggggaaagctgatgagacaaaagacgaacagttcgaagaatatgtccagaacttcaaacggcaagaagcagagggtaccagacttcagcgagaactccgaggatatttagcagcaatcaaaggcatgcaggaggcctccatgaagctcacagagtcgctgcatgaagtctatgagcctgactggtatgggcgggaagatgtgaaaatggttggtgagaaatgtgatgtgctgtgggaagacttccatcaaaaactcgtggatgggtccttgctaacactggatacctacctggggcaatttcctgacataaagaatcgcatcgccaagcgcagcaggaagctagtggactatgacagtgcccgccaccatctggaagctctgcagagctccaagaggaaggatgagagtcgaatctctaaggcagaagaagaatttcagaaagcacagaaagtgtttgaagagtttaacgttgacttacaagaagagttaccatcattatggtcaagacgagttggattttatgttaatactttcaaaaacgtctccagccttgaagccaagtttcataaggaaattgcggtgctttgccacaaactgtatgaagtgatgacaaaactgggtgaccagcacgccgacaaggccttcaccatccaaggagcgcccagtgattcgggtcctctccgcattgcaaagacaccatcaccgcctgaggagccttcacccctcccgagcccgacagcaagtccaaatcatacattagcacctgcgtctcccgcaccagcacggcctcggtcaccttcacagacaaggaaagggcctcctgtcccacctctacctaaagtcaccccgacaaaggaactgcagcaggagaacatcatcagtttctttgaggacaactttgttccagaaatcagtgtgacaacaccttcccagaatgaagtccctgaggtgaagaaagaggagactttgctggatctggactttgatcctttcaagcccgaggtgacacctgcaggttctgctggagtgacccactcacccatgtctcagacattgccctgggacctatggacgacaagcactgatttggtacagccggcttctggtggttcatttaatggattcacacagccccaggatacttcattattcacaatgcagacagaccagagtatgatctgcaacttgatcatacctggagctgatgctgatgcagctgttggaaccttggtgtcagcagctgagggggccccaggagaggaagcagaggcggagaaggccactgtccctgccggggaaggagtaagtttagaggaggccaaaattggaactgaaaccactgagggtgcagagagtgcccaacctgaagcagaggagctcgaagcaacagtgcctcaggagaaggtcattccttcggtggtcatagagcctgcctccaaccatgaagaggaaggagaaaacgaaataactataggtgcagagcccaaggagaccaccgaggacgcggctcctccgggccccaccagcgagacaccggagctggctacggagcagaagcctatccaggaccctcagcccacgccttctgcaccagccatgggggctgctgaccagctagcatctgcaagggaggcctctcaggaattgcctcctggctttctctacaaggtggaaacactgcatgattttgaggcagcaaattctgatgaacttaccttacaaaggggtgatgtggtgctggtggtcccctcagattcagaagctgatcaggatgcaggctggctggtgggagtgaaggaatcagactggcttcagtacagagaccttgccacctacaaaggcctctttccagagaacttcacccgacgcttagattagggcaacaagtactgcaagaaggagctcagttacggggtttttaaaccttcatgaaaacctgaagagttcacttttgttattatgctcttaatgatttacagactgatgccagacaaaccttgggaagatgtatcaatggagcatgtgtgcaaaaaaatgtaagaggaaaaaaagtaaattaaggaaaaaatcctcactcattcccatgttgtcaataacaggtttgtttgtgctttgtccaagctgtggagactcttgtacttgatcccctcccaccaattctaaagtagctttctccagatcagactttaatttctctgcatcaggtgtatcgtattgagtggctgccctgcagaagatgtgatgaattatcctgtagtacaagattatcttattcccctgcccaggtgtgagcacgtgctctcgctccctttcaggtttactatgtttaaaactaaactgctgcaaaagttctcaatgttcttttccaacacatctatatatatatggacacacagtcacgcaagctagttcccatgactcctggatctatgtgtatgcagaaggctacatatacatagttgcttctttcctttccattgtagctctttgcctctcaattgtcattgatacatgcattgctcttattctgtctggcattacaattgcagttttgcctaatggcaaaaccagccatcccattggcaaaagagtcaacagtatctgtgtttgtactgtgcagttttcaggatgagatgacagatagcacgactacactgaggcaccctcagagaaggcagggcctgatttatctagctgtccagccgctgtggctggaggtaggctagttgggatgggcagctaagcagtcttctcttctgcctttatgagattgggtagaaagatggggcatattcatctacccccaaaagaacactataaaaacagctcctctatatttccacctctttctatttatgcaactcatcttcacagattgttctaaagtaaaatagatggtgtatgctgtatccacaaatcatctgtaacaattatgttttcagtgctgtgtcattccaaataaacctttggtaatcttcaacgattaccctaa

SEQ ID NO: 106923 - DNA, 3418 bp, Homo sapiens
  Payload ID: 999
  Gene Symbol: AMPH
  Gene Name: amphiphysin
  Uniprot ID: P49418
  ENST ID: ENST00000356264
  CDS Start-End: 217-2304
cagtcccgacgcatcccgcccccgctctgtcgctttaagctggtcccgccgccgcgccccgccctcacccctccgcgctccgcggctccccgccgcttctcccgctcctcccttgctcggccctctcctcctcctcccgctcctcctcccgctcctccgcgccgccgccagccccgctgcgcgctctgctcttcgcagctccccggacccgcagccatggccgacatcaagacgggcatcttcgccaagaacgtccagaagcgactcaaccgcgcgcaggaaaaggtcctccaaaagctggggaaagctgatgagacaaaagacgaacagttcgaagaatatgtccagaacttcaaacggcaagaagcagagggtaccagacttcagcgagaactccgaggatatttagcagcaatcaaaggcatgcaggaggcctccatgaagctcacagagtcgctgcatgaagtctatgagcctgactggtatgggcgggaagatgtgaaaatggttggtgagaaatgtgatgtgctgtgggaagacttccatcaaaaactcgtggatgggtccttgctaacactggatacctacctggggcaatttcctgacataaagaatcgcatcgccaagcgcagcaggaagctagtggactatgacagtgcccgccaccatctggaagctctgcagagctccaagaggaaggatgagagtcgaatctctaaggcagaagaagaatttcagaaagcacagaaagtgtttgaagagtttaacgttgacttacaagaagagttaccatcattatggtcaagacgagttggattttatgttaatactttcaaaaacgtctccagccttgaagccaagtttcataaggaaattgcggtgctttgccacaaactgtatgaagtgatgacaaaactgggtgaccagcacgccgacaaggccttcaccatccaaggagcgcccagtgattcgggtcctctccgcattgcaaagacaccatcaccgcctgaggagccttcacccctcccgagcccgacagcaagtccaaatcatacattagcacctgcgtctcccgcaccagcacggcctcggtcaccttcacagacaaggaaagggcctcctgtcccacctctacctaaagtcaccccgacaaaggaactgcagcaggagaacatcatcagtttctttgaggacaactttgttccagaaatcagtgtgacaacaccttcccagaatgaagtccctgaggtgaagaaagaggagactttgctggatctggactttgatcctttcaagcccgaggtgacacctgcaggttctgctggagtgacccactcacccatgtctcagacattgccctgggacctatggacgacaagcactgatttggtacagccggcttctggtggttcatttaatggattcacacagccccaggatacttcattattcacaatgcagacagaccagagtatgatctgcaacttggctgaatctgaacaggctccacccacagagccaaaagcagaggagcctctggctgctgtcacacctgccgttggtctggaccttggaatggacactcgggctgaggagccagtggaggaggcagtgatcatacctggagctgatgctgatgcagctgttggaaccttggtgtcagcagctgagggggccccaggagaggaagcagaggcggagaaggccactgtccctgccggggaaggagtaagtttagaggaggccaaaattggaactgaaaccactgagggtgcagagagtgcccaacctgaagcagaggagctcgaagcaacagtgcctcaggagaaggtcattccttcggtggtcatagagcctgcctccaaccatgaagaggaaggagaaaacgaaataactataggtgcagagcccaaggagaccaccgaggacgcggctcctccgggccccaccagcgagacaccggagctggctacggagcagaagcctatccaggaccctcagcccacgccttctgcaccagccatgggggctgctgaccagctagcatctgcaagggaggcctctcaggaattgcctcctggctttctctacaaggtggaaacactgcatgattttgaggcagcaaattctgatgaacttaccttacaaaggggtgatgtggtgctggtggtcccctcagattcagaagctgatcaggatgcaggctggctggtgggagtgaaggaatcagactggcttcagtacagagaccttgccacctacaaaggcctctttccagagaacttcacccgacgcttagattagggcaacaagtactgcaagaaggagctcagttacggggtttttaaaccttcatgaaaacctgaagagttcacttttgttattatgctcttaatgatttacagactgatgccagacaaaccttgggaagatgtatcaatggagcatgtgtgcaaaaaaatgtaagaggaaaaaaagtaaattaaggaaaaaatcctcactcattcccatgttgtcaataacaggtttgtttgtgctttgtccaagctgtggagactcttgtacttgatcccctcccaccaattctaaagtagctttctccagatcagactttaatttctctgcatcaggtgtatcgtattgagtggctgccctgcagaagatgtgatgaattatcctgtagtacaagattatcttattcccctgcccaggtgtgagcacgtgctctcgctccctttcaggtttactatgtttaaaactaaactgctgcaaaagttctcaatgttcttttccaacacatctatatatatatggacacacagtcacgcaagctagttcccatgactcctggatctatgtgtatgcagaaggctacatatacatagttgcttctttcctttccattgtagctctttgcctctcaattgtcattgatacatgcattgctcttattctgtctggcattacaattgcagttttgcctaatggcaaaaccagccatcccattggcaaaagagtcaacagtatctgtgtttgtactgtgcagttttcaggatgagatgacagatagcacgactacactgaggcaccctcagagaaggcagggcctgatttatctagctgtccagccgctgtggctggaggtaggctagttgggatgggcagctaagcagtcttctcttctgcctttatgagattgggtagaaagatggggcatattcatctacccccaaaagaacactataaaaacagctcctctatatttccacctctttctatttatgcaactcatcttcacagattgttctaaagtaaaatagatggtgtatgctgtatccacaaatcatctgtaacaattatgttttcagtgctgtgtcattccaaataaacctttggtaatcttcaacgattaccctaa

SEQ ID NO: 106924 - DNA, 665 bp, Homo sapiens
  Payload ID: 999
  Gene Symbol: AMPH
  Gene Name: amphiphysin
  ENST ID: ENST00000450124
  CDS Start-End: 1-338
caggtggaaatgaacaactgcccccaaagcctgcgccggaggctggagttgccattgctgcttgtgtggagatggagcagctgtatgacccacttgactcagacatgccagccatggacacagctggcctgttcaaagaaagtcatgaagatatgaagaagtcagatgaagaggaagagaaacagaagatggaagattctctgtgggcaggtgtggaggcgtgtcaaaaggcttctggtggttcatttaatggattcacacagccccaggatacttcattattcacaatgcagacagaccagagtatgatctgcaacttggaaatcacagtgaactgatgtctcccagtgagtcgtgattgtacacgatcttcccaggagcaagaaaacgccccagtgtttggctcattgactattctgagcgagatcatacctggagctgatgctgatgcagctgttggaaccttggtgtcagcagctgagggggccccaggagaggaagcagaggcggagaaggccactgtccctgccggggaaggagtaagtttagaggaggccaaaattggaactgaaaccactgagggtgcagagagtgcccaacctgaagcagaggagctcgaagcaacagtgcctcaggagaaggtcattccttcggtggtcatagag

SEQ ID NO: 106925 - DNA, 1735 bp, Homo sapiens
  Payload ID: 999
  Gene Symbol: AMPH
  Gene Name: amphiphysin
  ENST ID: ENST00000441628
  CDS Start-End: 1-1735
tgattcgggtcctctccgcattgcaaagacaccatcaccgcctgaggagccttcacccctcccgagcccgacagcaagtccaaatcatacattagcacctgcgtctcccgcaccagcacggcctcggtcaccttcacagacaaggaaagggcctcctgtcccacctctacctaaagtcaccccgacaaaggaactgcagcaggagaacatcatcagtttctttgaggacaactttgttccagaaatcagtgtgacaacaccttcccagaatgaagtccctgaggtgaagaaagaggagactttgctggatctggactttgatcctttcaagcccgaggtgacacctgcaggttctgctggagtgacccactcacccatgtctcagacattgccctgggacctatggacgacaagcactgatttggtacagccgactgactcttcagaaagtctttccttgtgtaacctgatcatggaggaaactccagacagtgggttggccgaagaaattcaaagatctcaaaatgatataggtgcatttacttggggccctgacgctagtacagacagggtcagccaagaagttacctcaggtgggtttggagaagactctgcatgtccctccgaaacagagcaagacataagattatccaccagcctgctttcgtctgctgactggcccactgtagctgaagagagtgagcatgccccggggccagcctttccaggtggaaatgaacaactgcccccaaagcctgcgccggaggctggagttgccattgctgcttgtgtggagatggagcagctgtatgacccacttgactcagacatgccagccatggacacagctggcctgttcaaagaaagtcatgaagatatgaagaagtcagatgaagaggaagagaaacagaagatggaagattctctgtgggcaggtgtggaggcgtgtcaaaaggcttctggtggttcatttaatggattcacacagccccaggatacttcattattcacaatgcagacagaccagagtatgatctgcaacttgatcatacctggagctgatgctgatgcagctgttggaaccttggtgtcagcagctgagggggccccaggagaggaagcagaggcggagaaggccactgtccctgccggggaaggagtaagtttagaggaggccaaaattggaactgaaaccactgagggtgcagagagtgcccaacctgaagcagaggagctcgaagcaacagtgcctcaggagaaggtcattccttcggtggtcatagagcctgcctccaaccatgaagaggaaggagaaaacgaaataactataggtgcagagcccaaggagaccaccgaggacgcggctcctccgggccccaccagcgagacaccggagctggctacggagcagaagcctatccaggaccctcagcccacgccttctgcaccagccatgggggctgctgaccagctagcatctgcaagggaggcctctcaggaattgcctcctggctttctctacaaggtggaaacactgcatgattttgaggcagcaaattctgatgaacttaccttacaaaggggtgatgtggtgctggtggtcccctcagattcagaagctgatcaggatgcaggctggctggtgggagtgaaggaatcagactggcttcagtacagagaccttgccacctacaaaggcctctttccagagaacttcacccgacgcttagattag

SEQ ID NO: 106926 - DNA, 1240 bp, Homo sapiens
  Payload ID: 1000
  Gene Symbol: AREG
  Gene Name: amphiregulin
  Uniprot ID: P15514
  ENST ID: ENST00000395748
  CDS Start-End: 213-971
acagacgttcgcacacctgggtgccagcgccccagaggtcccgggacagcccgaggcgccgcgcccgccgccccgagctccccaagccttcgagagcggcgcacactcccggtctccactcgctcttccaacacccgctcgttttggcggcagctcgtgtcccagagaccgagttgccccagagaccgagacgccgccgctgcgaaggaccaatgagagccccgctgctaccgccggcgccggtggtgctgtcgctcttgatactcggctcaggccattatgctgctggattggacctcaatgacacctactctgggaagcgtgaaccattttctggggaccacagtgctgatggatttgaggttacctcaagaagtgagatgtcttcagggagtgagatttcccctgtgagtgaaatgccttctagtagtgaaccgtcctcgggagccgactatgactactcagaagagtatgataacgaaccacaaatacctggctatattgtcgatgattcagtcagagttgaacaggtagttaagcccccccaaaacaagacggaaagtgaaaatacttcagataaacccaaaagaaagaaaaagggaggcaaaaatggaaaaaatagaagaaacagaaagaagaaaaatccatgtaatgcagaatttcaaaatttctgcattcacggagaatgcaaatatatagagcacctggaagcagtaacatgcaaatgtcagcaagaatatttcggtgaacggtgtggggaaaagtccatgaaaactcacagcatgattgacagtagtttatcaaaaattgcattagcagccatagctgcctttatgtctgctgtgatcctcacagctgttgctgttattacagtccagcttagaagacaatacgtcaggaaatatgaaggagaagctgaggaacgaaagaaacttcgacaagagaatggaaatgtacatgctatagcataactgaagataaaattacaggatatcacattggagtcactgccaagtcatagccataaatgatgagtcggtcctctttccagtggatcataagacaatggaccctttttgttatgatggttttaaactttcaattgtcactttttatgctatttctgtatataaaggtgcacgaaggtaaaaagtattttttcaagttgtaaataatttatttaatatttaatggaagtgtatttattttacagctcattaaacttttttaaccaaacaga

SEQ ID NO: 106927 - DNA, 956 bp, Homo sapiens
  Payload ID: 1000
  Gene Symbol: AREG
  Gene Name: amphiregulin
  ENST ID: ENST00000502307
  CDS Start-End: 45-869
ccgagttgccccagagaccgagacgccgccgctgcgaaggaccaatgagagccccgctgctaccgccggcgccggtggtgctgtcgctcttgatactcggctcaggccattatgctgctggattggacctcaatgacacctactctgggaagcgtgaaccattttctggggaccacagtgctgatggatttgaggttacctcaagaagtgagatgtcttcagggagtgagatttcccctgtgagtgaaatgccttctagtagtgaaccgtcctcgggagccgactatgactactcagaagagtatgataacgaaccacaaatacctggctatattgtcgatgattcagtcagagttgaacaggtagttaagcccccccaaaacaagacggaaagtgaaaatacttcagataaacccaaaagaaagaaaaagggaggcaaaaatggaaaaaatagaagaaacagaaagaagaaaaatccatgtaatgcagaatttcaaaatttctgcattcacggagaatgcaaatatatagagcacctggaagcagtaacatgcaaatgtcagcaagaatatttcggtgaacggtgtggggaaaagtccatgaaaactcacagcatgattgacagtagtttatcaaaaattgcattagcagccatagctgcctttatgtctgctgtgatcctcacagctgttgctgttattacagtccagatatcacattggagtcactgccaagtcatagccataaatgatgagtcggtcctctttccagtggatcataagacaatggaccctttttgttatgatggttttaaactttcaattgtcactttttatgctatttctgtatataaaggtgcacgaaggtaaaaagtattttttcaagttgtaaataatttatttaatatttaatggaagtgtatttattttacagctcattaaacttttttaaccaaa

SEQ ID NO: 106928 - DNA, 1790 bp, Homo sapiens
  Payload ID: 1001
  Gene Symbol: AMY1A
  Gene Name: amylase, alpha 1A (salivary)
  Uniprot ID: P04745
  ENST ID: ENST00000370083
  CDS Start-End: 221-1756
gatttatctagaggctgggaagggctcctgaaccagttgtttccgtcttgtcggtctgtcagggttggaaagtccaagccataggacccagtttcctttcttagcttacgttatctaccagagcaccgtgggctgttacttgccttgagttggaagcggttcgcatttataccggaatataaatagtttctggaaaggacactgacaacttcaaagcaaaatgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttggacaaactgcataatctaaacagtaactggttcccggaaggtagtaaacctttcatttaccaggaggtaattgatctgggtggtgagccaattaaaagcagtgactactttggtaatggccgggtgacagaattcaagtatggtgcaaaactcggcacagttattcgcaagtggaatggagagaagatgtcttacttaaagaactggggagaaggttggggtttcatgccttctgacagagcgcttgtctttgtggataaccatgacaatcaacgaggacatggcgctggaggagcctctatacttaccttctgggatgctaggctgtacaaaatggcagttggatttatgcttgctcatccttatggatttacacgagtaatgtcaagctaccgttggccaagatattttgaaaatggaaaagatgttaatgattgggttgggccaccaaatgataatggagtaactaaagaagttactattaatccagacactacttgtggcaatgactgggtctgtgaacatcgatggcgccaaataaggaacatggttaatttccgcaatgtagtggatggccagccttttacaaactggtatgataatgggagcaaccaagtggcttttgggagaggaaacagaggattcattgttttcaacaatgatgactggacattttctttaactttgcaaactggtcttcctgctggcacatactgtgatgtcatttctggagataaaattaatggcaactgcacaggcattaaaatctacgtttctgatgatggcaaagctcatttttctattagtaactctgctgaagatccatttattgcaattcatgctgaatctaaattgtaaaatttaaaattaaatgcaaatccgcaaagcaata

SEQ ID NO: 106929 - DNA, 1363 bp, Homo sapiens
  Payload ID: 1001
  Gene Symbol: AMY1A
  Gene Name: amylase, alpha 1A (salivary)
  ENST ID: ENST00000430659
  CDS Start-End: 686-1363
atgcacccgtggtcagggagaaacagaatatggaagggagtttcacaatgttcttctatacaatgtctggaatctatgaataacatcggcttctaaatcataagttgatttgtaactactgggtttaggccaaccaggcccaggcctggttttgtgcctttgattttgcttccttgttgtttttactgaatagaaaacaatataaaacaagaggacagggtctttctctcttctcaatatcagcactggattgtagaacttgttgctgattttggcctggcattcaagttaactcttccccttggtatctgtacatacctttgatgtcagtgtttagtacacgtggcttggtcacttcatggctaaaaacgtgcttgtggaagacaagtctggcttggtgagtctgtgtggtcagcagtctctgatccgtgcagggtattaatgtgtcagggctgagtgttctgagatttatctagaggctgggaagggctcctgaaccagttgtttccgtcttgtcggtctgtcagggttggaaagtccaagccataggacccagtttcctttcttagcttacgttatctaccagagcaccgtgggctgttacttgccttgagttggaagcggttcgcatttataccggaatataaatagtttctggaaaggacactgacaacttcaaagcaaaatgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttg

SEQ ID NO: 106930 - DNA, 403 bp, Homo sapiens
  Payload ID: 1001
  Gene Symbol: AMY1A
  Gene Name: amylase, alpha 1A (salivary)
  ENST ID: ENST00000422549
  CDS Start-End: 89-403
gctgttatgtgagaacattaggccacagcaacatgtcattgtgaatataaatagtttctggaaaggacactgacaacttcaaagcaaaatgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggg

SEQ ID NO: 106931 - DNA, 1862 bp, Homo sapiens
  Payload ID: 1002
  Gene Symbol: AMY1B
  Gene Name: amylase, alpha 1B (salivary)
  Uniprot ID: P04745
  ENST ID: ENST00000330330
  CDS Start-End: 296-1831
tggcttggtgagtctgtgtggtcagcagtctctgatccgtgcagggtattaatgtgtcagggctgagtgttctgagatttatctagaggctgggaagggctcctgaaccagttgtttccgtcttgtcggtctgtcagggttggaaagtccaagccataggacccagtttcctttcttagcttacgttatctaccagagcaccgtgggctgttacttgccttgagttggaagcggttcgcatttataccggaatataaatagtttctggaaaggacactgacaacttcaaagcaaaatgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttggacaaactgcataatctaaacagtaactggttcccggaaggtagtaaacctttcatttaccaggaggtaattgatctgggtggtgagccaattaaaagcagtgactactttggtaatggccgggtgacagaattcaagtatggtgcaaaactcggcacagttattcgcaagtggaatggagagaagatgtcttacttaaagaactggggagaaggttggggtttcatgccttctgacagagcgcttgtctttgtggataaccatgacaatcaacgaggacatggcgctggaggagcctctatacttaccttctgggatgctaggctgtacaaaatggcagttggatttatgcttgctcatccttatggatttacacgagtaatgtcaagctaccgttggccaagatattttgaaaatggaaaagatgttaatgattgggttgggccaccaaatgataatggagtaactaaagaagttactattaatccagacactacttgtggcaatgactgggtctgtgaacatcgatggcgccaaataaggaacatggttaatttccgcaatgtagtggatggccagccttttacaaactggtatgataatgggagcaaccaagtggcttttgggagaggaaacagaggattcattgttttcaacaatgatgactggacattttctttaactttgcaaactggtcttcctgctggcacatactgtgatgtcatttctggagataaaattaatggcaactgcacaggcattaaaatctacgtttctgatgatggcaaagctcatttttctattagtaactctgctgaagatccatttattgcaattcatgctgaatctaaattgtaaaatttaaaattaaatgcaaatccgcaaagca

SEQ ID NO: 106932 - DNA, 1787 bp, Homo sapiens
  Payload ID: 1002
  Gene Symbol: AMY1B
  Gene Name: amylase, alpha 1B (salivary)
  Uniprot ID: P04745
  ENST ID: ENST00000370080
  CDS Start-End: 218-1753
tctcttctcaatatcagcactggattgtagaacttgttgctgattttggcctggcattcaagttaactcttccccttggtatctgtacatacctttgatgtcagtgtttagtacacgtggcttggtcacttcatggctaaaaacgtgcttgtggaagacaagtctggcttggaatataaatagtttctggaaaggacactgacaacttcaaagcaaaatgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttggacaaactgcataatctaaacagtaactggttcccggaaggtagtaaacctttcatttaccaggaggtaattgatctgggtggtgagccaattaaaagcagtgactactttggtaatggccgggtgacagaattcaagtatggtgcaaaactcggcacagttattcgcaagtggaatggagagaagatgtcttacttaaagaactggggagaaggttggggtttcatgccttctgacagagcgcttgtctttgtggataaccatgacaatcaacgaggacatggcgctggaggagcctctatacttaccttctgggatgctaggctgtacaaaatggcagttggatttatgcttgctcatccttatggatttacacgagtaatgtcaagctaccgttggccaagatattttgaaaatggaaaagatgttaatgattgggttgggccaccaaatgataatggagtaactaaagaagttactattaatccagacactacttgtggcaatgactgggtctgtgaacatcgatggcgccaaataaggaacatggttaatttccgcaatgtagtggatggccagccttttacaaactggtatgataatgggagcaaccaagtggcttttgggagaggaaacagaggattcattgttttcaacaatgatgactggacattttctttaactttgcaaactggtcttcctgctggcacatactgtgatgtcatttctggagataaaattaatggcaactgcacaggcattaaaatctacgtttctgatgatggcaaagctcatttttctattagtaactctgctgaagatccatttattgcaattcatgctgaatctaaattgtaaaatttaaaattaaatgcaaatccgcaaagcaata

SEQ ID NO: 106933 - DNA, 1363 bp, Homo sapiens
  Payload ID: 1002
  Gene Symbol: AMY1B
  Gene Name: amylase, alpha 1B (salivary)
  ENST ID: ENST00000446703
  CDS Start-End: 686-1363
atgcacccgtggtcagggagaaacagaatacggaagggagtttcacaatgttcttctatacaatgtctggaatctatgaataacatcggcttctaaatcataagttgatttgtaactactgggtttaggccaaccaggcccaggcctggttttgtgcctttgattttgcttccttgttgtttttactgaatagaaaacaatataaaacaagaggacagggtctttctctcttctcaatatcagcactggattgtagaacttgttgctgattttggcctggcattcaagttaactcttccccttggtatctgtacatacctttgatgtcagtgtttagtacacgtggcttggtcacttcatggctaaaaacgtgcttgtggaagacaagtctggcttggtgagtctgtgtggtcagcagtctctgatccgtgcagggtattaatgtgtcagggctgagtgttctgagatttatctagaggctgggaagggctcctgaaccagttgtttccgtcttgtcggtctgtcagggttggaaagtccaagccataggacccagtttcctttcttagcttacgttatctaccagagcaccgtgggctgttacttgccttgagttggaagcggttcgcatttataccggaatataaatagtttctggaaaggacactgacaacttcaaagcaaaatgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttg

SEQ ID NO: 106934 - DNA, 403 bp, Homo sapiens; identical to SEQ ID NO: 106930
  Payload ID: 1002
  Gene Symbol: AMY1B
  Gene Name: amylase, alpha 1B (salivary)
  ENST ID: ENST00000425410
  CDS Start-End: 89-403

SEQ ID NO: 106935 - DNA, 1632 bp, Homo sapiens
  Payload ID: 1003
  Gene Symbol: AMY1C
  Gene Name: amylase, alpha 1C (salivary)
  Uniprot ID: P04745
  ENST ID: ENST00000370079
  CDS Start-End: 65-1600
aaaatgtgcttcttacaggaatataaatagtttctggaaaggacactgacaacttcaaagcaaaatgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttggacaaactgcataatctaaacagtaactggttcccggaaggtagtaaacctttcatttaccaggaggtaattgatctgggtggtgagccaattaaaagcagtgactactttggtaatggccgggtgacagaattcaagtatggtgcaaaactcggcacagttattcgcaagtggaatggagagaagatgtcttacttaaagaactggggagaaggttggggtttcatgccttctgacagagcgcttgtctttgtggataaccatgacaatcaacgaggacatggcgctggaggagcctctatacttaccttctgggatgctaggctgtacaaaatggcagttggatttatgcttgctcatccttatggatttacacgagtaatgtcaagctaccgttggccaagatattttgaaaatggaaaagatgttaatgattgggttgggccaccaaatgataatggagtaactaaagaagttactattaatccagacactacttgtggcaatgactgggtctgtgaacatcgatggcgccaaataaggaacatggttaatttccgcaatgtagtggatggccagccttttacaaactggtatgataatgggagcaaccaagtggcttttgggagaggaaacagaggattcattgttttcaacaatgatgactggacattttctttaactttgcaaactggtcttcctgctggcacatactgtgatgtcatttctggagataaaattaatggcaactgcacaggcattaaaatctacgtttctgatgatggcaaagctcatttttctattagtaactctgctgaagatccatttattgcaattcatgctgaatctaaattgtaaaatttaaaattaaatgcaaatccgcaaagcaa

SEQ ID NO: 106936 - DNA, 626 bp, Homo sapiens
  Payload ID: 1004
  Gene Symbol: AMY2A
  Gene Name: amylase, alpha 2A (pancreatic)
  ENST ID: ENST00000423678
  CDS Start-End: 1-626
gttctttctgttgcttttcaccattgggttctgctgggctcagtattccccaaatacacaacaaggacggacatctattgttcatctgtttgaatggcgatgggttgatattgctcttgaatgtgagcgatatttagctccgaagggatttggaggggttcaggtctctccaccaaatgaaaatgttgcaatttacaaccctttcagaccttggtgggaaagataccaaccagttagctataaattatgcacaagatctggaaatgaagatgaatttagaaacatggtgactagatgtaacaatgttggggttcgtatttatgtggatgctgtaattaatcatatgtgtggtaacgctgtgagtgcaggaacaagcagtacctgtggaagttacttcaaccctggaagtagggactttccagcagtcccatattctggatgggatttcaatgatggtaaatgtaaaactggaagtggagatatcgagaactacaatgatgctactcaggtaattgatctgggtggtgagccaattaaaagcagtgactactttggtaatggccgggtgacagaattcaagtatggtgcaaaactcggcacagttattcgcaagtggaatggagaga

SEQ ID NO: 106937 - DNA, 1634 bp, Homo sapiens
  Payload ID: 1004
  Gene Symbol: AMY2A
  Gene Name: amylase, alpha 2A (pancreatic)
  Uniprot ID: P04746
  ENST ID: ENST00000414303
  CDS Start-End: 65-1600
aaaatgtgcttcttacaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctccgaagggatttggaggggttcaggtctctccaccaaatgaaaatgttgcaatttacaaccctttcagaccttggtgggaaagataccaaccagttagctataaattatgcacaagatctggaaatgaagatgaatttagaaacatggtgactagatgtaacaatgttggggttcgtatttatgtggatgctgtaattaatcatatgtgtggtaacgctgtgagtgcaggaacaagcagtacctgtggaagttacttcaaccctggaagtagggactttccagcagtcccatattctggatgggatttcaatgatggtaaatgtaaaactggaagtggagatatcgagaactacaatgatgctactcaggtcagagattgtcgtctgactggtcttcttgatcttgcactggagaaggattacgtgcgttctaagattgccgaatatatgaaccatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtaattgatctgggtggtgagccaattaaaagcagtgactactttggtaatggccgggtgacagaattcaagtatggtgcaaaactcggcacagttattcgcaagtggaatggagagaagatgtcttacttaaagaactggggagaaggttggggtttcgtaccttctgacagagcgcttgtctttgtggataaccatgacaatcaacgaggacatggggctggaggagcctctattcttaccttctgggatgctaggctgtacaaaatggcagttggatttatgcttgctcatccttacggatttacacgagtaatgtcaagctaccgttggccaagacagtttcaaaatggaaacgatgttaatgattgggttgggccaccaaataataatggagtaattaaagaagttactattaatccagacactacttgtggcaatgactgggtctgtgaacatcgatggcgccaaataaggaacatggttattttccgcaatgtagtggatggccagccttttacaaattggtatgataatgggagcaaccaagtggcttttgggagaggaaacagaggattcattgttttcaacaatgatgactggtcattttctttaactttgcaaactggtcttcctgctggcacatactgtgatgtcatttctggagataaaattaatggcaattgcacaggcattaaaatttacgtttctgatgatggcaaagctcatttttctattagtaactctgctgaagatccatttattgcaattcatgctgaatctaaattgtaaaatttaaaattaaatgcatgtcctcaaaacaata

SEQ ID NO: 106938 - DNA, 1862 bp, Homo sapiens
  Payload ID: 1004
  Gene Symbol: AMY2A
  Gene Name: amylase, alpha 2A (pancreatic)
  Uniprot ID: P04746
  ENST ID: ENST00000622339
  CDS Start-End: 296-1831
tggctcggtgagtctgtgcggccagcagtctctgatctgtacagggtattaatgtgtcagggctgagtgttctgggatttgtctagaggctggtaagggcttctggaccacttgtttctgtcctgtcagtctgtcagggttggaaagtccaagccataggacccagtttcctttcttagcttacgttatctaccagagcaccgtgggctgttacttaccttgagttggaaggggttcgcatttatacctgaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctccgaagggatttggaggggttcaggtctctccaccaaatgaaaatgttgcaatttacaaccctttcagaccttggtgggaaagataccaaccagttagctataaattatgcacaagatctggaaatgaagatgaatttagaaacatggtgactagatgtaacaatgttggggttcgtatttatgtggatgctgtaattaatcatatgtgtggtaacgctgtgagtgcaggaacaagcagtacctgtggaagttacttcaaccctggaagtagggactttccagcagtcccatattctggatgggatttcaatgatggtaaatgtaaaactggaagtggagatatcgagaactacaatgatgctactcaggtcagagattgtcgtctgactggtcttcttgatcttgcactggagaaggattacgtgcgttctaagattgccgaatatatgaaccatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtaattgatctgggtggtgagccaattaaaagcagtgactactttggtaatggccgggtgacagaattcaagtatggtgcaaaactcggcacagttattcgcaagtggaatggagagaagatgtcttacttaaagaactggggagaaggttggggtttcgtaccttctgacagagcgcttgtctttgtggataaccatgacaatcaacgaggacatggggctggaggagcctctattcttaccttctgggatgctaggctgtacaaaatggcagttggatttatgcttgctcatccttacggatttacacgagtaatgtcaagctaccgttggccaagacagtttcaaaatggaaacgatgttaatgattgggttgggccaccaaataataatggagtaattaaagaagttactattaatccagacactacttgtggcaatgactgggtctgtgaacatcgatggcgccaaataaggaacatggttattttccgcaatgtagtggatggccagccttttacaaattggtatgataatgggagcaaccaagtggcttttgggagaggaaacagaggattcattgttttcaacaatgatgactggtcattttctttaactttgcaaactggtcttcctgctggcacatactgtgatgtcatttctggagataaaattaatggcaattgcacaggcattaaaatttacgtttctgatgatggcaaagctcatttttctattagtaactctgctgaagatccatttattgcaattcatgctgaatctaaattgtaaaatttaaaattaaatgcatgtcctcaaaaca

SEQ ID NO: 106939 - DNA, 2181 bp, Homo sapiens
  Payload ID: 1005
  Gene Symbol: AMY2B
  Gene Name: amylase, alpha 2B (pancreatic)
  Uniprot ID: P19961
  ENST ID: ENST00000361355
  CDS Start-End: 617-2152
ggaaaataaagggttggagcctctgtgtttctttgttgaaaaatctgctactattattagatctgtgaaaacaattgaaaattcggttattatcaccttaaaagtacaaaacctatagattttgaaaatgtaattatttttctgtaggcatagttaaaaagattttgtaaatgttataaatcagtttctttataagcggtttatttagataaattttgttatactgacatgattcactaattttctaaatataaatggttcagctcttagttatttttaaactaatgacctgtgttatacttcctatttttaatgggcttttatgatgttttaggtttttttgaatcccgtgtccttcaagtgctttctaactttgagaggaagaaattgaccacctggactatggaactttggttgaatctggcgatgtggaacccatggatatggagggctgactatatacaccatgttttttcctggcacatcactcaactactattagctggcgagtcaactcacgttgttggaatgactagggacaactagacttcaagtgatctttcatcccaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctcccaagggatttggaggggttcaggtctctccaccaaatgaaaatgttgcaattcacaaccctttcagaccttggtgggaaagataccaaccagttagctataaattatgcacaagatctggaaatgaagatgaatttagaaacatggtgactagatgtaacaatgttggggttcgtatttatgtggatgctgtaattaatcatatgtctggtaatgctgtgagtgcaggaacaagcagtacctgtggaagttacttcaaccctggaagtagggactttccagcagtcccatattctggatgggattttaatgatggtaaatgtaaaactggaagtggagatatcgagaactacaatgatgctactcaggtcagagattgtcgtctggttggtcttcttgatcttgcactggagaaagattatgtgcgttccaagattgccgaatatatgaatcatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtaattgatctgggtggtgagccaattaaaagcagtgactactttggaaatggccgggtgacagaattcaagtatggtgcaaaactcggcacagttattcgcaagtggaatggagagaagatgtcttacctaaagaactggggagaaggttggggtttcatgccttctgacagagcacttgtctttgtggataaccatgacaatcaacgaggacatggggctggaggagcctctattcttaccttctgggatgctaggctgtataaaatggcagttggatttatgcttgctcatccttatggttttacacgagtaatgtcaagctaccgttggccaagacagtttcaaaatggaaacgatgttaatgattgggttgggccaccaaataataatggagtaattaaagaagttactattaatccagacactacttgtggcaatgactgggtctgtgaacatcgatggcgccaaataaggaacatggttaatttccgcaatgtagtggatggccagccttttacaaactggtatgataatgggagcaaccaagtggcttttgggagaggaaacagaggattcattgttttcaacaatgatgactggacattttctttaactttgcaaactggtcttcctgctggcacatactgtgatgtcatttctggagataaaattaatggcaattgcacaggcattaaaatctacgtttctgacgatggcaaagctcatttttctattagtaactctgctgaggatccatttattgcaattcatgctgaatctaaattataaaatttaaaattaaatgcatatcctcaaaa

SEQ ID NO: 106940 - DNA, 832 bp, Homo sapiens
  Payload ID: 1005
  Gene Symbol: AMY2B
  Gene Name: amylase, alpha 2B (pancreatic)
  ENST ID: ENST00000435302
  CDS Start-End: 545-832
gagatatagtgtagtaagaagaggtggcagggcagcaaactgagcagaggagagaagacagtggtttgcttaggaaacaggagtgtggtgatcaacctgttgtaatactggagttcagagaagattccttgtacaaatctgatttggagaattggagtaggactctagggccacatattgaaagtaagaggttatagaaaatctataagattctaaattcagcaattttttttccaactgaagaaaaagcaaaaccagaactgtgagatttttattttatgattgtaaaacactcaactgtgggtttgggagattgctgattgagagaagttaatgtgttggttgaatctggcgatgtggaacccatggatatggagggctgactatatacaccatgttttttcctggcacatcactcaactactattagctggcgagtcaactcacgttgttggaatgactagggacaactagacttcaagtgatctttcatcccaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctcccaagggatttggaggggttcaggtctctccaccaaatgaaaatgttgcaattcacaaccctttcagaccttggtgggaaagataccaaccagttagctataaattatgcacaagatctggaaatgaagatgaatttagaaac

SEQ ID NO: 106941 - DNA, 869 bp, Homo sapiens
  Payload ID: 1005
  Gene Symbol: AMY2B
  Gene Name: amylase, alpha 2B (pancreatic)
  ENST ID: ENST00000453959
  CDS Start-End: 611-869
caccaagtctgttatatctcccctctctgttttacataaacatttcccctctattccaggggtatatgttccaagacccccagcaggtgcctgaaaccacagatagtaccaagccttttgcagtcatctctccagtatctgtgggggattggttccaggacctcccatggataccaaaatctacagatgctcaagtgccttatataaaatagcatagtatttgcatataaccaatgcacatcctcctgtatactttaaatcatctctatattgctagagatgtaatatctactgtaatataaatgctatgcagatagttacattgtttagggaataatgacagaaaagtctatatgttcagtacagatgcaactatccttctttaaaaatatgttcttccacagttggttgaatctggcgatgtggaacccatggatatggagggctgactatatacaccatgttttttcctggcacatcactcaactactattagctggcgagtcaactcacgttgttggaatgactagggacaactagacttcaagtgatctttcatcccaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctcccaagggatttggaggggttcaggtctctccaccaaatgaaaatgttgcaattcacaaccctttcagaccttggtgggaaagataccaaccagttagctataaattatgcacaa

SEQ ID NO: 106942 - DNA, 2788 bp, Homo sapiens
  Payload ID: 1005
  Gene Symbol: AMY2B
  Gene Name: amylase, alpha 2B (pancreatic)
  Uniprot ID: P19961
  ENST ID: ENST00000477657
  CDS Start-End: 1342-2454
agtgaatctcttttgacatagatagcaatagaagtatctttcttctttcccctttctttttctaaacaagagaagaaaagcgtaatagaggggagaacacataatgcccactaagggtagtgcattaaggaaaaacagtcttggcaggtatataggaatagtggtttccagactggttgatgaccgtaatcaccaagaacagtggttctcagtcttggctgcacattgcagtgatctggaacttaaatactaattttaaaagggtgcagtggctcatacctgtaatcccagcactttgcaagtccgagatgggagaatcacttgagcccaggagtttgagaccagcctgggcaatgtagggagaccctgtccctacaaaaaatacaaaaattagccaagtgtggtggcttgcacctctggtctcagctacttgggatgctaaggcaggaggattacttgagccccagaggttgaggttgcagtgaaccatgatcacaccactgcattctagcctgggtgacagagtgagaccctctccctcctaaaaaaatccttaagaaatatattgatgcttggttcctttggtcagaattttgatttaaggtgttgggagtgtagcacagatgttggaataaacctctcaaactgattttaatatacaaacaaggtcgagaaccaccaaggaagagtttttatgcataaagattcctgtactctaccctagaactaatacatctgaatctctgggaatggagtataacaatcagatttgaaaaggtttctttagtaattttaaggactgaccagtttagacactgctttgttagagtaaaatgattaggtacctagtatcaacctagccatccaaccttatattaataactaggaaaataaagggttggagcctctgtgtttctttgttgaaaaatctgctactattattagatctgtgaaaacaattgaaaattcggttattatcaccttaaaagtacaaaacctatagattttgaaaatgtaattatttttctgtaggcatagttaaaaagattttgtaaatgttataaatcagtttctttataagcggtttatttagataaattttgttatactgacatgattcactaattttctaaatataaatggttcagctcttagttatttttaaactaatgacctgtgttatacttcctatttttaatgggcttttatgatgttttaggtttttttgaatcccgtgtccttcaagtgctttctaactttgagaggaagaaattgaccacctggactatggaactgaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctcccaagggatttggaggggttcaggtctctccaccaaatgaaaatgttgcaattcacaaccctttcagaccttggtgggaaagataccaaccagttagctataaattatgcacaagatctggaaatgaagatgaatttagaaacatggtgactagatgtaacaatgttggggttcgtatttatgtggatgctgtaattaatcatatgtctggtaatgctgtgagtgcaggaacaagcagtacctgtggaagttacttcaaccctggaagtagggactttccagcagtcccatattctggatgggattttaatgatggtaaatgtaaaactggaagtggagatatcgagaactacaatgatgctactcaggtcagagattgtcgtctggttggtcttcttgatcttgcactggagaaagattatgtgcgttccaagattgccgaatatatgaatcatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtaattgatctgggtggtgagccaattaaaagcagtgactactttggaaatggccgggtgacagaattcaagtatggtgcaaaactcggcacagttattcgcaagtggaatggagagaagatgtcttacctaaagaactggggagaaggttggggtttcatgccttctgacagagcacttgtctttgtggataaccatgacaatcaacgaggacatggggctggaggagcctctattcttaccttctgggatgctaggctgtataaaatggcagttggatttatgcttgctcatccttatggttttacacgagtaatgtcaagctaccgttggccaagacagtttcaaaatggaaacgaacatggttaatttccgcaatgtagtggatggccagccttttacaaactggtatgataatgggagcaaccaagtggcttttgggagaggaaacagaggattcattgttttcaacaatgatgactggacattttctttaactttgcaaactggtcttcctgctggcacatactgtgatgtcatttctggagataaaattaatggcaattgcacaggcattaaaatctacgtttctgacgatggcaaagctcatttttctattagtaactctgctgaggatccatttattgcaattcatgctgaatctaaattataaaatttaaaattaaatgcatatcctcaaaac

SEQ ID NO: 106943 - DNA, 1736 bp, Homo sapiens
  Payload ID: 1005
  Gene Symbol: AMY2B
  Gene Name: amylase, alpha 2B (pancreatic)
  Uniprot ID: P19961
  ENST ID: ENST00000610648
  CDS Start-End: 171-1706
tcggtctgtcagggttggaaagtccaagccataggacccagtttcctttcttagcttctgttgtctgccagaacaccatgggctgttactcgccttgagttggaagcggtttgcatttatacctgaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctcccaagggatttggaggggttcaggtctctccaccaaatgaaaatgttgcaattcacaaccctttcagaccttggtgggaaagataccaaccagttagctataaattatgcacaagatctggaaatgaagatgaatttagaaacatggtgactagatgtaacaatgttggggttcgtatttatgtggatgctgtaattaatcatatgtctggtaatgctgtgagtgcaggaacaagcagtacctgtggaagttacttcaaccctggaagtagggactttccagcagtcccatattctggatgggattttaatgatggtaaatgtaaaactggaagtggagatatcgagaactacaatgatgctactcaggtcagagattgtcgtctggttggtcttcttgatcttgcactggagaaagattatgtgcgttccaagattgccgaatatatgaatcatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtaattgatctgggtggtgagccaattaaaagcagtgactactttggaaatggccgggtgacagaattcaagtatggtgcaaaactcggcacagttattcgcaagtggaatggagagaagatgtcttacctaaagaactggggagaaggttggggtttcatgccttctgacagagcacttgtctttgtggataaccatgacaatcaacgaggacatggggctggaggagcctctattcttaccttctgggatgctaggctgtataaaatggcagttggatttatgcttgctcatccttatggttttacacgagtaatgtcaagctaccgttggccaagacagtttcaaaatggaaacgatgttaatgattgggttgggccaccaaataataatggagtaattaaagaagttactattaatccagacactacttgtggcaatgactgggtctgtgaacatcgatggcgccaaataaggaacatggttaatttccgcaatgtagtggatggccagccttttacaaactggtatgataatgggagcaaccaagtggcttttgggagaggaaacagaggattcattgttttcaacaatgatgactggacattttctttaactttgcaaactggtcttcctgctggcacatactgtgatgtcatttctggagataaaattaatggcaattgcacaggcattaaaatctacgtttctgacgatggcaaagctcatttttctattagtaactctgctgaggatccatttattgcaattcatgctgaatctaaattataaaatttaaaattaaatgcatatcctcaaaac

SEQ ID NO: 106944 - DNA, 7446 bp, Homo sapiens
  Payload ID: 1006
  Gene Symbol: AGL
  Gene Name: amylo-alpha-1, 6-glucosidase, 4-alpha-glucanotransferase
  Uniprot ID: P35573
  ENST ID: ENST00000294724
  CDS Start-End: 479-5077
ctgtctacggcagctattccagaggcaacaactgcttccctctgttctcatctccccattggtggctggcgacccgaatttgggaatggggagattgcccacctgttatctttgagcagactaatctcttgtaagcagaagtgccattcggagtctccagagccctgtggcttggggctgggaatgtccccctgacttcaggctttcctaagtgtattgcttttctctgagaatggtctaggtttttaattttttaattgtaagaatctgtaatacagcatttttatttcggtcttattcgttgtgctcaaaggcaggaaacaactattaatttgccttctcgaatcttaatagttataagattcattctctttcattgctctgctaggcataaaacacacttcgaacatgggtaactcattcgactgtggagttcttttaattcttatgaaagatttcaaatcctctagaagccaaaatgggacacagtaaacagattcgaattttacttctgaacgaaatggagaaactggaaaagaccctcttcagacttgaacaagggtatgagctacagttccgattaggcccaactttacagggaaaagcagttaccgtgtatacaaattacccatttcctggagaaacatttaatagagaaaaattccgttctctggattgggaaaatccaacagaaagagaagatgattctgataaatactgtaaacttaatctgcaacaatctggttcatttcagtattatttccttcaaggaaatgagaaaagtggtggaggttacatagttgtggaccccattttacgtgttggtgctgataatcatgtgctacccttggactgtgttactcttcagacatttttagctaagtgtttgggaccttttgatgaatgggaaagcagacttagggttgcaaaagaatcaggctacaacatgattcattttaccccattgcagactcttggactatctaggtcatgctactcccttgccaatcagttagaattaaatcctgacttttcaagacctaatagaaagtatacctggaatgatgttggacagctagtggaaaaattaaaaaaggaatggaatgttatttgtattactgatgttgtctacaatcatactgctgctaatagtaaatggatccaggaacatccagaatgtgcctataatcttgtgaattctccacacttaaaacctgcctgggtcttagacagagcactttggcgtttctcctgtgatgttgcagaagggaaatacaaagaaaagggaatacctgctttgattgaaaatgatcaccatatgaattccatccgaaaaataatttgggaggatatttttccaaagcttaaactctgggaatttttccaagtagatgtcaacaaagcggttgagcaatttagaagacttcttacacaagaaaataggcgagtaaccaagtctgatccaaaccaacaccttacgattattcaagatcctgaatacagacggtttggctgtactgtagatatgaacattgcactaacgactttcataccacatgacaaggggccagcagcaattgaagaatgctgtaattggtttcataaaagaatggaggaattaaattcagagaagcatcgactcattaactatcatcaggaacaggcagttaattgccttttgggaaatgtgttttatgaacgactggctggccatggtccaaaactaggacctgtcactagaaagcatcctttagttaccaggtattttactttcccatttgaagagatagacttctccatggaagaatctatgattcatctgccaaataaagcttgttttctgatggcacacaatggatgggtaatgggagatgatcctcttcgaaactttgctgaaccgggttcagaagtttacctaaggagagaacttatttgctggggagacagtgttaaattacgctatgggaataaaccagaggactgtccttatctctgggcacacatgaaaaaatacactgaaataactgcaacttatttccagggagtacgtcttgataactgccactcaacacctcttcacgtagctgagtacatgttggatgctgctaggaatttgcaacccaatttatatgtagtagctgaactgttcacaggaagtgaagatctggacaatgtctttgttactagactgggcattagttccttaataagagaggcaatgagtgcatataatagtcatgaagagggcagattagtttaccgatatggaggagaacctgttggatcctttgttcagccctgtttgaggcctttaatgccagctattgcacatgccctgtttatggatattacgcatgataatgagtgtcctattgtgcatagatcagcgtatgatgctcttccaagtactacaattgtttctatggcatgttgtgctagtggaagtacaagaggctatgatgaattagtgcctcatcagatttcagtggtttctgaagaacggttttacactaagtggaatcctgaagcattgccttcaaacacaggtgaagttaatttccaaagcggcattattgcagccaggtgtgctatcagtaaacttcatcaggagcttggagccaagggttttattcaggtgtatgtggatcaagttgatgaagacatagtggcagtaacaagacactcacctagcatccatcagtctgttgtggctgtatctagaactgctttcaggaatcccaagacttcattttacagcaaggaagtgcctcaaatgtgcatccctggcaaaattgaagaagtagttcttgaagctagaactattgagagaaacacgaaaccttataggaaggatgagaattcaatcaatggaacaccagatatcacagtagaaattagagaacatattcagcttaatgaaagtaaaattgttaaacaagctggagttgccacaaaagggcccaatgaatatattcaagaaatagaatttgaaaacttgtctccaggaagtgttattatattcagagttagtcttgatccacatgcacaagtcgctgttggaattcttcgaaatcatctgacacaattcagtcctcactttaaatctggcagcctagctgttgacaatgcagatcctatattaaaaattccttttgcttctcttgcctccagattaactttggctgagctaaatcagatcctttaccgatgtgaatcagaagaaaaggaagatggtggagggtgctatgacataccaaactggtcagcccttaaatatgcaggtcttcaaggtttaatgtctgtattggcagaaataagaccaaagaatgacttggggcatcctttttgtaataatttgagatctggagattggatgattgactatgtcagtaaccggcttatttcacgatcaggaactattgctgaagttggtaaatggttgcaggctatgttcttctacctgaagcagatcccacgttaccttatcccatgttactttgatgctatattaattggtgcatataccactcttctggatacagcatggaagcagatgtcaagctttgttcagaatggttcaacctttgtgaaacacctttcattgggttcagttcaactgtgtggagtaggaaaattcccttccctgccaattctttcacctgccctaatggatgtaccttataggttaaatgagatcacaaaagaaaaggagcaatgttgtgtttctctagctgcaggcttacctcatttttcttctggtattttccgctgctggggaagggatacttttattgcacttagaggtatactgctgattactggacgctatgtagaagccaggaatattattttagcatttgcgggtaccctgaggcatggtctcattcctaatctactgggtgaaggaatttatgccagatacaattgtcgggatgctgtgtggtggtggctgcagtgtatccaggattactgtaaaatggttccaaatggtctagacattctcaagtgcccagtttccagaatgtatcctacagatgattctgctcctttgcctgctggcacactggatcagccattgtttgaagtcatacaggaagcaatgcaaaaacacatgcagggcatacagttccgagaaaggaatgctggtccccagatagatcgaaacatgaaggacgaaggttttaatataactgcaggagttgatgaagaaacaggatttgtttatggaggaaatcgtttcaattgtggcacatggatggataaaatgggagaaagtgacagagctagaaacagaggaatcccagccacaccaagagatgggtctgctgtggaaattgtgggcctgagtaaatctgctgttcgctggttgctggaattatccaaaaaaaatattttcccttatcatgaagtcacagtaaaaagacatggaaaggctataaaggtctcatatgatgagtggaacagaaaaatacaagacaactttgaaaagctatttcatgtttccgaagacccttcagatttaaatgaaaagcatccaaatctggttcacaaacgtggcatatacaaagatagttatggagcttcaagtccttggtgtgactatcagctcaggcctaattttaccatagcaatggttgtggcccctgagctctttactacagaaaaagcatggaaagctttggagattgcagaaaaaaaattgcttggtccccttggcatgaaaactttagatccagatgatatggtttactgtggaatttatgacaatgcattagacaatgacaactacaatcttgctaaaggtttcaattatcaccaaggacctgagtggctgtggcctattgggtattttcttcgtgcaaaattatatttttccagattgatgggcccggagactactgcaaagactatagttttggttaaaaatgttctttcccgacattatgttcatcttgagagatccccttggaaaggacttccagaactgaccaatgagaatgcccagtactgtcctttcagctgtgaaacacaagcctggtcaattgctactattcttgagacactttatgatttatagtttattacagatattaagtatgcaattacttgtattataggatgcaaggtcatcatatgtaaatgccttatatgcacaggctcaagttgttttaaaaatctcatttattataatattgatgctcaattaggtaagattgtaaaagcattgattttttttaatgtacagaggtagatttcaatttgaatcagaaagaaatatcattaccaatgaaatgtgtttgagttcagtaagaattattcaaatgcctagaaatccatagtttggaaaagaaaaatcatgtcatcttctatttgtacagaaatgaaaataaaatatgaaaataatgaaagaaatgaaaagatagcttttaattgtggtatatataatcttcagtaacaatacatactgaatacgctgtggttcattaatattaacaccacgtactatagtattcttaatacagtgctcactgcatttaataaatatttaataaatgatgaatgatagaagtttccatctacaatatatgttcctaaatggagcacagatgttcaaactatgctttcattttttcactgatatattaatttttgtgtaatgaatgccaacagtatattttatatgatttacttatgtgaggaaacatgcaaagcattaggaaatttatttcctaaaaacagttttgtaaaattagtattgagttctattgagtattataagatagcttacattttcaaaatggaaattgtcggtcatatttctagaactttaaagaaaaaagaatgttatattagttttctaaaactcaactatctttagtcatgttcaaaaatctattgctagatcatagtagatactggttttctattaactcaaaacctacattgacaagtttaacattgagaagaatcttaacaaaaatatggatatgaattcagtagatatcttaaattcaataaaatcactggaagtttttcatgataacttattttaagatgccttaaaaatcttaaagtcacaaaaggaaaaaggtttttaacatttacatgagttaacattttttcatagaacttatttcctagatagaattttttactgttttttactgttttcttaagaaaacagttaaatcattatgcattcagttggaagaaagtagtggcaagaattctttcattgctatataatattcagtggctcatttatacctaataaaataatggtattttaaaataatgctactttcaaagtagcatttttttagttagtttacaggttacatacccaaaaccttaactatgactaagaaattaaagaagaaaaccagcaaactaaaacttctgggcagcaaaaatatataaatgcttcagatgtcaaatacccatgcttgaaagctcgtgtaatttactttaagattatctgcctgctcttcttcaaagctgaccttgctttagaaatagttttaactagcttagttttctggtttccaaaactaaaatagattaaatcctacaaatttaaggacagttgtgacagtaatctgaccactatctataaatacattggacattggtttccaaatctccctttcttcttcagttccttccttgttcaatatatacccttctctaaactgtgcgggtaaaaggaatgactgtccttgagagaaccattagtttatcaaaggtttatgtagttttgttgctgtaccctaactttgatattcagggaggtaggaaaggtaacagaaaaccagcatatttaatcaaagcaagaagtaatcgctgacagttaaatgtgaccaaaaaaattaaaagttcacaatttttttaatgtagccatttggggttatctctagtaaggcagatacccacgttggtaaatttttaggatattgtgttgcactagaaaactaagtggttcatatttctaatgaggaagattaatgaaagaacattgttatattctgcgtggtatattttaaagtttaagaaggcatgttaaacattatttcctctatggtagttaaaatacagaattagatttttaacaggtgtcatttgactaaacgtttcggtagaatgcttcatacttgagtgatgctggataaggtattgtatttcaacaatggactatgccttggtttttcactaatcaaaatcaaaattactctttaacatgataaatgaatttaccagtttagtatgctgtggtattttaataagttttcaaagataattgggaaaacatgagactggtcatattgatgaatattgtaacatgtgaattgtgatccatttctgatatgtcttgaactactgtgtctagtgggcaaatgtcattgttacctctgtgtgttaagaaaataaaaatattttctaaaggtc

SEQ ID NO: 106945 - DNA, 7179 bp, Homo sapiens
  Payload ID: 1006
  Gene Symbol: AGL
  Gene Name: amylo-alpha-1, 6-glucosidase, 4-alpha-glucanotransferase
  Uniprot ID: P35573
  ENST ID: ENST00000361522
  CDS Start-End: 263-4810
tgtataagaatttgcacatcccaagttgctatgtgaataggaatgcgtttccaggggaaggagaaagagacattacagagcagacagctctatgatgtttactatacttgctaaaatgtgaaattcagctaaattggaatacaaagtagtgccaaaacagcattaggtttgcggagttattttaaacataattgaaaaatcaaggttttttaatactttaaataaaacatctgtttttcaatgtggtaatttaagtcctacgatgagtttattaacatgtgctttttatttagggtatgagctacagttccgattaggcccaactttacagggaaaagcagttaccgtgtatacaaattacccatttcctggagaaacatttaatagagaaaaattccgttctctggattgggaaaatccaacagaaagagaagatgattctgataaatactgtaaacttaatctgcaacaatctggttcatttcagtattatttccttcaaggaaatgagaaaagtggtggaggttacatagttgtggaccccattttacgtgttggtgctgataatcatgtgctacccttggactgtgttactcttcagacatttttagctaagtgtttgggaccttttgatgaatgggaaagcagacttagggttgcaaaagaatcaggctacaacatgattcattttaccccattgcagactcttggactatctaggtcatgctactcccttgccaatcagttagaattaaatcctgacttttcaagacctaatagaaagtatacctggaatgatgttggacagctagtggaaaaattaaaaaaggaatggaatgttatttgtattactgatgttgtctacaatcatactgctgctaatagtaaatggatccaggaacatccagaatgtgcctataatcttgtgaattctccacacttaaaacctgcctgggtcttagacagagcactttggcgtttctcctgtgatgttgcagaagggaaatacaaagaaaagggaatacctgctttgattgaaaatgatcaccatatgaattccatccgaaaaataatttgggaggatatttttccaaagcttaaactctgggaatttttccaagtagatgtcaacaaagcggttgagcaatttagaagacttcttacacaagaaaataggcgagtaaccaagtctgatccaaaccaacaccttacgattattcaagatcctgaatacagacggtttggctgtactgtagatatgaacattgcactaacgactttcataccacatgacaaggggccagcagcaattgaagaatgctgtaattggtttcataaaagaatggaggaattaaattcagagaagcatcgactcattaactatcatcaggaacaggcagttaattgccttttgggaaatgtgttttatgaacgactggctggccatggtccaaaactaggacctgtcactagaaagcatcctttagttaccaggtattttactttcccatttgaagagatagacttctccatggaagaatctatgattcatctgccaaataaagcttgttttctgatggcacacaatggatgggtaatgggagatgatcctcttcgaaactttgctgaaccgggttcagaagtttacctaaggagagaacttatttgctggggagacagtgttaaattacgctatgggaataaaccagaggactgtccttatctctgggcacacatgaaaaaatacactgaaataactgcaacttatttccagggagtacgtcttgataactgccactcaacacctcttcacgtagctgagtacatgttggatgctgctaggaatttgcaacccaatttatatgtagtagctgaactgttcacaggaagtgaagatctggacaatgtctttgttactagactgggcattagttccttaataagagaggcaatgagtgcatataatagtcatgaagagggcagattagtttaccgatatggaggagaacctgttggatcctttgttcagccctgtttgaggcctttaatgccagctattgcacatgccctgtttatggatattacgcatgataatgagtgtcctattgtgcatagatcagcgtatgatgctcttccaagtactacaattgtttctatggcatgttgtgctagtggaagtacaagaggctatgatgaattagtgcctcatcagatttcagtggtttctgaagaacggttttacactaagtggaatcctgaagcattgccttcaaacacaggtgaagttaatttccaaagcggcattattgcagccaggtgtgctatcagtaaacttcatcaggagcttggagccaagggttttattcaggtgtatgtggatcaagttgatgaagacatagtggcagtaacaagacactcacctagcatccatcagtctgttgtggctgtatctagaactgctttcaggaatcccaagacttcattttacagcaaggaagtgcctcaaatgtgcatccctggcaaaattgaagaagtagttcttgaagctagaactattgagagaaacacgaaaccttataggaaggatgagaattcaatcaatggaacaccagatatcacagtagaaattagagaacatattcagcttaatgaaagtaaaattgttaaacaagctggagttgccacaaaagggcccaatgaatatattcaagaaatagaatttgaaaacttgtctccaggaagtgttattatattcagagttagtcttgatccacatgcacaagtcgctgttggaattcttcgaaatcatctgacacaattcagtcctcactttaaatctggcagcctagctgttgacaatgcagatcctatattaaaaattccttttgcttctcttgcctccagattaactttggctgagctaaatcagatcctttaccgatgtgaatcagaagaaaaggaagatggtggagggtgctatgacataccaaactggtcagcccttaaatatgcaggtcttcaaggtttaatgtctgtattggcagaaataagaccaaagaatgacttggggcatcctttttgtaataatttgagatctggagattggatgattgactatgtcagtaaccggcttatttcacgatcaggaactattgctgaagttggtaaatggttgcaggctatgttcttctacctgaagcagatcccacgttaccttatcccatgttactttgatgctatattaattggtgcatataccactcttctggatacagcatggaagcagatgtcaagctttgttcagaatggttcaacctttgtgaaacacctttcattgggttcagttcaactgtgtggagtaggaaaattcccttccctgccaattctttcacctgccctaatggatgtaccttataggttaaatgagatcacaaaagaaaaggagcaatgttgtgtttctctagctgcaggcttacctcatttttcttctggtattttccgctgctggggaagggatacttttattgcacttagaggtatactgctgattactggacgctatgtagaagccaggaatattattttagcatttgcgggtaccctgaggcatggtctcattcctaatctactgggtgaaggaatttatgccagatacaattgtcgggatgctgtgtggtggtggctgcagtgtatccaggattactgtaaaatggttccaaatggtctagacattctcaagtgcccagtttccagaatgtatcctacagatgattctgctcctttgcctgctggcacactggatcagccattgtttgaagtcatacaggaagcaatgcaaaaacacatgcagggcatacagttccgagaaaggaatgctggtccccagatagatcgaaacatgaaggacgaaggttttaatataactgcaggagttgatgaagaaacaggatttgtttatggaggaaatcgtttcaattgtggcacatggatggataaaatgggagaaagtgacagagctagaaacagaggaatcccagccacaccaagagatgggtctgctgtggaaattgtgggcctgagtaaatctgctgttcgctggttgctggaattatccaaaaaaaatattttcccttatcatgaagtcacagtaaaaagacatggaaaggctataaaggtctcatatgatgagtggaacagaaaaatacaagacaactttgaaaagctatttcatgtttccgaagacccttcagatttaaatgaaaagcatccaaatctggttcacaaacgtggcatatacaaagatagttatggagcttcaagtccttggtgtgactatcagctcaggcctaattttaccatagcaatggttgtggcccctgagctctttactacagaaaaagcatggaaagctttggagattgcagaaaaaaaattgcttggtccccttggcatgaaaactttagatccagatgatatggtttactgtggaatttatgacaatgcattagacaatgacaactacaatcttgctaaaggtttcaattatcaccaaggacctgagtggctgtggcctattgggtattttcttcgtgcaaaattatatttttccagattgatgggcccggagactactgcaaagactatagttttggttaaaaatgttctttcccgacattatgttcatcttgagagatccccttggaaaggacttccagaactgaccaatgagaatgcccagtactgtcctttcagctgtgaaacacaagcctggtcaattgctactattcttgagacactttatgatttatagtttattacagatattaagtatgcaattacttgtattataggatgcaaggtcatcatatgtaaatgccttatatgcacaggctcaagttgttttaaaaatctcatttattataatattgatgctcaattaggtaagattgtaaaagcattgattttttttaatgtacagaggtagatttcaatttgaatcagaaagaaatatcattaccaatgaaatgtgtttgagttcagtaagaattattcaaatgcctagaaatccatagtttggaaaagaaaaatcatgtcatcttctatttgtacagaaatgaaaataaaatatgaaaataatgaaagaaatgaaaagatagcttttaattgtggtatatataatcttcagtaacaatacatactgaatacgctgtggttcattaatattaacaccacgtactatagtattcttaatacagtgctcactgcatttaataaatatttaataaatgatgaatgatagaagtttccatctacaatatatgttcctaaatggagcacagatgttcaaactatgctttcattttttcactgatatattaatttttgtgtaatgaatgccaacagtatattttatatgatttacttatgtgaggaaacatgcaaagcattaggaaatttatttcctaaaaacagttttgtaaaattagtattgagttctattgagtattataagatagcttacattttcaaaatggaaattgtcggtcatatttctagaactttaaagaaaaaagaatgttatattagttttctaaaactcaactatctttagtcatgttcaaaaatctattgctagatcatagtagatactggttttctattaactcaaaacctacattgacaagtttaacattgagaagaatcttaacaaaaatatggatatgaattcagtagatatcttaaattcaataaaatcactggaagtttttcatgataacttattttaagatgccttaaaaatcttaaagtcacaaaaggaaaaaggtttttaacatttacatgagttaacattttttcatagaacttatttcctagatagaattttttactgttttttactgttttcttaagaaaacagttaaatcattatgcattcagttggaagaaagtagtggcaagaattctttcattgctatataatattcagtggctcatttatacctaataaaataatggtattttaaaataatgctactttcaaagtagcatttttttagttagtttacaggttacatacccaaaaccttaactatgactaagaaattaaagaagaaaaccagcaaactaaaacttctgggcagcaaaaatatataaatgcttcagatgtcaaatacccatgcttgaaagctcgtgtaatttactttaagattatctgcctgctcttcttcaaagctgaccttgctttagaaatagttttaactagcttagttttctggtttccaaaactaaaatagattaaatcctacaaatttaaggacagttgtgacagtaatctgaccactatctataaatacattggacattggtttccaaatctccctttcttcttcagttccttccttgttcaatatatacccttctctaaactgtgcgggtaaaaggaatgactgtccttgagagaaccattagtttatcaaaggtttatgtagttttgttgctgtaccctaactttgatattcagggaggtaggaaaggtaacagaaaaccagcatatttaatcaaagcaagaagtaatcgctgacagttaaatgtgaccaaaaaaattaaaagttcacaatttttttaatgtagccatttggggttatctctagtaaggcagatacccacgttggtaaatttttaggatattgtgttgcactagaaaactaagtggttcatatttctaatgaggaagattaatgaaagaacattgttatattctgcgtggtatattttaaagtttaagaaggcatgttaaacattatttcctctatggtagttaaaatacagaattagatttttaacaggtgtcatttgactaaacgtttcggtagaatgcttcatacttgagtgatgctggataaggtattgtatttcaacaatggactatgccttggtttttcactaatcaaaatcaaaattactctttaacatgataaatgaatttaccagtttagtatgctgtggtattttaataagttttcaaagataattgggaaaacatgagactggtcatattgatgaatattgtaacatgtgaattgtgatccatttctgatatgtcttgaactactgtgtctagtgggcaaatgtcattgttacctctgtgtgttaagaaaataaaaatattttctaaaggtc

SEQ ID NO: 106946 - DNA, 7179 bp, Homo sapiens
  Payload ID: 1006
  Gene Symbol: AGL
  Gene Name: amylo-alpha-1, 6-glucosidase, 4-alpha-glucanotransferase
  Uniprot ID: P35573
  ENST ID: ENST00000361302
  CDS Start-End: 260-4810
gggtaactcattcgactgtggagttcttttaattcttatgaaagatttcaaatcctctagaagccaaaatgggacacagtaaacagattcgaattttacttctgaacgaaatggagaaactggaaaagaccctcttcagacttgaacaagaaactgggtctcactatgttgcccaggttgatattgaactcctggactcaagcaaccctccctctttggcctctgaaagtactgggattacaagcataagccaccgggcatggccccaattctgagcattaatttatttattgggtatgagctacagttccgattaggcccaactttacagggaaaagcagttaccgtgtatacaaattacccatttcctggagaaacatttaatagagaaaaattccgttctctggattgggaaaatccaacagaaagagaagatgattctgataaatactgtaaacttaatctgcaacaatctggttcatttcagtattatttccttcaaggaaatgagaaaagtggtggaggttacatagttgtggaccccattttacgtgttggtgctgataatcatgtgctacccttggactgtgttactcttcagacatttttagctaagtgtttgggaccttttgatgaatgggaaagcagacttagggttgcaaaagaatcaggctacaacatgattcattttaccccattgcagactcttggactatctaggtcatgctactcccttgccaatcagttagaattaaatcctgacttttcaagacctaatagaaagtatacctggaatgatgttggacagctagtggaaaaattaaaaaaggaatggaatgttatttgtattactgatgttgtctacaatcatactgctgctaatagtaaatggatccaggaacatccagaatgtgcctataatcttgtgaattctccacacttaaaacctgcctgggtcttagacagagcactttggcgtttctcctgtgatgttgcagaagggaaatacaaagaaaagggaatacctgctttgattgaaaatgatcaccatatgaattccatccgaaaaataatttgggaggatatttttccaaagcttaaactctgggaatttttccaagtagatgtcaacaaagcggttgagcaatttagaagacttcttacacaagaaaataggcgagtaaccaagtctgatccaaaccaacaccttacgattattcaagatcctgaatacagacggtttggctgtactgtagatatgaacattgcactaacgactttcataccacatgacaaggggccagcagcaattgaagaatgctgtaattggtttcataaaagaatggaggaattaaattcagagaagcatcgactcattaactatcatcaggaacaggcagttaattgccttttgggaaatgtgttttatgaacgactggctggccatggtccaaaactaggacctgtcactagaaagcatcctttagttaccaggtattttactttcccatttgaagagatagacttctccatggaagaatctatgattcatctgccaaataaagcttgttttctgatggcacacaatggatgggtaatgggagatgatcctcttcgaaactttgctgaaccgggttcagaagtttacctaaggagagaacttatttgctggggagacagtgttaaattacgctatgggaataaaccagaggactgtccttatctctgggcacacatgaaaaaatacactgaaataactgcaacttatttccagggagtacgtcttgataactgccactcaacacctcttcacgtagctgagtacatgttggatgctgctaggaatttgcaacccaatttatatgtagtagctgaactgttcacaggaagtgaagatctggacaatgtctttgttactagactgggcattagttccttaataagagaggcaatgagtgcatataatagtcatgaagagggcagattagtttaccgatatggaggagaacctgttggatcctttgttcagccctgtttgaggcctttaatgccagctattgcacatgccctgtttatggatattacgcatgataatgagtgtcctattgtgcatagatcagcgtatgatgctcttccaagtactacaattgtttctatggcatgttgtgctagtggaagtacaagaggctatgatgaattagtgcctcatcagatttcagtggtttctgaagaacggttttacactaagtggaatcctgaagcattgccttcaaacacaggtgaagttaatttccaaagcggcattattgcagccaggtgtgctatcagtaaacttcatcaggagcttggagccaagggttttattcaggtgtatgtggatcaagttgatgaagacatagtggcagtaacaagacactcacctagcatccatcagtctgttgtggctgtatctagaactgctttcaggaatcccaagacttcattttacagcaaggaagtgcctcaaatgtgcatccctggcaaaattgaagaagtagttcttgaagctagaactattgagagaaacacgaaaccttataggaaggatgagaattcaatcaatggaacaccagatatcacagtagaaattagagaacatattcagcttaatgaaagtaaaattgttaaacaagctggagttgccacaaaagggcccaatgaatatattcaagaaatagaatttgaaaacttgtctccaggaagtgttattatattcagagttagtcttgatccacatgcacaagtcgctgttggaattcttcgaaatcatctgacacaattcagtcctcactttaaatctggcagcctagctgttgacaatgcagatcctatattaaaaattccttttgcttctcttgcctccagattaactttggctgagctaaatcagatcctttaccgatgtgaatcagaagaaaaggaagatggtggagggtgctatgacataccaaactggtcagcccttaaatatgcaggtcttcaaggtttaatgtctgtattggcagaaataagaccaaagaatgacttggggcatcctttttgtaataatttgagatctggagattggatgattgactatgtcagtaaccggcttatttcacgatcaggaactattgctgaagttggtaaatggttgcaggctatgttcttctacctgaagcagatcccacgttaccttatcccatgttactttgatgctatattaattggtgcatataccactcttctggatacagcatggaagcagatgtcaagctttgttcagaatggttcaacctttgtgaaacacctttcattgggttcagttcaactgtgtggagtaggaaaattcccttccctgccaattctttcacctgccctaatggatgtaccttataggttaaatgagatcacaaaagaaaaggagcaatgttgtgtttctctagctgcaggcttacctcatttttcttctggtattttccgctgctggggaagggatacttttattgcacttagaggtatactgctgattactggacgctatgtagaagccaggaatattattttagcatttgcgggtaccctgaggcatggtctcattcctaatctactgggtgaaggaatttatgccagatacaattgtcgggatgctgtgtggtggtggctgcagtgtatccaggattactgtaaaatggttccaaatggtctagacattctcaagtgcccagtttccagaatgtatcctacagatgattctgctcctttgcctgctggcacactggatcagccattgtttgaagtcatacaggaagcaatgcaaaaacacatgcagggcatacagttccgagaaaggaatgctggtccccagatagatcgaaacatgaaggacgaaggttttaatataactgcaggagttgatgaagaaacaggatttgtttatggaggaaatcgtttcaattgtggcacatggatggataaaatgggagaaagtgacagagctagaaacagaggaatcccagccacaccaagagatgggtctgctgtggaaattgtgggcctgagtaaatctgctgttcgctggttgctggaattatccaaaaaaaatattttcccttatcatgaagtcacagtaaaaagacatggaaaggctataaaggtctcatatgatgagtggaacagaaaaatacaagacaactttgaaaagctatttcatgtttccgaagacccttcagatttaaatgaaaagcatccaaatctggttcacaaacgtggcatatacaaagatagttatggagcttcaagtccttggtgtgactatcagctcaggcctaattttaccatagcaatggttgtggcccctgagctctttactacagaaaaagcatggaaagctttggagattgcagaaaaaaaattgcttggtccccttggcatgaaaactttagatccagatgatatggtttactgtggaatttatgacaatgcattagacaatgacaactacaatcttgctaaaggtttcaattatcaccaaggacctgagtggctgtggcctattgggtattttcttcgtgcaaaattatatttttccagattgatgggcccggagactactgcaaagactatagttttggttaaaaatgttctttcccgacattatgttcatcttgagagatccccttggaaaggacttccagaactgaccaatgagaatgcccagtactgtcctttcagctgtgaaacacaagcctggtcaattgctactattcttgagacactttatgatttatagtttattacagatattaagtatgcaattacttgtattataggatgcaaggtcatcatatgtaaatgccttatatgcacaggctcaagttgttttaaaaatctcatttattataatattgatgctcaattaggtaagattgtaaaagcattgattttttttaatgtacagaggtagatttcaatttgaatcagaaagaaatatcattaccaatgaaatgtgtttgagttcagtaagaattattcaaatgcctagaaatccatagtttggaaaagaaaaatcatgtcatcttctatttgtacagaaatgaaaataaaatatgaaaataatgaaagaaatgaaaagatagcttttaattgtggtatatataatcttcagtaacaatacatactgaatacgctgtggttcattaatattaacaccacgtactatagtattcttaatacagtgctcactgcatttaataaatatttaataaatgatgaatgatagaagtttccatctacaatatatgttcctaaatggagcacagatgttcaaactatgctttcattttttcactgatatattaatttttgtgtaatgaatgccaacagtatattttatatgatttacttatgtgaggaaacatgcaaagcattaggaaatttatttcctaaaaacagttttgtaaaattagtattgagttctattgagtattataagatagcttacattttcaaaatggaaattgtcggtcatatttctagaactttaaagaaaaaagaatgttatattagttttctaaaactcaactatctttagtcatgttcaaaaatctattgctagatcatagtagatactggttttctattaactcaaaacctacattgacaagtttaacattgagaagaatcttaacaaaaatatggatatgaattcagtagatatcttaaattcaataaaatcactggaagtttttcatgataacttattttaagatgccttaaaaatcttaaagtcacaaaaggaaaaaggtttttaacatttacatgagttaacattttttcatagaacttatttcctagatagaattttttactgttttttactgttttcttaagaaaacagttaaatcattatgcattcagttggaagaaagtagtggcaagaattctttcattgctatataatattcagtggctcatttatacctaataaaataatggtattttaaaataatgctactttcaaagtagcatttttttagttagtttacaggttacatacccaaaaccttaactatgactaagaaattaaagaagaaaaccagcaaactaaaacttctgggcagcaaaaatatataaatgcttcagatgtcaaatacccatgcttgaaagctcgtgtaatttactttaagattatctgcctgctcttcttcaaagctgaccttgctttagaaatagttttaactagcttagttttctggtttccaaaactaaaatagattaaatcctacaaatttaaggacagttgtgacagtaatctgaccactatctataaatacattggacattggtttccaaatctccctttcttcttcagttccttccttgttcaatatatacccttctctaaactgtgcgggtaaaaggaatgactgtccttgagagaaccattagtttatcaaaggtttatgtagttttgttgctgtaccctaactttgatattcagggaggtaggaaaggtaacagaaaaccagcatatttaatcaaagcaagaagtaatcgctgacagttaaatgtgaccaaaaaaattaaaagttcacaatttttttaatgtagccatttggggttatctctagtaaggcagatacccacgttggtaaatttttaggatattgtgttgcactagaaaactaagtggttcatatttctaatgaggaagattaatgaaagaacattgttatattctgcgtggtatattttaaagtttaagaaggcatgttaaacattatttcctctatggtagttaaaatacagaattagatttttaacaggtgtcatttgactaaacgtttcggtagaatgcttcatacttgagtgatgctggataaggtattgtatttcaacaatggactatgccttggtttttcactaatcaaaatcaaaattactctttaacatgataaatgaatttaccagtttagtatgctgtggtattttaataagttttcaaagataattgggaaaacatgagactggtcatattgatgaatattgtaacatgtgaattgtgatccatttctgatatgtcttgaactactgtgtctagtgggcaaatgtcattgttacctctgtgtgttaagaaaataaaaatattttctaaaggtc

SEQ ID NO: 106947 - DNA, 7368 bp, Homo sapiens
  Payload ID: 1006
  Gene Symbol: AGL
  Gene Name: amylo-alpha-1, 6-glucosidase, 4-alpha-glucanotransferase
  Uniprot ID: P35573
  ENST ID: ENST00000361915
  CDS Start-End: 401-4999
cccggaagtgggccagaggtacggtccgctcccacctggggcgagtgcgcgcacggccaggttgggtaccgggtgcgcccaggaacccgcgcgaggcgaagtcgctgagactctgcctgcttctcacccagctgcctcggcgctgccccggtcgctcgccgcccctccctttgcccttcacggcgcccggccctccttgggctgcggcttctgtgcgaggctgggcagccagcccttccccttctgtttctccccgtcccctccccccgaccgtagcaccagagtcgcgggtcctgcagtgccccagaagccgcacgtataactccctcggcgggtaactcattcgactgtggagttcttttaattcttatgaaagatttcaaatcctctagaagccaaaatgggacacagtaaacagattcgaattttacttctgaacgaaatggagaaactggaaaagaccctcttcagacttgaacaagggtatgagctacagttccgattaggcccaactttacagggaaaagcagttaccgtgtatacaaattacccatttcctggagaaacatttaatagagaaaaattccgttctctggattgggaaaatccaacagaaagagaagatgattctgataaatactgtaaacttaatctgcaacaatctggttcatttcagtattatttccttcaaggaaatgagaaaagtggtggaggttacatagttgtggaccccattttacgtgttggtgctgataatcatgtgctacccttggactgtgttactcttcagacatttttagctaagtgtttgggaccttttgatgaatgggaaagcagacttagggttgcaaaagaatcaggctacaacatgattcattttaccccattgcagactcttggactatctaggtcatgctactcccttgccaatcagttagaattaaatcctgacttttcaagacctaatagaaagtatacctggaatgatgttggacagctagtggaaaaattaaaaaaggaatggaatgttatttgtattactgatgttgtctacaatcatactgctgctaatagtaaatggatccaggaacatccagaatgtgcctataatcttgtgaattctccacacttaaaacctgcctgggtcttagacagagcactttggcgtttctcctgtgatgttgcagaagggaaatacaaagaaaagggaatacctgctttgattgaaaatgatcaccatatgaattccatccgaaaaataatttgggaggatatttttccaaagcttaaactctgggaatttttccaagtagatgtcaacaaagcggttgagcaatttagaagacttcttacacaagaaaataggcgagtaaccaagtctgatccaaaccaacaccttacgattattcaagatcctgaatacagacggtttggctgtactgtagatatgaacattgcactaacgactttcataccacatgacaaggggccagcagcaattgaagaatgctgtaattggtttcataaaagaatggaggaattaaattcagagaagcatcgactcattaactatcatcaggaacaggcagttaattgccttttgggaaatgtgttttatgaacgactggctggccatggtccaaaactaggacctgtcactagaaagcatcctttagttaccaggtattttactttcccatttgaagagatagacttctccatggaagaatctatgattcatctgccaaataaagcttgttttctgatggcacacaatggatgggtaatgggagatgatcctcttcgaaactttgctgaaccgggttcagaagtttacctaaggagagaacttatttgctggggagacagtgttaaattacgctatgggaataaaccagaggactgtccttatctctgggcacacatgaaaaaatacactgaaataactgcaacttatttccagggagtacgtcttgataactgccactcaacacctcttcacgtagctgagtacatgttggatgctgctaggaatttgcaacccaatttatatgtagtagctgaactgttcacaggaagtgaagatctggacaatgtctttgttactagactgggcattagttccttaataagagaggcaatgagtgcatataatagtcatgaagagggcagattagtttaccgatatggaggagaacctgttggatcctttgttcagccctgtttgaggcctttaatgccagctattgcacatgccctgtttatggatattacgcatgataatgagtgtcctattgtgcatagatcagcgtatgatgctcttccaagtactacaattgtttctatggcatgttgtgctagtggaagtacaagaggctatgatgaattagtgcctcatcagatttcagtggtttctgaagaacggttttacactaagtggaatcctgaagcattgccttcaaacacaggtgaagttaatttccaaagcggcattattgcagccaggtgtgctatcagtaaacttcatcaggagcttggagccaagggttttattcaggtgtatgtggatcaagttgatgaagacatagtggcagtaacaagacactcacctagcatccatcagtctgttgtggctgtatctagaactgctttcaggaatcccaagacttcattttacagcaaggaagtgcctcaaatgtgcatccctggcaaaattgaagaagtagttcttgaagctagaactattgagagaaacacgaaaccttataggaaggatgagaattcaatcaatggaacaccagatatcacagtagaaattagagaacatattcagcttaatgaaagtaaaattgttaaacaagctggagttgccacaaaagggcccaatgaatatattcaagaaatagaatttgaaaacttgtctccaggaagtgttattatattcagagttagtcttgatccacatgcacaagtcgctgttggaattcttcgaaatcatctgacacaattcagtcctcactttaaatctggcagcctagctgttgacaatgcagatcctatattaaaaattccttttgcttctcttgcctccagattaactttggctgagctaaatcagatcctttaccgatgtgaatcagaagaaaaggaagatggtggagggtgctatgacataccaaactggtcagcccttaaatatgcaggtcttcaaggtttaatgtctgtattggcagaaataagaccaaagaatgacttggggcatcctttttgtaataatttgagatctggagattggatgattgactatgtcagtaaccggcttatttcacgatcaggaactattgctgaagttggtaaatggttgcaggctatgttcttctacctgaagcagatcccacgttaccttatcccatgttactttgatgctatattaattggtgcatataccactcttctggatacagcatggaagcagatgtcaagctttgttcagaatggttcaacctttgtgaaacacctttcattgggttcagttcaactgtgtggagtaggaaaattcccttccctgccaattctttcacctgccctaatggatgtaccttataggttaaatgagatcacaaaagaaaaggagcaatgttgtgtttctctagctgcaggcttacctcatttttcttctggtattttccgctgctggggaagggatacttttattgcacttagaggtatactgctgattactggacgctatgtagaagccaggaatattattttagcatttgcgggtaccctgaggcatggtctcattcctaatctactgggtgaaggaatttatgccagatacaattgtcgggatgctgtgtggtggtggctgcagtgtatccaggattactgtaaaatggttccaaatggtctagacattctcaagtgcccagtttccagaatgtatcctacagatgattctgctcctttgcctgctggcacactggatcagccattgtttgaagtcatacaggaagcaatgcaaaaacacatgcagggcatacagttccgagaaaggaatgctggtccccagatagatcgaaacatgaaggacgaaggttttaatataactgcaggagttgatgaagaaacaggatttgtttatggaggaaatcgtttcaattgtggcacatggatggataaaatgggagaaagtgacagagctagaaacagaggaatcccagccacaccaagagatgggtctgctgtggaaattgtgggcctgagtaaatctgctgttcgctggttgctggaattatccaaaaaaaatattttcccttatcatgaagtcacagtaaaaagacatggaaaggctataaaggtctcatatgatgagtggaacagaaaaatacaagacaactttgaaaagctatttcatgtttccgaagacccttcagatttaaatgaaaagcatccaaatctggttcacaaacgtggcatatacaaagatagttatggagcttcaagtccttggtgtgactatcagctcaggcctaattttaccatagcaatggttgtggcccctgagctctttactacagaaaaagcatggaaagctttggagattgcagaaaaaaaattgcttggtccccttggcatgaaaactttagatccagatgatatggtttactgtggaatttatgacaatgcattagacaatgacaactacaatcttgctaaaggtttcaattatcaccaaggacctgagtggctgtggcctattgggtattttcttcgtgcaaaattatatttttccagattgatgggcccggagactactgcaaagactatagttttggttaaaaatgttctttcccgacattatgttcatcttgagagatccccttggaaaggacttccagaactgaccaatgagaatgcccagtactgtcctttcagctgtgaaacacaagcctggtcaattgctactattcttgagacactttatgatttatagtttattacagatattaagtatgcaattacttgtattataggatgcaaggtcatcatatgtaaatgccttatatgcacaggctcaagttgttttaaaaatctcatttattataatattgatgctcaattaggtaagattgtaaaagcattgattttttttaatgtacagaggtagatttcaatttgaatcagaaagaaatatcattaccaatgaaatgtgtttgagttcagtaagaattattcaaatgcctagaaatccatagtttggaaaagaaaaatcatgtcatcttctatttgtacagaaatgaaaataaaatatgaaaataatgaaagaaatgaaaagatagcttttaattgtggtatatataatcttcagtaacaatacatactgaatacgctgtggttcattaatattaacaccacgtactatagtattcttaatacagtgctcactgcatttaataaatatttaataaatgatgaatgatagaagtttccatctacaatatatgttcctaaatggagcacagatgttcaaactatgctttcattttttcactgatatattaatttttgtgtaatgaatgccaacagtatattttatatgatttacttatgtgaggaaacatgcaaagcattaggaaatttatttcctaaaaacagttttgtaaaattagtattgagttctattgagtattataagatagcttacattttcaaaatggaaattgtcggtcatatttctagaactttaaagaaaaaagaatgttatattagttttctaaaactcaactatctttagtcatgttcaaaaatctattgctagatcatagtagatactggttttctattaactcaaaacctacattgacaagtttaacattgagaagaatcttaacaaaaatatggatatgaattcagtagatatcttaaattcaataaaatcactggaagtttttcatgataacttattttaagatgccttaaaaatcttaaagtcacaaaaggaaaaaggtttttaacatttacatgagttaacattttttcatagaacttatttcctagatagaattttttactgttttttactgttttcttaagaaaacagttaaatcattatgcattcagttggaagaaagtagtggcaagaattctttcattgctatataatattcagtggctcatttatacctaataaaataatggtattttaaaataatgctactttcaaagtagcatttttttagttagtttacaggttacatacccaaaaccttaactatgactaagaaattaaagaagaaaaccagcaaactaaaacttctgggcagcaaaaatatataaatgcttcagatgtcaaatacccatgcttgaaagctcgtgtaatttactttaagattatctgcctgctcttcttcaaagctgaccttgctttagaaatagttttaactagcttagttttctggtttccaaaactaaaatagattaaatcctacaaatttaaggacagttgtgacagtaatctgaccactatctataaatacattggacattggtttccaaatctccctttcttcttcagttccttccttgttcaatatatacccttctctaaactgtgcgggtaaaaggaatgactgtccttgagagaaccattagtttatcaaaggtttatgtagttttgttgctgtaccctaactttgatattcagggaggtaggaaaggtaacagaaaaccagcatatttaatcaaagcaagaagtaatcgctgacagttaaatgtgaccaaaaaaattaaaagttcacaatttttttaatgtagccatttggggttatctctagtaaggcagatacccacgttggtaaatttttaggatattgtgttgcactagaaaactaagtggttcatatttctaatgaggaagattaatgaaagaacattgttatattctgcgtggtatattttaaagtttaagaaggcatgttaaacattatttcctctatggtagttaaaatacagaattagatttttaacaggtgtcatttgactaaacgtttcggtagaatgcttcatacttgagtgatgctggataaggtattgtatttcaacaatggactatgccttggtttttcactaatcaaaatcaaaattactctttaacatgataaatgaatttaccagtttagtatgctgtggtattttaataagttttcaaagataattgggaaaacatgagactggtcatattgatgaatattgtaacatgtgaattgtgatccatttctgatatgtcttgaactactgtgtctagtgggcaaatgtcattgttacctctgtgtgttaagaaaataaaaatattttctaaaggtc

SEQ ID NO: 106948 - DNA, 6923 bp, Homo sapiens
  Payload ID: 1006
  Gene Symbol: AGL
  Gene Name: amylo-alpha-1, 6-glucosidase, 4-alpha-glucanotransferase
  Uniprot ID: P35573
  ENST ID: ENST00000370161
  CDS Start-End: 1-4551
atggccccaattctgagcattaatttatttattgggtatgagctacagttccgattaggcccaactttacagggaaaagcagttaccgtgtatacaaattacccatttcctggagaaacatttaatagagaaaaattccgttctctggattgggaaaatccaacagaaagagaagatgattctgataaatactgtaaacttaatctgcaacaatctggttcatttcagtattatttccttcaaggaaatgagaaaagtggtggaggttacatagttgtggaccccattttacgtgttggtgctgataatcatgtgctacccttggactgtgttactcttcagacatttttagctaagtgtttgggaccttttgatgaatgggaaagcagacttagggttgcaaaagaatcaggctacaacatgattcattttaccccattgcagactcttggactatctaggtcatgctactcccttgccaatcagttagaattaaatcctgacttttcaagacctaatagaaagtatacctggaatgatgttggacagctagtggaaaaattaaaaaaggaatggaatgttatttgtattactgatgttgtctacaatcatactgctgctaatagtaaatggatccaggaacatccagaatgtgcctataatcttgtgaattctccacacttaaaacctgcctgggtcttagacagagcactttggcgtttctcctgtgatgttgcagaagggaaatacaaagaaaagggaatacctgctttgattgaaaatgatcaccatatgaattccatccgaaaaataatttgggaggatatttttccaaagcttaaactctgggaatttttccaagtagatgtcaacaaagcggttgagcaatttagaagacttcttacacaagaaaataggcgagtaaccaagtctgatccaaaccaacaccttacgattattcaagatcctgaatacagacggtttggctgtactgtagatatgaacattgcactaacgactttcataccacatgacaaggggccagcagcaattgaagaatgctgtaattggtttcataaaagaatggaggaattaaattcagagaagcatcgactcattaactatcatcaggaacaggcagttaattgccttttgggaaatgtgttttatgaacgactggctggccatggtccaaaactaggacctgtcactagaaagcatcctttagttaccaggtattttactttcccatttgaagagatagacttctccatggaagaatctatgattcatctgccaaataaagcttgttttctgatggcacacaatggatgggtaatgggagatgatcctcttcgaaactttgctgaaccgggttcagaagtttacctaaggagagaacttatttgctggggagacagtgttaaattacgctatgggaataaaccagaggactgtccttatctctgggcacacatgaaaaaatacactgaaataactgcaacttatttccagggagtacgtcttgataactgccactcaacacctcttcacgtagctgagtacatgttggatgctgctaggaatttgcaacccaatttatatgtagtagctgaactgttcacaggaagtgaagatctggacaatgtctttgttactagactgggcattagttccttaataagagaggcaatgagtgcatataatagtcatgaagagggcagattagtttaccgatatggaggagaacctgttggatcctttgttcagccctgtttgaggcctttaatgccagctattgcacatgccctgtttatggatattacgcatgataatgagtgtcctattgtgcatagatcagcgtatgatgctcttccaagtactacaattgtttctatggcatgttgtgctagtggaagtacaagaggctatgatgaattagtgcctcatcagatttcagtggtttctgaagaacggttttacactaagtggaatcctgaagcattgccttcaaacacaggtgaagttaatttccaaagcggcattattgcagccaggtgtgctatcagtaaacttcatcaggagcttggagccaagggttttattcaggtgtatgtggatcaagttgatgaagacatagtggcagtaacaagacactcacctagcatccatcagtctgttgtggctgtatctagaactgctttcaggaatcccaagacttcattttacagcaaggaagtgcctcaaatgtgcatccctggcaaaattgaagaagtagttcttgaagctagaactattgagagaaacacgaaaccttataggaaggatgagaattcaatcaatggaacaccagatatcacagtagaaattagagaacatattcagcttaatgaaagtaaaattgttaaacaagctggagttgccacaaaagggcccaatgaatatattcaagaaatagaatttgaaaacttgtctccaggaagtgttattatattcagagttagtcttgatccacatgcacaagtcgctgttggaattcttcgaaatcatctgacacaattcagtcctcactttaaatctggcagcctagctgttgacaatgcagatcctatattaaaaattccttttgcttctcttgcctccagattaactttggctgagctaaatcagatcctttaccgatgtgaatcagaagaaaaggaagatggtggagggtgctatgacataccaaactggtcagcccttaaatatgcaggtcttcaaggtttaatgtctgtattggcagaaataagaccaaagaatgacttggggcatcctttttgtaataatttgagatctggagattggatgattgactatgtcagtaaccggcttatttcacgatcaggaactattgctgaagttggtaaatggttgcaggctatgttcttctacctgaagcagatcccacgttaccttatcccatgttactttgatgctatattaattggtgcatataccactcttctggatacagcatggaagcagatgtcaagctttgttcagaatggttcaacctttgtgaaacacctttcattgggttcagttcaactgtgtggagtaggaaaattcccttccctgccaattctttcacctgccctaatggatgtaccttataggttaaatgagatcacaaaagaaaaggagcaatgttgtgtttctctagctgcaggcttacctcatttttcttctggtattttccgctgctggggaagggatacttttattgcacttagaggtatactgctgattactggacgctatgtagaagccaggaatattattttagcatttgcgggtaccctgaggcatggtctcattcctaatctactgggtgaaggaatttatgccagatacaattgtcgggatgctgtgtggtggtggctgcagtgtatccaggattactgtaaaatggttccaaatggtctagacattctcaagtgcccagtttccagaatgtatcctacagatgattctgctcctttgcctgctggcacactggatcagccattgtttgaagtcatacaggaagcaatgcaaaaacacatgcagggcatacagttccgagaaaggaatgctggtccccagatagatcgaaacatgaaggacgaaggttttaatataactgcaggagttgatgaagaaacaggatttgtttatggaggaaatcgtttcaattgtggcacatggatggataaaatgggagaaagtgacagagctagaaacagaggaatcccagccacaccaagagatgggtctgctgtggaaattgtgggcctgagtaaatctgctgttcgctggttgctggaattatccaaaaaaaatattttcccttatcatgaagtcacagtaaaaagacatggaaaggctataaaggtctcatatgatgagtggaacagaaaaatacaagacaactttgaaaagctatttcatgtttccgaagacccttcagatttaaatgaaaagcatccaaatctggttcacaaacgtggcatatacaaagatagttatggagcttcaagtccttggtgtgactatcagctcaggcctaattttaccatagcaatggttgtggcccctgagctctttactacagaaaaagcatggaaagctttggagattgcagaaaaaaaattgcttggtccccttggcatgaaaactttagatccagatgatatggtttactgtggaatttatgacaatgcattagacaatgacaactacaatcttgctaaaggtttcaattatcaccaaggacctgagtggctgtggcctattgggtattttcttcgtgcaaaattatatttttccagattgatgggcccggagactactgcaaagactatagttttggttaaaaatgttctttcccgacattatgttcatcttgagagatccccttggaaaggacttccagaactgaccaatgagaatgcccagtactgtcctttcagctgtgaaacacaagcctggtcaattgctactattcttgagacactttatgatttatagtttattacagatattaagtatgcaattacttgtattataggatgcaaggtcatcatatgtaaatgccttatatgcacaggctcaagttgttttaaaaatctcatttattataatattgatgctcaattaggtaagattgtaaaagcattgattttttttaatgtacagaggtagatttcaatttgaatcagaaagaaatatcattaccaatgaaatgtgtttgagttcagtaagaattattcaaatgcctagaaatccatagtttggaaaagaaaaatcatgtcatcttctatttgtacagaaatgaaaataaaatatgaaaataatgaaagaaatgaaaagatagcttttaattgtggtatatataatcttcagtaacaatacatactgaatacgctgtggttcattaatattaacaccacgtactatagtattcttaatacagtgctcactgcatttaataaatatttaataaatgatgaatgatagaagtttccatctacaatatatgttcctaaatggagcacagatgttcaaactatgctttcattttttcactgatatattaatttttgtgtaatgaatgccaacagtatattttatatgatttacttatgtgaggaaacatgcaaagcattaggaaatttatttcctaaaaacagttttgtaaaattagtattgagttctattgagtattataagatagcttacattttcaaaatggaaattgtcggtcatatttctagaactttaaagaaaaaagaatgttatattagttttctaaaactcaactatctttagtcatgttcaaaaatctattgctagatcatagtagatactggttttctattaactcaaaacctacattgacaagtttaacattgagaagaatcttaacaaaaatatggatatgaattcagtagatatcttaaattcaataaaatcactggaagtttttcatgataacttattttaagatgccttaaaaatcttaaagtcacaaaaggaaaaaggtttttaacatttacatgagttaacattttttcatagaacttatttcctagatagaattttttactgttttttactgttttcttaagaaaacagttaaatcattatgcattcagttggaagaaagtagtggcaagaattctttcattgctatataatattcagtggctcatttatacctaataaaataatggtattttaaaataatgctactttcaaagtagcatttttttagttagtttacaggttacatacccaaaaccttaactatgactaagaaattaaagaagaaaaccagcaaactaaaacttctgggcagcaaaaatatataaatgcttcagatgtcaaatacccatgcttgaaagctcgtgtaatttactttaagattatctgcctgctcttcttcaaagctgaccttgctttagaaatagttttaactagcttagttttctggtttccaaaactaaaatagattaaatcctacaaatttaaggacagttgtgacagtaatctgaccactatctataaatacattggacattggtttccaaatctccctttcttcttcagttccttccttgttcaatatatacccttctctaaactgtgcgggtaaaaggaatgactgtccttgagagaaccattagtttatcaaaggtttatgtagttttgttgctgtaccctaactttgatattcagggaggtaggaaaggtaacagaaaaccagcatatttaatcaaagcaagaagtaatcgctgacagttaaatgtgaccaaaaaaattaaaagttcacaatttttttaatgtagccatttggggttatctctagtaaggcagatacccacgttggtaaatttttaggatattgtgttgcactagaaaactaagtggttcatatttctaatgaggaagattaatgaaagaacattgttatattctgcgtggtatattttaaagtttaagaaggcatgttaaacattatttcctctatggtagttaaaatacagaattagatttttaacaggtgtcatttgactaaacgtttcggtagaatgcttcatacttgagtgatgctggataaggtattgtatttcaacaatggactatgccttggtttttcactaatcaaaatcaaaattactctttaacatgataaatgaatttaccagtttagtatgctgtggtattttaataagttttcaaagataattgggaaaacatgagactggtcatattgatgaatattgtaacatgtgaattgtgatccatttctgatatgtcttgaactactgtgtctagtgggcaaatgtcattgttacctctgtgtgttaagaaaataaaaatattttctaaaggtctgt

SEQ ID NO: 106949 - DNA, 7166 bp, Homo sapiens
  Payload ID: 1006
  Gene Symbol: AGL
  Gene Name: amylo-alpha-1, 6-glucosidase, 4-alpha-glucanotransferase
  Uniprot ID: P35573
  ENST ID: ENST00000370163
  CDS Start-End: 199-4797
ctgtctacggcagctattccagaggcaacaactgcttccctctgttctcatctccccattggtggctggcgacccgaatttgggaatggggagattgcccacctgttatctttgagcagactaatctcttgggtaactcattcgactgtggagttcttttaattcttatgaaagatttcaaatcctctagaagccaaaatgggacacagtaaacagattcgaattttacttctgaacgaaatggagaaactggaaaagaccctcttcagacttgaacaagggtatgagctacagttccgattaggcccaactttacagggaaaagcagttaccgtgtatacaaattacccatttcctggagaaacatttaatagagaaaaattccgttctctggattgggaaaatccaacagaaagagaagatgattctgataaatactgtaaacttaatctgcaacaatctggttcatttcagtattatttccttcaaggaaatgagaaaagtggtggaggttacatagttgtggaccccattttacgtgttggtgctgataatcatgtgctacccttggactgtgttactcttcagacatttttagctaagtgtttgggaccttttgatgaatgggaaagcagacttagggttgcaaaagaatcaggctacaacatgattcattttaccccattgcagactcttggactatctaggtcatgctactcccttgccaatcagttagaattaaatcctgacttttcaagacctaatagaaagtatacctggaatgatgttggacagctagtggaaaaattaaaaaaggaatggaatgttatttgtattactgatgttgtctacaatcatactgctgctaatagtaaatggatccaggaacatccagaatgtgcctataatcttgtgaattctccacacttaaaacctgcctgggtcttagacagagcactttggcgtttctcctgtgatgttgcagaagggaaatacaaagaaaagggaatacctgctttgattgaaaatgatcaccatatgaattccatccgaaaaataatttgggaggatatttttccaaagcttaaactctgggaatttttccaagtagatgtcaacaaagcggttgagcaatttagaagacttcttacacaagaaaataggcgagtaaccaagtctgatccaaaccaacaccttacgattattcaagatcctgaatacagacggtttggctgtactgtagatatgaacattgcactaacgactttcataccacatgacaaggggccagcagcaattgaagaatgctgtaattggtttcataaaagaatggaggaattaaattcagagaagcatcgactcattaactatcatcaggaacaggcagttaattgccttttgggaaatgtgttttatgaacgactggctggccatggtccaaaactaggacctgtcactagaaagcatcctttagttaccaggtattttactttcccatttgaagagatagacttctccatggaagaatctatgattcatctgccaaataaagcttgttttctgatggcacacaatggatgggtaatgggagatgatcctcttcgaaactttgctgaaccgggttcagaagtttacctaaggagagaacttatttgctggggagacagtgttaaattacgctatgggaataaaccagaggactgtccttatctctgggcacacatgaaaaaatacactgaaataactgcaacttatttccagggagtacgtcttgataactgccactcaacacctcttcacgtagctgagtacatgttggatgctgctaggaatttgcaacccaatttatatgtagtagctgaactgttcacaggaagtgaagatctggacaatgtctttgttactagactgggcattagttccttaataagagaggcaatgagtgcatataatagtcatgaagagggcagattagtttaccgatatggaggagaacctgttggatcctttgttcagccctgtttgaggcctttaatgccagctattgcacatgccctgtttatggatattacgcatgataatgagtgtcctattgtgcatagatcagcgtatgatgctcttccaagtactacaattgtttctatggcatgttgtgctagtggaagtacaagaggctatgatgaattagtgcctcatcagatttcagtggtttctgaagaacggttttacactaagtggaatcctgaagcattgccttcaaacacaggtgaagttaatttccaaagcggcattattgcagccaggtgtgctatcagtaaacttcatcaggagcttggagccaagggttttattcaggtgtatgtggatcaagttgatgaagacatagtggcagtaacaagacactcacctagcatccatcagtctgttgtggctgtatctagaactgctttcaggaatcccaagacttcattttacagcaaggaagtgcctcaaatgtgcatccctggcaaaattgaagaagtagttcttgaagctagaactattgagagaaacacgaaaccttataggaaggatgagaattcaatcaatggaacaccagatatcacagtagaaattagagaacatattcagcttaatgaaagtaaaattgttaaacaagctggagttgccacaaaagggcccaatgaatatattcaagaaatagaatttgaaaacttgtctccaggaagtgttattatattcagagttagtcttgatccacatgcacaagtcgctgttggaattcttcgaaatcatctgacacaattcagtcctcactttaaatctggcagcctagctgttgacaatgcagatcctatattaaaaattccttttgcttctcttgcctccagattaactttggctgagctaaatcagatcctttaccgatgtgaatcagaagaaaaggaagatggtggagggtgctatgacataccaaactggtcagcccttaaatatgcaggtcttcaaggtttaatgtctgtattggcagaaataagaccaaagaatgacttggggcatcctttttgtaataatttgagatctggagattggatgattgactatgtcagtaaccggcttatttcacgatcaggaactattgctgaagttggtaaatggttgcaggctatgttcttctacctgaagcagatcccacgttaccttatcccatgttactttgatgctatattaattggtgcatataccactcttctggatacagcatggaagcagatgtcaagctttgttcagaatggttcaacctttgtgaaacacctttcattgggttcagttcaactgtgtggagtaggaaaattcccttccctgccaattctttcacctgccctaatggatgtaccttataggttaaatgagatcacaaaagaaaaggagcaatgttgtgtttctctagctgcaggcttacctcatttttcttctggtattttccgctgctggggaagggatacttttattgcacttagaggtatactgctgattactggacgctatgtagaagccaggaatattattttagcatttgcgggtaccctgaggcatggtctcattcctaatctactgggtgaaggaatttatgccagatacaattgtcgggatgctgtgtggtggtggctgcagtgtatccaggattactgtaaaatggttccaaatggtctagacattctcaagtgcccagtttccagaatgtatcctacagatgattctgctcctttgcctgctggcacactggatcagccattgtttgaagtcatacaggaagcaatgcaaaaacacatgcagggcatacagttccgagaaaggaatgctggtccccagatagatcgaaacatgaaggacgaaggttttaatataactgcaggagttgatgaagaaacaggatttgtttatggaggaaatcgtttcaattgtggcacatggatggataaaatgggagaaagtgacagagctagaaacagaggaatcccagccacaccaagagatgggtctgctgtggaaattgtgggcctgagtaaatctgctgttcgctggttgctggaattatccaaaaaaaatattttcccttatcatgaagtcacagtaaaaagacatggaaaggctataaaggtctcatatgatgagtggaacagaaaaatacaagacaactttgaaaagctatttcatgtttccgaagacccttcagatttaaatgaaaagcatccaaatctggttcacaaacgtggcatatacaaagatagttatggagcttcaagtccttggtgtgactatcagctcaggcctaattttaccatagcaatggttgtggcccctgagctctttactacagaaaaagcatggaaagctttggagattgcagaaaaaaaattgcttggtccccttggcatgaaaactttagatccagatgatatggtttactgtggaatttatgacaatgcattagacaatgacaactacaatcttgctaaaggtttcaattatcaccaaggacctgagtggctgtggcctattgggtattttcttcgtgcaaaattatatttttccagattgatgggcccggagactactgcaaagactatagttttggttaaaaatgttctttcccgacattatgttcatcttgagagatccccttggaaaggacttccagaactgaccaatgagaatgcccagtactgtcctttcagctgtgaaacacaagcctggtcaattgctactattcttgagacactttatgatttatagtttattacagatattaagtatgcaattacttgtattataggatgcaaggtcatcatatgtaaatgccttatatgcacaggctcaagttgttttaaaaatctcatttattataatattgatgctcaattaggtaagattgtaaaagcattgattttttttaatgtacagaggtagatttcaatttgaatcagaaagaaatatcattaccaatgaaatgtgtttgagttcagtaagaattattcaaatgcctagaaatccatagtttggaaaagaaaaatcatgtcatcttctatttgtacagaaatgaaaataaaatatgaaaataatgaaagaaatgaaaagatagcttttaattgtggtatatataatcttcagtaacaatacatactgaatacgctgtggttcattaatattaacaccacgtactatagtattcttaatacagtgctcactgcatttaataaatatttaataaatgatgaatgatagaagtttccatctacaatatatgttcctaaatggagcacagatgttcaaactatgctttcattttttcactgatatattaatttttgtgtaatgaatgccaacagtatattttatatgatttacttatgtgaggaaacatgcaaagcattaggaaatttatttcctaaaaacagttttgtaaaattagtattgagttctattgagtattataagatagcttacattttcaaaatggaaattgtcggtcatatttctagaactttaaagaaaaaagaatgttatattagttttctaaaactcaactatctttagtcatgttcaaaaatctattgctagatcatagtagatactggttttctattaactcaaaacctacattgacaagtttaacattgagaagaatcttaacaaaaatatggatatgaattcagtagatatcttaaattcaataaaatcactggaagtttttcatgataacttattttaagatgccttaaaaatcttaaagtcacaaaaggaaaaaggtttttaacatttacatgagttaacattttttcatagaacttatttcctagatagaattttttactgttttttactgttttcttaagaaaacagttaaatcattatgcattcagttggaagaaagtagtggcaagaattctttcattgctatataatattcagtggctcatttatacctaataaaataatggtattttaaaataatgctactttcaaagtagcatttttttagttagtttacaggttacatacccaaaaccttaactatgactaagaaattaaagaagaaaaccagcaaactaaaacttctgggcagcaaaaatatataaatgcttcagatgtcaaatacccatgcttgaaagctcgtgtaatttactttaagattatctgcctgctcttcttcaaagctgaccttgctttagaaatagttttaactagcttagttttctggtttccaaaactaaaatagattaaatcctacaaatttaaggacagttgtgacagtaatctgaccactatctataaatacattggacattggtttccaaatctccctttcttcttcagttccttccttgttcaatatatacccttctctaaactgtgcgggtaaaaggaatgactgtccttgagagaaccattagtttatcaaaggtttatgtagttttgttgctgtaccctaactttgatattcagggaggtaggaaaggtaacagaaaaccagcatatttaatcaaagcaagaagtaatcgctgacagttaaatgtgaccaaaaaaattaaaagttcacaatttttttaatgtagccatttggggttatctctagtaaggcagatacccacgttggtaaatttttaggatattgtgttgcactagaaaactaagtggttcatatttctaatgaggaagattaatgaaagaacattgttatattctgcgtggtatattttaaagtttaagaaggcatgttaaacattatttcctctatggtagttaaaatacagaattagatttttaacaggtgtcatttgactaaacgtttcggtagaatgcttcatacttgagtgatgctggataaggtattgtatttcaacaatggactatgccttggtttttcactaatcaaaatcaaaattactctttaacatgataaatgaatttaccagtttagtatgctgtggtattttaataagttttcaaagataattgggaaaacatgagactggtcatattgatgaatattgtaacatgtgaattgtgatccatttctgatatgtcttgaactactgtgtctagtgggcaaatgtcattgttacctctgtgtgttaagaaaataaaaatattttctaaaggtc

SEQ ID NO: 106950 - DNA, 7106 bp, Homo sapiens
  Payload ID: 1006
  Gene Symbol: AGL
  Gene Name: amylo-alpha-1, 6-glucosidase, 4-alpha-glucanotransferase
  Uniprot ID: P35573
  ENST ID: ENST00000370165
  CDS Start-End: 139-4737
ctgtctacggcagctattccagaggcaacaactgcttccctctgttctcatctccccattggtggctggcgacccgaatttgggaatggggagattgcccacctgttatctttgagcagactaatctcttaagccaaaatgggacacagtaaacagattcgaattttacttctgaacgaaatggagaaactggaaaagaccctcttcagacttgaacaagggtatgagctacagttccgattaggcccaactttacagggaaaagcagttaccgtgtatacaaattacccatttcctggagaaacatttaatagagaaaaattccgttctctggattgggaaaatccaacagaaagagaagatgattctgataaatactgtaaacttaatctgcaacaatctggttcatttcagtattatttccttcaaggaaatgagaaaagtggtggaggttacatagttgtggaccccattttacgtgttggtgctgataatcatgtgctacccttggactgtgttactcttcagacatttttagctaagtgtttgggaccttttgatgaatgggaaagcagacttagggttgcaaaagaatcaggctacaacatgattcattttaccccattgcagactcttggactatctaggtcatgctactcccttgccaatcagttagaattaaatcctgacttttcaagacctaatagaaagtatacctggaatgatgttggacagctagtggaaaaattaaaaaaggaatggaatgttatttgtattactgatgttgtctacaatcatactgctgctaatagtaaatggatccaggaacatccagaatgtgcctataatcttgtgaattctccacacttaaaacctgcctgggtcttagacagagcactttggcgtttctcctgtgatgttgcagaagggaaatacaaagaaaagggaatacctgctttgattgaaaatgatcaccatatgaattccatccgaaaaataatttgggaggatatttttccaaagcttaaactctgggaatttttccaagtagatgtcaacaaagcggttgagcaatttagaagacttcttacacaagaaaataggcgagtaaccaagtctgatccaaaccaacaccttacgattattcaagatcctgaatacagacggtttggctgtactgtagatatgaacattgcactaacgactttcataccacatgacaaggggccagcagcaattgaagaatgctgtaattggtttcataaaagaatggaggaattaaattcagagaagcatcgactcattaactatcatcaggaacaggcagttaattgccttttgggaaatgtgttttatgaacgactggctggccatggtccaaaactaggacctgtcactagaaagcatcctttagttaccaggtattttactttcccatttgaagagatagacttctccatggaagaatctatgattcatctgccaaataaagcttgttttctgatggcacacaatggatgggtaatgggagatgatcctcttcgaaactttgctgaaccgggttcagaagtttacctaaggagagaacttatttgctggggagacagtgttaaattacgctatgggaataaaccagaggactgtccttatctctgggcacacatgaaaaaatacactgaaataactgcaacttatttccagggagtacgtcttgataactgccactcaacacctcttcacgtagctgagtacatgttggatgctgctaggaatttgcaacccaatttatatgtagtagctgaactgttcacaggaagtgaagatctggacaatgtctttgttactagactgggcattagttccttaataagagaggcaatgagtgcatataatagtcatgaagagggcagattagtttaccgatatggaggagaacctgttggatcctttgttcagccctgtttgaggcctttaatgccagctattgcacatgccctgtttatggatattacgcatgataatgagtgtcctattgtgcatagatcagcgtatgatgctcttccaagtactacaattgtttctatggcatgttgtgctagtggaagtacaagaggctatgatgaattagtgcctcatcagatttcagtggtttctgaagaacggttttacactaagtggaatcctgaagcattgccttcaaacacaggtgaagttaatttccaaagcggcattattgcagccaggtgtgctatcagtaaacttcatcaggagcttggagccaagggttttattcaggtgtatgtggatcaagttgatgaagacatagtggcagtaacaagacactcacctagcatccatcagtctgttgtggctgtatctagaactgctttcaggaatcccaagacttcattttacagcaaggaagtgcctcaaatgtgcatccctggcaaaattgaagaagtagttcttgaagctagaactattgagagaaacacgaaaccttataggaaggatgagaattcaatcaatggaacaccagatatcacagtagaaattagagaacatattcagcttaatgaaagtaaaattgttaaacaagctggagttgccacaaaagggcccaatgaatatattcaagaaatagaatttgaaaacttgtctccaggaagtgttattatattcagagttagtcttgatccacatgcacaagtcgctgttggaattcttcgaaatcatctgacacaattcagtcctcactttaaatctggcagcctagctgttgacaatgcagatcctatattaaaaattccttttgcttctcttgcctccagattaactttggctgagctaaatcagatcctttaccgatgtgaatcagaagaaaaggaagatggtggagggtgctatgacataccaaactggtcagcccttaaatatgcaggtcttcaaggtttaatgtctgtattggcagaaataagaccaaagaatgacttggggcatcctttttgtaataatttgagatctggagattggatgattgactatgtcagtaaccggcttatttcacgatcaggaactattgctgaagttggtaaatggttgcaggctatgttcttctacctgaagcagatcccacgttaccttatcccatgttactttgatgctatattaattggtgcatataccactcttctggatacagcatggaagcagatgtcaagctttgttcagaatggttcaacctttgtgaaacacctttcattgggttcagttcaactgtgtggagtaggaaaattcccttccctgccaattctttcacctgccctaatggatgtaccttataggttaaatgagatcacaaaagaaaaggagcaatgttgtgtttctctagctgcaggcttacctcatttttcttctggtattttccgctgctggggaagggatacttttattgcacttagaggtatactgctgattactggacgctatgtagaagccaggaatattattttagcatttgcgggtaccctgaggcatggtctcattcctaatctactgggtgaaggaatttatgccagatacaattgtcgggatgctgtgtggtggtggctgcagtgtatccaggattactgtaaaatggttccaaatggtctagacattctcaagtgcccagtttccagaatgtatcctacagatgattctgctcctttgcctgctggcacactggatcagccattgtttgaagtcatacaggaagcaatgcaaaaacacatgcagggcatacagttccgagaaaggaatgctggtccccagatagatcgaaacatgaaggacgaaggttttaatataactgcaggagttgatgaagaaacaggatttgtttatggaggaaatcgtttcaattgtggcacatggatggataaaatgggagaaagtgacagagctagaaacagaggaatcccagccacaccaagagatgggtctgctgtggaaattgtgggcctgagtaaatctgctgttcgctggttgctggaattatccaaaaaaaatattttcccttatcatgaagtcacagtaaaaagacatggaaaggctataaaggtctcatatgatgagtggaacagaaaaatacaagacaactttgaaaagctatttcatgtttccgaagacccttcagatttaaatgaaaagcatccaaatctggttcacaaacgtggcatatacaaagatagttatggagcttcaagtccttggtgtgactatcagctcaggcctaattttaccatagcaatggttgtggcccctgagctctttactacagaaaaagcatggaaagctttggagattgcagaaaaaaaattgcttggtccccttggcatgaaaactttagatccagatgatatggtttactgtggaatttatgacaatgcattagacaatgacaactacaatcttgctaaaggtttcaattatcaccaaggacctgagtggctgtggcctattgggtattttcttcgtgcaaaattatatttttccagattgatgggcccggagactactgcaaagactatagttttggttaaaaatgttctttcccgacattatgttcatcttgagagatccccttggaaaggacttccagaactgaccaatgagaatgcccagtactgtcctttcagctgtgaaacacaagcctggtcaattgctactattcttgagacactttatgatttatagtttattacagatattaagtatgcaattacttgtattataggatgcaaggtcatcatatgtaaatgccttatatgcacaggctcaagttgttttaaaaatctcatttattataatattgatgctcaattaggtaagattgtaaaagcattgattttttttaatgtacagaggtagatttcaatttgaatcagaaagaaatatcattaccaatgaaatgtgtttgagttcagtaagaattattcaaatgcctagaaatccatagtttggaaaagaaaaatcatgtcatcttctatttgtacagaaatgaaaataaaatatgaaaataatgaaagaaatgaaaagatagcttttaattgtggtatatataatcttcagtaacaatacatactgaatacgctgtggttcattaatattaacaccacgtactatagtattcttaatacagtgctcactgcatttaataaatatttaataaatgatgaatgatagaagtttccatctacaatatatgttcctaaatggagcacagatgttcaaactatgctttcattttttcactgatatattaatttttgtgtaatgaatgccaacagtatattttatatgatttacttatgtgaggaaacatgcaaagcattaggaaatttatttcctaaaaacagttttgtaaaattagtattgagttctattgagtattataagatagcttacattttcaaaatggaaattgtcggtcatatttctagaactttaaagaaaaaagaatgttatattagttttctaaaactcaactatctttagtcatgttcaaaaatctattgctagatcatagtagatactggttttctattaactcaaaacctacattgacaagtttaacattgagaagaatcttaacaaaaatatggatatgaattcagtagatatcttaaattcaataaaatcactggaagtttttcatgataacttattttaagatgccttaaaaatcttaaagtcacaaaaggaaaaaggtttttaacatttacatgagttaacattttttcatagaacttatttcctagatagaattttttactgttttttactgttttcttaagaaaacagttaaatcattatgcattcagttggaagaaagtagtggcaagaattctttcattgctatataatattcagtggctcatttatacctaataaaataatggtattttaaaataatgctactttcaaagtagcatttttttagttagtttacaggttacatacccaaaaccttaactatgactaagaaattaaagaagaaaaccagcaaactaaaacttctgggcagcaaaaatatataaatgcttcagatgtcaaatacccatgcttgaaagctcgtgtaatttactttaagattatctgcctgctcttcttcaaagctgaccttgctttagaaatagttttaactagcttagttttctggtttccaaaactaaaatagattaaatcctacaaatttaaggacagttgtgacagtaatctgaccactatctataaatacattggacattggtttccaaatctccctttcttcttcagttccttccttgttcaatatatacccttctctaaactgtgcgggtaaaaggaatgactgtccttgagagaaccattagtttatcaaaggtttatgtagttttgttgctgtaccctaactttgatattcagggaggtaggaaaggtaacagaaaaccagcatatttaatcaaagcaagaagtaatcgctgacagttaaatgtgaccaaaaaaattaaaagttcacaatttttttaatgtagccatttggggttatctctagtaaggcagatacccacgttggtaaatttttaggatattgtgttgcactagaaaactaagtggttcatatttctaatgaggaagattaatgaaagaacattgttatattctgcgtggtatattttaaagtttaagaaggcatgttaaacattatttcctctatggtagttaaaatacagaattagatttttaacaggtgtcatttgactaaacgtttcggtagaatgcttcatacttgagtgatgctggataaggtattgtatttcaacaatggactatgccttggtttttcactaatcaaaatcaaaattactctttaacatgataaatgaatttaccagtttagtatgctgtggtattttaataagttttcaaagataattgggaaaacatgagactggtcatattgatgaatattgtaacatgtgaattgtgatccatttctgatatgtcttgaactactgtgtctagtgggcaaatgtcattgttacctctgtgtgttaagaaaataaaaatattttctaaaggtc

SEQ ID NO: 106951 - DNA, 3467 bp, Homo sapiens
  Payload ID: 1007
  Gene Symbol: APP
  Gene Name: amyloid beta (A4) precursor protein
  Uniprot ID: P05067
  ENST ID: ENST00000346798
  CDS Start-End: 35-2347
cagcagcgcactcggtgccccgcgcagggtcgcgatgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccatgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagca

SEQ ID NO: 106952 - DNA, 3355 bp, Homo sapiens
  Payload ID: 1007
  Gene Symbol: APP
  Gene Name: amyloid beta (A4) precursor protein
  Uniprot ID: P05067
  ENST ID: ENST00000348990
  CDS Start-End: 148-2235
agtttcctcggcagcggtaggcgagagcacgcggaggagcgtgcgcgggggccccgggagacggcggcggtggcggcgcgggcagagcaaggacgcggcggatcccactcgcacagcagcgcactcggtgccccgcgcagggtcgcgatgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagca

SEQ ID NO: 106953 - DNA, 3167 bp, Homo sapiens
  Payload ID: 1007
  Gene Symbol: APP
  Gene Name: amyloid beta (A4) precursor protein
  Uniprot ID: P05067
  ENST ID: ENST00000354192
  CDS Start-End: 128-2047
gcgagagcacgcggaggagcgtgcgcgggggccccgggagacggcggcggtggcggcgcgggcagagcaaggacgcggcggatcccactcgcacagcagcgcactcggtgccccgcgcagggtcgcgatgctgcccggtttggcactgctcctgctggccgcctggacggctcgggcgctggaggtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagca

SEQ ID NO: 106954 - DNA, 3543 bp, Homo sapiens
  Payload ID: 1007
  Gene Symbol: APP
  Gene Name: amyloid beta (A4) precursor protein
  Uniprot ID: P05067
  ENST ID: ENST00000357903
  CDS Start-End: 168-2423
cgccgcgctcgggctccgtcagtttcctcggcagcggtaggcgagagcacgcggaggagcgtgcgcgggggccccgggagacggcggcggtggcggcgcgggcagagcaaggacgcggcggatcccactcgcacagcagcgcactcggtgccccgcgcagggtcgcgatgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagca

SEQ ID NO: 106955 - DNA, 2366 bp, Homo sapiens
  Payload ID: 1007
  Gene Symbol: APP
  Gene Name: amyloid beta (A4) precursor protein
  Uniprot ID: P05067
  ENST ID: ENST00000358918
  CDS Start-End: 48-2306
gatcccactcgcacagcagcgcactcggtgccccgcgcagggtcgcgatgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccatgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcgg

SEQ ID NO: 106956 - DNA, 3294 bp, Homo sapiens
  Payload ID: 1007
  Gene Symbol: APP
  Gene Name: amyloid beta (A4) precursor protein
  ENST ID: ENST00000359726
  CDS Start-End: 193-2175
gtcggatgattcaagctcacggggacgagcaggagcgctctcgacttttctagagcctcagcgtcctaggactcacctttccctgatcctgcaccgtccctctcctggccccagactctccctcccactgttcacgaagcccaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagc

SEQ ID NO: 106957 - DNA, 2846 bp, Homo sapiens
  Payload ID: 1007
  Gene Symbol: APP
  Gene Name: amyloid beta (A4) precursor protein
  Uniprot ID: P05067
  ENST ID: ENST00000440126
  CDS Start-End: 267-2507
agagttccggaggctttggttgtccattgttagcttagaagttggcgcagtgtgcgtgtgatccacgcctaaatagcacagccttgctgtgcgtggtagaagttgggttagtgttgacatgctgttgactcaccctcccgaggatggaagctctggcctgggtcaagttgtggtcactgcagttaacagtttgttgatctcagggagtattccacagttgctgatgtaattgacaatgattggagccagctcttccccagattcaaatggaccaattagaggacttgttggttctgtttatcaactatgtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattctt

SEQ ID NO: 106958 - DNA, 1846 bp, Homo sapiens
  Payload ID: 1007
  Gene Symbol: APP
  Gene Name: amyloid beta (A4) precursor protein
  ENST ID: ENST00000448850
  CDS Start-End: 1-1456
actgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttggtgcagtggctcatgcctgtaattccagcattttgggaggccaaggtgggcagatgacttgagcccagaagttcaagaccagaatgggaaacatggcaagaccacatttctacaaaaaaattatccaggcatgataacatctatttgtagtcccagctactcaggaggctgtggtgggaggatctcctgagcctggggtggctgaggctgcagtgagccttgatcacgccacctgggcaatagagcaagaccctgtctcaaaaaaaggaagaaaaagactattatttcccccattgaatggtcttggcactattacacaaaatcaattgtccatagataatatgggtttatttcttaattcttagttcttttctttgatctgtgtgcctgtgcttactgtagtaccacactgttttgattattgtagctttgtagtaaattttgaaatcagc

SEQ ID NO: 106959 - DNA, 2517 bp, Homo sapiens
  Payload ID: 1007
  Gene Symbol: APP
  Gene Name: amyloid beta (A4) precursor protein
  ENST ID: ENST00000439274
  CDS Start-End: 35-2179
cagcagcgcactcggtgccccgcgcagggtcgcgatgctgcccggtttggcactgctcctgctggccgcctggacggctcgggcgctggaggtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccatgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattct

SEQ ID NO: 106960 - DNA, 541 bp, Homo sapiens
  Payload ID: 1007
  Gene Symbol: APP
  Gene Name: amyloid beta (A4) precursor protein
  ENST ID: ENST00000415997
  CDS Start-End: 1-541
gggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagtgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagca

SEQ ID NO: 106961 - DNA, 6534 bp, Homo sapiens
  Payload ID: 1008
  Gene Symbol: APBA1
  Gene Name: amyloid beta (A4) precursor protein-binding, family A, member 1
  Uniprot ID: Q02410
  ENST ID: ENST00000265381
  CDS Start-End: 224-2737
ggcggcggcggcggcggcggcagctgcggcgggagaagatggtggcgctggaggcagcagcggctggagcggagctttattcccaggcttggcaccagcgctgtcactagcgccgcctgctcccgcgggcccgcggacccagctgtcaggcaagcccagtggagcaaaatgagagcgcagtgagccgggcccagcttctctcctagccgttccgactcccaccatgaaccacttggaggggtctgcggaggtggaggtgaccgacgaggcggcaggtggggaggtgaacgagtcggtggaggccgacctggagcaccccgaggtggaagaggaacagcagcagccgccgcagcagcagcactatgtgggccgccaccagcgcgggcgagccctcgaggacctccgcgcccagctcggccaggaggaagaggagcgcggggaatgcctggcgcgctcagccagcacggagagcggcttccacaaccacacggacaccgccgagggcgacgtgatcgccgcggcccgcgacggctacgatgcggagcgcgcgcaggaccccgaggacgagagcgcctatgctgtgcagtaccggcccgaggccgaggagtacacggagcaggcagaggccgagcacgccgaggccacgcaccgccgcgcgctgcccaaccacctgcacttccactcgctggagcacgaggaagccatgaatgcggcctactcaggctacgtctacacgcaccggctcttccaccgcggtgaggacgagccctactccgagccctatgccgactacggcggcctccaggagcacgtgtacgaggagataggggacgcgcccgagctggacgcacgcgacggcctgcggctctacgagcaggagcgcgacgaggcggccgcgtaccgccaggaggccctgggcgcgcggctgcaccattacgacgagcgctccgacggcgagtccgacagccccgagaaggaggccgagttcgcgccctacccgcgcatggacagctacgagcaggaggaggacatcgaccagatagtggccgaggtgaagcagagcatgagctcgcagagcctcgacaaggcagccgaggacatgcctgaggccgagcaggacctggagcgtccccctaccccggccgggggtcgccccgacagccccgggctgcaggcgccggcggggcagcagcgggcggtgggccccgcgggcggcggcgaggcggggcagcggtacagcaaggagaagcgcgatgccatctcgctggccatcaaggacatcaaggaggccatcgaggaggtgaaaaccaggaccatccgttcgccttacacccccgacgagcccaaagagcccatctgggtcatgcgccaggacattagccccaccagggactgtgacgaccagaggccgatggacggagattctccgtctcctggcagctcctcccccttgggtgcagagtcatcaagcacatctcttcaccccagtgaccctgtggaagcgtccactaataaagagtcaagaaaaagcttggcttcattcccaacctacgttgaagttccgggaccctgcgaccccgaagacttgatcgatggaatcatttttgccgccaattaccttggctccactcagctgctctcagacaaaactccttccaaaaacgtgcgcatgatgcaggcccaggaagccgtaagcaggatcaagatggcccagaaattagccaaaagcaggaagaaggctcctgaaggcgaatctcagccaatgactgaagtggatctcttcatttctacccagagaatcaaagtgctgaacgccgacacacaggagacaatgatggaccaccctctgaggaccatttcctacattgcggacattgggaacatcgttgtgctgatggcccgccggcggatgcctcgctccaactcccaggagaacgtggaagcgtcccacccatcccaggatgggaaaaggcagtacaagatgatctgccacgtcttcgagtctgaggatgctcagctgattgcacagtccatcggacaggcatttagcgtggcataccaggaattcctcagggccaatgggattaaccccgaagatctcagccagaaggagtatagtgacctgctcaatacccaggacatgtacaacgatgacctgatccacttctccaagtcggaaaactgtaaagatgttttcatagagaagcagaaaggagaaatcctaggtgtggtgattgtggagtctggctggggatccatcctccccaccgtgatcattgccaacatgatgcatggtggccctgcggagaaatctgggaagctgaatatcggtgaccagatcatgtccattaatggcaccagcctggtgggcctgcctctgtccacctgccagagcattattaagggcttaaagaatcagtcccgagtcaagctgaatatcgtgagatgtcctccggtgaccaccgtgttaatcagaagaccagaccttcgctaccagctcggtttcagcgtccagaatggaattatctgcagcctcatgcgagggggaatagctgagagaggaggcgtccgtgtggggcaccggatcattgaaatcaatggacagagcgtcgtggccaccccccacgagaagatcgtccacattctctccaatgctgttggggagattcatatgaagacaatgccagccgcgatgtacaggctgctgacggcccaggagcagcctgtttacatctgaccgcggccacacgcggtggcatgcatggaggactctcctcttcgtggttgtgtttctcgtgctgcatccctgtgtccactgagactttcccctctcgcgcccagcatttggttttacacaggaagagaagaatccacaaggacctctttactctctccgatttgcttttttttttttttttttttcaataccagggaagtttcgtatgcactcccttgaggatggagagcagccagcacccacctggtactgacccaggaccatcctggagggctttctgggtgtgtccagggggtgggctgtcactgcttgagggagaatcctcccttcccaggaggtgcagacttcttaaaaggagctcgcggggcagcaaagcagctgattcagcagtgcctaaaacccagttgctgatccctgctctctgagtttatctgtgggaatgtggtagtacccagggccagcccacgtcattaaggttatgcactgcctgccatgtagttggggcaccatacattatttcttcccagaatctctgagccaaccttaaacctcttctattgctagttctaatttcaacgtatgtgtgttttctaatacgagccttctcaccccaggataaaaggggaaataactgccttgggcaaggacaccatagtgtcacagagagcttggcaattcatggggcatctgaagctttaccaggttgtcctcaagttatcaaccattagataaacacaggcaggtactgtctgcttctctctctctcacacacacacacacacacacagtcccatttgcatatcacccttccctgctcccaccaccagtgagacaagctgaagattaggcacacagatcccctggaaacccacctctctggaaggccccttccctggcaggtggccaggcaggcgggggctgctcagcctcatcctgagagacctgccctctctgcgctgaggcccagcccctccagcaccactttggcttaaagcatcctcctcctggactcccctccctgccgaacacacatcccaggagtctgggaaggagggactgttcccaagaaggcaagctgcaggtgcaattgcgtcttgttttctggcccaaggcaagaccaactttcttctctgctcagggccactaggcggatgtgatattggaaaggccagaatagtacataaaccacaaaattaaggagacaatagcaacctcaagttatgcctcagaatccccagatgtggtccataaacaccctcttgctgccttgtgggcctgagagcatttttggctggtgtggaattgttccgtgttttcatcaggtgcctcatatttatgcttccgtctcagttcagtgtagatgttttagtaatattataattctgagccagttttcacttggtccaaagagcattttgtgttcatgtgaggtgtgatttggctttgcttttgttttgtttcattcatgacctcagtagagacaggggaagagaaactattatattttgtaattaatatagtccctgttctctgcatccgagatatttatgttgtgtctatggaaataggaactcagtgagcaaatggtgggtagcatgtatttatagagagaatggagggattctaaggagggagcaaagtgactataacaagattagggacaagagacttcaaccagagagttctgtgatcaattccccgagatctctgcatcttctgagttttctgcttagaatcagggaagctcagtgcttgacaggaacgagcagtggcactctcagtttcactgtgttacaaaggagccctgaggaagggaggccgctggctgcccaggtgccctggggggaaagggacttctgctgctgcagagagtggcacccggtggggccaggggctctgggatggtccgtaaagctccccaggacttctttgaaggatgctttacagaatgtttctgggagaccagcctcaaggtcaacccatcacaaacgtgaggaccaggaaggaaccatggccagggttctccatttgctgtagagtatctggtgatacagtgagacactaaagagtcatcagccagttcatctttcctctgccaataagagtggatagaacaggaatgaagtgttactggtggtatttcaggcatcaggagccttggaaaatcatcgtaggggcccatgcctgtctgtccctaggcacctgggcagtgccacagaggcccgcccacgactggccaggggacagaactccagtagtgcatccctgtacaacctgcacataacggttatgtatgttcacctaaaggagagaatatactttctattcctattgcacaaaaaccttgtaaactttgagaggtgctgaaaaagccaattctgcaagctctcctagaggactgacattgtaacattagagtgagaagatttctctgccacattcttttgtgttaatccaggtgtgtcttcacacccagtgagtggaagttgctggagctcggtacaggtccacccagctgaagtgggttctttttcccactaccactggggcaagggagtgagcctaggtatggtcacctcagcagccacagtcttaaaagcaagtcgctagattttttgaaagtcccaagagaagtggtggtcttcccttctgtcatcccagtatatatagttatacatgtaaatatctaaataccccatgtaatgggaaggctatgtacagggcagccttcccaaacgctgtgagggcacagagctgctgtggctgctccaccagggtgtgctggtggctcagctttggggttggactcccacgttcacctccccctcctggtccaggcagaggcaccagaacccatcctgccttttctccagtgtgagcatttcagggagccaccatcagccttgggttcatgagaggaagaaacccccaaagaccaatgcctggagcccacttctccagcgacaccttccctcgccagagcaggctcctaggagtgcatggcaggggtgccgggtccctgtgcacgggtttgctttctgaacattgcccatcaacaccgccttcagggagtcccagagtaacctactacctcccccatcgctcctctgcccccctcaccctgtgggcaccaacacctcccgcacacagatgaaaaccatctacagagcccttcccgggtccctcgacccagtggtgtagccgttaccaatgtttacaaccaggggccgcccctccttagatgtgtttactcgcattcacaggccacctgttggtttgagtttcatgtgtctccttccctggcctaggttgacttgagcacacaactcgatctttcttcccctccatcaaggcagtgtgtgaggactgtgtgggaatgacatttcttgtacatacttagcacagcacctagagtatgaacttgtactattgttctgtaaagagggtgaaatagagcttattgtaaagtgtcgggagaagtatagtattgtatttgtaacaatatcgttctttgtatacacaaaactcaatgatctatatataaatataaataaatatataaataaaatatatctacacgtgagcctggaatgtggacaccgcacacccactgaatgtacttccttgacagtctggtcactggtccctccctccctccctcctccgtcccgtggccacagtcatccagtttggggttgtgatgtatttactgtgctatctatcttcctttatttaactgaacgctaatgtctgtataagagttgctgcaacaataaacaagaacttcacctcttggc

SEQ ID NO: 106962 - DNA, 5110 bp, Homo sapiens
  Payload ID: 1008
  Gene Symbol: APBA1
  Gene Name: amyloid beta (A4) precursor protein-binding, family A, member 1
  ENST ID: ENST00000617471
  CDS Start-End: 1-1314
tctccgtctcctggcagctcctcccccttgggtgcagagtcatcaagcacatctcttcaccccagtgaccctgtggaagcgtccactaataaagagtcaagaaaaagcttggcttcattcccaacctacgttgaagttccgggaccctgcgaccccgaagacttgatcgatggaatcatttttgccgccaattaccttggctccactcagctgctctcagacaaaactccttccaaaaacgtgcgcatgatgcaggcccaggaagccgtaagcaggatcaagatggcccagaaattagccaaaagcaggaagaaggctcctgaaggcgaatctcagccaatgactgaagtggatctcttcatttctacccagagaatcaaagtgctgaacgccgacacacaggagacaatgatggaccaccctctgaggaccatttcctacattgcggacattgggaacatcgttgtgctgatggcccgccggcggatgcctcgctccaactcccaggagaacgtggaagcgtcccacccatcccaggatgggaaaaggcagtacaagatgatctgccacgtcttcgagtctgaggatgctcagctgattgcacagtccatcggacaggcatttagcgtggcataccaggaattcctcagggccaatgggattaaccccgaagatctcagccagaaggagtatagtgacctgctcaatacccaggacatgtacaacgatgacctgatccacttctccaagtcggaaaactgtaaagatgttttcatagagaagcagaaaggagaaatcctaggtgtggtgattgtggagtctggctggggatccatcctccccaccgtgatcattgccaacatgatgcatggtggccctgcggagaaatctgggaagctgaatatcggtgaccagatcatgtccattaatggcaccagcctggtgggcctgcctctgtccacctgccagagcattattaagggcttaaagaatcagtcccgagtcaagctgaatatcgtgagatgtcctccggtgaccaccgtgttaatcagaagaccagaccttcgctaccagctcggtttcagcgtccagaatggaattatctgcagcctcatgcgagggggaatagctgagagaggaggcgtccgtgtggggcaccggatcattgaaatcaatggacagagcgtcgtggccaccccccacgagaagatcgtccacattctctccaatgctgttggggagattcatatgaagacaatgccagccgcgatgtacaggctgctgacggcccaggagcagcctgtttacatctgaccgcggccacacgcggtggcatgcatggaggactctcctcttcgtggttgtgtttctcgtgctgcatccctgtgtccactgagactttcccctctcgcgcccagcatttggttttacacaggaagagaagaatccacaaggacctctttactctctccgatttgcttttttttttttttttttttcaataccagggaagtttcgtatgcactcccttgaggatggagagcagccagcacccacctggtactgacccaggaccatcctggagggctttctgggtgtgtccagggggtgggctgtcactgcttgagggagaatcctcccttcccaggaggtgcagacttcttaaaaggagctcgcggggcagcaaagcagctgattcagcagtgcctaaaacccagttgctgatccctgctctctgagtttatctgtgggaatgtggtagtacccagggccagcccacgtcattaaggttatgcactgcctgccatgtagttggggcaccatacattatttcttcccagaatctctgagccaaccttaaacctcttctattgctagttctaatttcaacgtatgtgtgttttctaatacgagccttctcaccccaggataaaaggggaaataactgccttgggcaaggacaccatagtgtcacagagagcttggcaattcatggggcatctgaagctttaccaggttgtcctcaagttatcaaccattagataaacacaggcaggtactgtctgcttctctctctctcacacacacacacacacacacagtcccatttgcatatcacccttccctgctcccaccaccagtgagacaagctgaagattaggcacacagatcccctggaaacccacctctctggaaggccccttccctggcaggtggccaggcaggcgggggctgctcagcctcatcctgagagacctgccctctctgcgctgaggcccagcccctccagcaccactttggcttaaagcatcctcctcctggactcccctccctgccgaacacacatcccaggagtctgggaaggagggactgttcccaagaaggcaagctgcaggtgcaattgcgtcttgttttctggcccaaggcaagaccaactttcttctctgctcagggccactaggcggatgtgatattggaaaggccagaatagtacataaaccacaaaattaaggagacaatagcaacctcaagttatgcctcagaatccccagatgtggtccataaacaccctcttgctgccttgtgggcctgagagcatttttggctggtgtggaattgttccgtgttttcatcaggtgcctcatatttatgcttccgtctcagttcagtgtagatgttttagtaatattataattctgagccagtttttcacttggtccaaagagcattttgtgttcatgtgaggtgtgatttggctttgcttttgttttgtttcattcatgacctcagtagagacaggggaagagaaactattatattttgtaattaatatagtccctgttctctgcatccgagatatttatgttgtgtctatggaaataggaactcagtgagcaaatggtgggtagcatgtatttatagagagaatggagggattctaaggagggagcaaagtgactataacaagattagggacaagagacttcaaccagagagttctgtgatcaattccccgagatctctgcatcttctgagttttctgcttagaatcagggaagctcagtgcttgacaggaacgagcagtggcactctcagtttcactgtgttacaaaggagccctgaggaagggaggccgctggctgcccaggtgccctggggggaaagggacttctgctgctgcagagagtggcacccggtggggccaggggctctgggatggtccgtaaagctccccaggacttctttgaaggatgctttacagaatgtttctgggagaccagcctcaaggtcaacccatcacaaacgtgaggaccaggaaggaaccatggccagggttctccatttgctgtagagtatctggtgatacagtgagacactaaagagtcatcagccagttcatctttcctctgccaataagagtggatagaacaggaatgaagtgttactggtggtatttcaggcatcaggagccttggaaaatcatcgtaggggcccatgcctgtctgtccctaggcacctgggcagtgccacagaggcccgcccacgactggccaggggacagaactccagtagtgcatccctgtacaacctgcacataacggttatgtatgttcacctaaaggagagaatatactttctattcctattgcacaaaaaccttgtaaactttgagaggtgctgaaaaagccaattctgcaagctctcctagaggactgacattgtaacattagagtgagaagatttctctgccacattcttttgtgttaatccaggtgtgtcttcacacccagtgagtggaagttgctggagctcggtacaggtccacccagctgaagtgggttctttttcccactaccactggggcaagggagtgagcctaggtatggtcacctcagcagccacagtcttaaaagcaagtcgctagattttttgaaagtcccaagagaagtggtggtcttcccttctgtcatcccagtatatatagttatacatgtaaatatctaaataccccatgtaatgggaaggctatgtacagggcagccttcccaaacgctgtgagggcacagagctgctgtggctgctccaccagggtgtgctggtggctcagctttggggttggactcccacgttcacctccccctcctggtccaggcagaggcaccagaacccatcctgccttttctccagtgtgagcatttcagggagccaccatcagccttgggttcatgagaggaagaaacccccaaagaccaatgcctggagcccacttctccagcgacaccttccctcgccagagcaggctcctaggagtgcatggcaggggtgccgggtccctgtgcacgggtttgctttctgaacattgcccatcaacaccgccttcagggagtcccagagtaacctactacctcccccatcgctcctctgcccccctcaccctgtgggcaccaacacctcccgcacacagatgaaaaccatctacagagcccttcccgggtccctcgacccagtggtgtagccgttaccaatgtttacaaccaggggccgcccctccttagatgtgtttactcgcattcacaggccacctgttggtttgagtttcatgtgtctccttccctggcctaggttgacttgagcacacaactcgatctttcttcccctccatcaaggcagtgtgtgaggactgtgtgggaatgacatttcttgtacatacttagcacagcacctagagtatgaacttgtactattgttctgtaaagagggtgaaatagagcttattgtaaagtgtcgggagaagtatagtattgtatttgtaacaatatcgttctttgtatacacaaaactcaatgatctatatataaatataaataaatatataaataaaatatatctacacgtgagcctggaatgtggacaccgcacacccactgaatgtacttccttgacagtctggtcactggtccctccctccctccctcctccgtcccgtggccacagtcatccagtttggggttgtgatgtatttactgtgctatctatcttcctttatttaactgaacgctaatgtctgtataagagttgctgcaacaataaacaagaacttcacctcttg

SEQ ID NO: 106963 - DNA, 367 bp, Homo sapiens
  Payload ID: 1008
  Gene Symbol: APBA1
  Gene Name: amyloid beta (A4) precursor protein-binding, family A, member 1
  ENST ID: ENST00000470082
  CDS Start-End: 1-367
gaagacttgatcgatggaatcatttttgccgccaattaccttggctccactcagctgctctcagacaaaactccttccaaaaacgtgcgcatgatgcaggcccaggaagccgtaagcaggatcaaggctcctgaaggcgaatctcagccaatgactgaagtggatctcttcatttctacccagagaatcaaagtgctgaacgccgacacacaggagacaatgatggaccaccctctgaggaccatttcctacattgcggacattgggaacatcgttgtgctgatggcccgccggcggatgcctcgctccaactcccaggagaacgtggaagcgtcccacccatcccaggatgggaaaaggcagtaca

SEQ ID NO: 106964 - DNA, 367 bp, Homo sapiens; identical to SEQ ID NO: 106963
  Payload ID: 1008
  Gene Symbol: APBA1
  Gene Name: amyloid beta (A4) precursor protein-binding, family A, member 1
  ENST ID: ENST00000620509
  CDS Start-End: 1-367

SEQ ID NO: 106965 - DNA, 3599 bp, Homo sapiens
  Payload ID: 1009
  Gene Symbol: APBA2
  Gene Name: amyloid beta (A4) precursor protein-binding, family A, member 2
  Uniprot ID: Q99767
  ENST ID: ENST00000411764
  CDS Start-End: 208-2421
cagtctcctgaatatttacgcgttgctgaatctcctgtggacaaaccaccaataggccaggactgtcctgtggacagacggggtgagcctcttcttgtgtctggagattctgaaaagatttgatcaccaggagatttttcgggacattaccaaaccactcattttagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggcctgcccacccatcaaggccagctgcagccccagcaggcacgaggcgaggcccaagtcgctgaacctccttcccgaggccaagcaccccggagacccccagagaggcttcaagcccaagaccaggaccccagaagagaggctgaagtggccccacgagcaggtttgcaatggtctggagcagccaaggaagcagcagcgctctgatctcaatggacctgttgacaataacaacattccagagacaaagaaggtggcatcatttccaagttttgtggctgttccagggccctgcgaaccagaagacctcatcgacgggatcatctttgctgccaattacctggggtccacccagctgctatcagaacggaacccttccaaaaacatcagaatgatgcaagcgcaggaggccgtcagccgggtcaagaattctgagggggatgcccagacgctgacggaagtggacctcttcatttccacccagaggatcaaggttttaaatgcagacacgcaggaaaccatgatggaccacgccttgcgtaccatctcctacatcgccgacattgggaacattgtagtgctgatggccagacgccgcatgccccggtcagcctctcaggactgcatcgagaccacgcccggggcccaggaaggcaagaagcagtataagatgatctgccatgtgttcgagtcggaggatgcccagctcatcgcccagtctatcggccaggccttcagcgtggcctaccaggagttcctgcgagccaatggcatcaaccccgaagacttgagccagaaggaatacagcgacatcatcaacacccaggagatgtacaacgacgacctcatccacttctcaaactcggagaactgcaaggagctgcagctggagaagcacaagggcgagatcctgggcgtggtggtggtggagtcgggctggggctccatcctgcccacggtgatcctggccaacatgatgaatggcggcccggctgcccgctcggggaagctgagcatcggggaccagatcatgtccatcaatggcaccagcctggtggggctgcccctcgccacctgccaaggcatcatcaagggcctgaagaaccagacacaggtgaagctcaacattgtcagctgtcccccggtcaccacggtccttatcaagcggccagacctcaagtaccagctgggcttcagcgtgcagaatggaattatctgcagcctcatgagagggggcattgctgagcgagggggcgtccgtgtgggccaccgcatcatcgagatcaacgggcagagcgtggtggccacagcccacgagaagatagtccaagctctgtccaactcggtcggagagatccacatgaagaccatgcccgccgccatgttcaggctcctcacgggtcaggagaccccgctgtacatctaggccaccccagcctggccacgcagccaggacaccgggcagggccgcccgggcccagaggagctgggagccgggccgcagacttgaccccgacgccacagcccagccacggacgctggctccccaaagggtgtgccctcaccacccacttgatttttttcattttgccaaaaaggggtatgtctttatcaaaggagagtcacagaacaaatgtttgtttgtaaagcgttccaagtattttgccacgttctggactgtcttctccctgcacaagccagggtgtgtctcggtagctgtgcgtggtgtggagtgtgtgtctttcctccctgaagctgtgcggagcgaactggcgcctccgagggacgcggctcccggggcagggcagccgtcacccctgcctcccgcccccttggctgggacgtctggggtcctgtggggcccccacaatggtcccaaacagctgcctctgccactgactgcagggacacgggcagcctggctcccaggacacgacttgtaatgaaagtttggggacatgtgattgattgattgattgtaaataaaggatgatggccacaacatgaaaactccatatttatttagatgctattattactgtttggacttttattttggcaggcttttttccagactctagggttttccaatgtgactaatgaccacacctgcctctcccgtcgtctcttctgggcaccctcccacccggctgcatacccgggcagggctcccacagagacaaggagggcacaggtgtctgccccctctttaaaatcgatctacacacatccacgcacatgcgaccccgaggaaacgaaacccactctagaaaacgcgaccttggccgcacctaaagcagccagccgtgagtgcagaccccttggccagcgtggcgcagtggccctgagcagtagtggcatgtgtgtagatcaagtcggatctagtccagctcggttcattagcgatccatgtaatctgacgtcatcttgtctcgaagtctctttttttggcccaggccttgaagaatacactgtgacttaagaagccttaccacgcagtaactaaagctttaggatgactgtattcgaggagtgccgtgtgttgcatgcagctacccgtaggaagacttcgcgcatatcactaataaacctgaagtcgtgatg

SEQ ID NO: 106966 - DNA, 594 bp, Homo sapiens
  Payload ID: 1009
  Gene Symbol: APBA2
  Gene Name: amyloid beta (A4) precursor protein-binding, family A, member 2
  ENST ID: ENST00000559709
  CDS Start-End: 582-594
agcagtcgcggtgtgcggctcggcgcgggctcacaaagagctcggcctcgcggactgagccggcggcagcggggcggggacggcggcgtacccgggcagcccagcgccctggccaggcgtgcctgtgcttaatcagcactgacgactggtgctgcttcagttgatttgatacacctagaggcagcctcatctccaacttgccttgacttcgtctggggagctgccgtgggggacccctggactggcagcattcccacccctcactttggcaaccctggtctaactccgcggagggagctgttcatcctctgggggctgctgggccagaaatatctcttacctgataatgtcaggcatcagaggttcctgtttcgtggtctcctgaatatttacgcgttgctgaatctcctgtggacaaaccaccaataggccaggactgtcctgtggacagacggggtgagcctcttcttgtgtctggagattctgaaaagatttgatcaccaggagatttttcgggacattaccaaaccactcattttagtggctgcctccgggtgatgatggctgtgtgaacgactgccatggcccaccgga

SEQ ID NO: 106967 - DNA, 3349 bp, Homo sapiens
  Payload ID: 1009
  Gene Symbol: APBA2
  Gene Name: amyloid beta (A4) precursor protein-binding, family A, member 2
  Uniprot ID: Q99767
  ENST ID: ENST00000558330
  CDS Start-End: 552-2765
gcccggcagccgcaggccggtgcgggatgcgccccgcagccgcgccgcgtgcgcccggcagaggcggccctgcgtgccgtacgctgcgtccggggcgcgcccgccgctattcgggaagctattcagcttcccgggctcattagcagtcgcggtgtgcggctcggcgcgggctcacaaagagctcggcctcgcggactgagccggcggcagcggggcggggacggcggcgtacccgggcagcccagcgccctggccaggcggagggagctgttcatcctctgggggctgctgggccagaaatatctcttacctgataatgtcaggcatcagaggttcctgtttcgtggtctcctgaatatttacgcgttgctgaatctcctgtggacaaaccaccaataggccaggactgtcctgtggacagacggggtgagcctcttcttgtgtctggagattctgaaaagatttgatcaccaggagatttttcgggacattaccaaaccactcattttagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggcctgcccacccatcaaggccagctgcagccccagcaggcacgaggcgaggcccaagtcgctgaacctccttcccgaggccaagcaccccggagacccccagagaggcttcaagcccaagaccaggaccccagaagagaggctgaagtggccccacgagcaggtttgcaatggtctggagcagccaaggaagcagcagcgctctgatctcaatggacctgttgacaataacaacattccagagacaaagaaggtggcatcatttccaagttttgtggctgttccagggccctgcgaaccagaagacctcatcgacgggatcatctttgctgccaattacctggggtccacccagctgctatcagaacggaacccttccaaaaacatcagaatgatgcaagcgcaggaggccgtcagccgggtcaagaattctgagggggatgcccagacgctgacggaagtggacctcttcatttccacccagaggatcaaggttttaaatgcagacacgcaggaaaccatgatggaccacgccttgcgtaccatctcctacatcgccgacattgggaacattgtagtgctgatggccagacgccgcatgccccggtcagcctctcaggactgcatcgagaccacgcccggggcccaggaaggcaagaagcagtataagatgatctgccatgtgttcgagtcggaggatgcccagctcatcgcccagtctatcggccaggccttcagcgtggcctaccaggagttcctgcgagccaatggcatcaaccccgaagacttgagccagaaggaatacagcgacatcatcaacacccaggagatgtacaacgacgacctcatccacttctcaaactcggagaactgcaaggagctgcagctggagaagcacaagggcgagatcctgggcgtggtggtggtggagtcgggctggggctccatcctgcccacggtgatcctggccaacatgatgaatggcggcccggctgcccgctcggggaagctgagcatcggggaccagatcatgtccatcaatggcaccagcctggtggggctgcccctcgccacctgccaaggcatcatcaagggcctgaagaaccagacacaggtgaagctcaacattgtcagctgtcccccggtcaccacggtccttatcaagcggccagacctcaagtaccagctgggcttcagcgtgcagaatggaattatctgcagcctcatgagagggggcattgctgagcgagggggcgtccgtgtgggccaccgcatcatcgagatcaacgggcagagcgtggtggccacagcccacgagaagatagtccaagctctgtccaactcggtcggagagatccacatgaagaccatgcccgccgccatgttcaggctcctcacgggtcaggagaccccgctgtacatctaggccaccccagcctggccacgcagccaggacaccgggcagggccgcccgggcccagaggagctgggagccgggccgcagacttgaccccgacgccacagcccagccacggacgctggctccccaaagggtgtgccctcaccacccacttgatttttttcattttgccaaaaaggggtatgtctttatcaaaggagagtcacagaacaaatgtttgtttgtaaagcgttccaagtattttgccacgttctggactgtcttctccctgcacaagccagggtgtgtctcggtagctgtgcgtggtgtggagtgtgtgtctttcctccctgaagctgtgcggagcgaactggcgcctccgagggacgcggctcccggggcagggcagccgtcacccctgcctcccgcccccttggctgggacgtctggggtcctgtggggcccccacaatggtcccaaacagctgcctctgccactgactgcagggacacgggcagcctggctcccaggacacgacttgtaatgaaagtttggggacatgtgattgattgattgattgtaaataaaggatgatggccacaacatgaaaa

SEQ ID NO: 106968 - DNA, 711 bp, Homo sapiens
  Payload ID: 1009
  Gene Symbol: APBA2
  Gene Name: amyloid beta (A4) precursor protein-binding, family A, member 2
  ENST ID: ENST00000560283
  CDS Start-End: 376-711
gcagatgagggcctgcttgggtctggggcgtcagtggggattggctgcaggcagccatgaggagccttcagggtgatgagggttctaaaagtgcgtcgtgtgcctgagccactgcgacattcactagaagtcctccgtgctgacggagggtgaactgtgtggggcccaagttctatctcaggaaagccagggaagccactcagttcagctttgtgaaaatcaagggagtcttcttggaggaagtggactctgagctggatgtgaatgacggagtgtctttgaaagatttgatcaccaggagatttttcgggacattaccaaaccactcattttagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagag

SEQ ID NO: 106969 - DNA, 3138 bp, Homo sapiens
  Payload ID: 1009
  Gene Symbol: APBA2
  Gene Name: amyloid beta (A4) precursor protein-binding, family A, member 2
  Uniprot ID: Q99767
  ENST ID: ENST00000561069
  CDS Start-End: 305-2554
acataacagtaaggcaagaagatgactgcatttatcttctcagaatcacttcttcttaattgttgcttcccactattggcattggtgaaaggctgggccacaggaggctggatgaactttgtgttagccagtctcctgaatatttacgcgttgctgaatctcctgtggacaaaccaccaataggccaggactgtcctgtggacagacgggaaagatttgatcaccaggagatttttcgggacattaccaaaccactcattttagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggcctgcccacccatcaaggccagctgcagccccagcaggcacgaggcgaggcccaagtcgctgaacctccttcccgaggccaagcaccccggagacccccagagaggcttcaagcccaagaccaggaccccagaagagaggctgaagtggccccacgagcaggtttgcaatggtctggagcagccaaggaagcagcagcgctctgatctcaatggacctgttgacaataacaacattccagagacaaagaaggtggcatcatttccaagttttgtggctgttccagggccctgcgaaccagaagacctcatcgacgggatcatctttgctgccaattacctggggtccacccagctgctatcagaacggaacccttccaaaaacatcagaatgatgcaagcgcaggaggccgtcagccgggtcaagaggatgcaaaaggctgctaagatcaagaaaaaagcgaattctgagggggatgcccagacgctgacggaagtggacctcttcatttccacccagaggatcaaggttttaaatgcagacacgcaggaaaccatgatggaccacgccttgcgtaccatctcctacatcgccgacattgggaacattgtagtgctgatggccagacgccgcatgccccggtcagcctctcaggactgcatcgagaccacgcccggggcccaggaaggcaagaagcagtataagatgatctgccatgtgttcgagtcggaggatgcccagctcatcgcccagtctatcggccaggccttcagcgtggcctaccaggagttcctgcgagccaatggcatcaaccccgaagacttgagccagaaggaatacagcgacatcatcaacacccaggagatgtacaacgacgacctcatccacttctcaaactcggagaactgcaaggagctgcagctggagaagcacaagggcgagatcctgggcgtggtggtggtggagtcgggctggggctccatcctgcccacggtgatcctggccaacatgatgaatggcggcccggctgcccgctcggggaagctgagcatcggggaccagatcatgtccatcaatggcaccagcctggtggggctgcccctcgccacctgccaaggcatcatcaagggcctgaagaaccagacacaggtgaagctcaacattgtcagctgtcccccggtcaccacggtccttatcaagcggccagacctcaagtaccagctgggcttcagcgtgcagaatggaattatctgcagcctcatgagagggggcattgctgagcgagggggcgtccgtgtgggccaccgcatcatcgagatcaacgggcagagcgtggtggccacagcccacgagaagatagtccaagctctgtccaactcggtcggagagatccacatgaagaccatgcccgccgccatgttcaggctcctcacgggtcaggagaccccgctgtacatctaggccaccccagcctggccacgcagccaggacaccgggcagggccgcccgggcccagaggagctgggagccgggccgcagacttgaccccgacgccacagcccagccacggacgctggctccccaaagggtgtgccctcaccacccacttgatttttttcattttgccaaaaaggggtatgtctttatcaaaggagagtcacagaacaaatgtttgtttgtaaagcgttccaagtattttgccacgttctggactgtcttctccctgcacaagccagggtgtgtctcggtagctgtgcgtggtgtggagtgtgtgtctttcctccctgaagctgtgcggagcgaactggcgcctccgagggacgcggctcccggggcagggcagccgtcacccctgcctcccgcccccttggctgggacgtctggggtcctgtggggcccccacaatggtcccaaacagctgcctctgccactgactgcagggacacgggcagcctggctcccaggacacgacttgtaatgaaagtttggggacatgtgattgattgattgattgtaaataaaggatgatggccacaacatgaaaa

SEQ ID NO: 106970 - DNA, 4031 bp, Homo sapiens
  Payload ID: 1009
  Gene Symbol: APBA2
  Gene Name: amyloid beta (A4) precursor protein-binding, family A, member 2
  Uniprot ID: Q99767
  ENST ID: ENST00000558402
  CDS Start-End: 600-2849
agtgtgcccggcgcgggtgaggcggaagcggccggggcgggggcgcaggcccggcagccgcaggccggtgcgggatgcgccccgcagccgcgccgcgtgcgcccggcagaggcggccctgcgtgccgtacgctgcgtccggggcgcgcccgccgctattcgggaagctattcagcttcccgggctcattagcagtcgcggtgtgcggctcggcgcgggctcacaaagagctcggcctcgcggactgagccggcggcagcggggcggggacggcggcgtacccgggcagcccagcgccctggccaggcggagggagctgttcatcctctgggggctgctgggccagaaatatctcttacctgataatgtcaggcatcagaggttcctgtttcgtggtctcctgaatatttacgcgttgctgaatctcctgtggacaaaccaccaataggccaggactgtcctgtggacagacggggtgagcctcttcttgtgtctggagattctgaaaagatttgatcaccaggagatttttcgggacattaccaaaccactcattttagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggcctgcccacccatcaaggccagctgcagccccagcaggcacgaggcgaggcccaagtcgctgaacctccttcccgaggccaagcaccccggagacccccagagaggcttcaagcccaagaccaggaccccagaagagaggctgaagtggccccacgagcaggtttgcaatggtctggagcagccaaggaagcagcagcgctctgatctcaatggacctgttgacaataacaacattccagagacaaagaaggtggcatcatttccaagttttgtggctgttccagggccctgcgaaccagaagacctcatcgacgggatcatctttgctgccaattacctggggtccacccagctgctatcagaacggaacccttccaaaaacatcagaatgatgcaagcgcaggaggccgtcagccgggtcaagaggatgcaaaaggctgctaagatcaagaaaaaagcgaattctgagggggatgcccagacgctgacggaagtggacctcttcatttccacccagaggatcaaggttttaaatgcagacacgcaggaaaccatgatggaccacgccttgcgtaccatctcctacatcgccgacattgggaacattgtagtgctgatggccagacgccgcatgccccggtcagcctctcaggactgcatcgagaccacgcccggggcccaggaaggcaagaagcagtataagatgatctgccatgtgttcgagtcggaggatgcccagctcatcgcccagtctatcggccaggccttcagcgtggcctaccaggagttcctgcgagccaatggcatcaaccccgaagacttgagccagaaggaatacagcgacatcatcaacacccaggagatgtacaacgacgacctcatccacttctcaaactcggagaactgcaaggagctgcagctggagaagcacaagggcgagatcctgggcgtggtggtggtggagtcgggctggggctccatcctgcccacggtgatcctggccaacatgatgaatggcggcccggctgcccgctcggggaagctgagcatcggggaccagatcatgtccatcaatggcaccagcctggtggggctgcccctcgccacctgccaaggcatcatcaagggcctgaagaaccagacacaggtgaagctcaacattgtcagctgtcccccggtcaccacggtccttatcaagcggccagacctcaagtaccagctgggcttcagcgtgcagaatggaattatctgcagcctcatgagagggggcattgctgagcgagggggcgtccgtgtgggccaccgcatcatcgagatcaacgggcagagcgtggtggccacagcccacgagaagatagtccaagctctgtccaactcggtcggagagatccacatgaagaccatgcccgccgccatgttcaggctcctcacgggtcaggagaccccgctgtacatctaggccaccccagcctggccacgcagccaggacaccgggcagggccgcccgggcccagaggagctgggagccgggccgcagacttgaccccgacgccacagcccagccacggacgctggctccccaaagggtgtgccctcaccacccacttgatttttttcattttgccaaaaaggggtatgtctttatcaaaggagagtcacagaacaaatgtttgtttgtaaagcgttccaagtattttgccacgttctggactgtcttctccctgcacaagccagggtgtgtctcggtagctgtgcgtggtgtggagtgtgtgtctttcctccctgaagctgtgcggagcgaactggcgcctccgagggacgcggctcccggggcagggcagccgtcacccctgcctcccgcccccttggctgggacgtctggggtcctgtggggcccccacaatggtcccaaacagctgcctctgccactgactgcagggacacgggcagcctggctcccaggacacgacttgtaatgaaagtttggggacatgtgattgattgattgattgtaaataaaggatgatggccacaacatgaaaactccatatttatttagatgctattattactgtttggacttttattttggcaggcttttttccagactctagggttttccaatgtgactaatgaccacacctgcctctcccgtcgtctcttctgggcaccctcccacccggctgcatacccgggcagggctcccacagagacaaggagggcacaggtgtctgccccctctttaaaatcgatctacacacatccacgcacatgcgaccccgaggaaacgaaacccactctagaaaacgcgaccttggccgcacctaaagcagccagccgtgagtgcagaccccttggccagcgtggcgcagtggccctgagcagtagtggcatgtgtgtagatcaagtcggatctagtccagctcggttcattagcgatccatgtaatctgacgtcatcttgtctcgaagtctctttttttggcccaggccttgaagaatacactgtgacttaagaagccttaccacgcagtaactaaagctttaggatgactgtattcgaggagtgccgtgtgttgcatgcagctacccgtaggaagacttcgcgcatatcactaataaacctgaagtcgtgatgaaaa

SEQ ID NO: 106971 - DNA, 936 bp, Homo sapiens
  Payload ID: 1009
  Gene Symbol: APBA2
  Gene Name: amyloid beta (A4) precursor protein-binding, family A, member 2
  ENST ID: ENST00000558358
  CDS Start-End: 146-936
agtggtgagcacggtgtcgggggccgcattagctattgatttatgtgctgttatagaattaattgagtctggacatggagactcattttcttggacatgtagcagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggc

SEQ ID NO: 106972 - DNA, 554 bp, Homo sapiens
  Payload ID: 1009
  Gene Symbol: APBA2
  Gene Name: amyloid beta (A4) precursor protein-binding, family A, member 2
  ENST ID: ENST00000558206
  CDS Start-End: 473-554
cagctcagccccactgcaaggagctcctgggtttatttaagtgagcctcagataactttacataaaagcaaatgtgtaaaaagcgataaagtcagatatattgaacatttgtcctgagggcaaatttctgagctctaaaagccagtttggttttagataacatctgtgagtctggaaacaggctgagatactctatatctgcactcccaactctgcctttggctttgtgagccctgtggtctccttgaaagaattggtccccagtgggtgaactaatcacccatgaagagtctcccaattcaaatctggaataaaaagtgaggacatgggggcagaatgttactcatcacatgtggcccgtcagtactagacttcaagaaagatttgatcaccaggagatttttcgggacattaccaaaccactcattttagtggctgcctccgggtgatgatggctgtgtgaacgactgccatggcccaccggaagcttgagagcgtggggagcggcatgttggaccatagggtgagaccaggtcctgtccctcacagccagg

SEQ ID NO: 106973 - DNA, 535 bp, Homo sapiens
  Payload ID: 1009
  Gene Symbol: APBA2
  Gene Name: amyloid beta (A4) precursor protein-binding, family A, member 2
  ENST ID: ENST00000558804
  CDS Start-End: 326-535
aacaaccgctgacttcctggttcctgggtgccgcatcactgcccctctgctccgggtcaaaccggctgtatgcttagcttcaggaacatgtggcaggtggcagcccccggccccgtggcagtctcctgaatatttacgcgttgctgaatctcctgtggacaaaccaccaataggccaggactgtcctgtggacagacggggtgagcctcttcttgtgtctggagattctgaaaagatttgatcaccaggagatttttcgggacattaccaaaccactcattttagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggg

SEQ ID NO: 106974 - DNA, 3635 bp, Homo sapiens
  Payload ID: 1009
  Gene Symbol: APBA2
  Gene Name: amyloid beta (A4) precursor protein-binding, family A, member 2
  Uniprot ID: Q99767
  ENST ID: ENST00000558259
  CDS Start-End: 208-2457
cagtctcctgaatatttacgcgttgctgaatctcctgtggacaaaccaccaataggccaggactgtcctgtggacagacggggtgagcctcttcttgtgtctggagattctgaaaagatttgatcaccaggagatttttcgggacattaccaaaccactcattttagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggcctgcccacccatcaaggccagctgcagccccagcaggcacgaggcgaggcccaagtcgctgaacctccttcccgaggccaagcaccccggagacccccagagaggcttcaagcccaagaccaggaccccagaagagaggctgaagtggccccacgagcaggtttgcaatggtctggagcagccaaggaagcagcagcgctctgatctcaatggacctgttgacaataacaacattccagagacaaagaaggtggcatcatttccaagttttgtggctgttccagggccctgcgaaccagaagacctcatcgacgggatcatctttgctgccaattacctggggtccacccagctgctatcagaacggaacccttccaaaaacatcagaatgatgcaagcgcaggaggccgtcagccgggtcaagaggatgcaaaaggctgctaagatcaagaaaaaagcgaattctgagggggatgcccagacgctgacggaagtggacctcttcatttccacccagaggatcaaggttttaaatgcagacacgcaggaaaccatgatggaccacgccttgcgtaccatctcctacatcgccgacattgggaacattgtagtgctgatggccagacgccgcatgccccggtcagcctctcaggactgcatcgagaccacgcccggggcccaggaaggcaagaagcagtataagatgatctgccatgtgttcgagtcggaggatgcccagctcatcgcccagtctatcggccaggccttcagcgtggcctaccaggagttcctgcgagccaatggcatcaaccccgaagacttgagccagaaggaatacagcgacatcatcaacacccaggagatgtacaacgacgacctcatccacttctcaaactcggagaactgcaaggagctgcagctggagaagcacaagggcgagatcctgggcgtggtggtggtggagtcgggctggggctccatcctgcccacggtgatcctggccaacatgatgaatggcggcccggctgcccgctcggggaagctgagcatcggggaccagatcatgtccatcaatggcaccagcctggtggggctgcccctcgccacctgccaaggcatcatcaagggcctgaagaaccagacacaggtgaagctcaacattgtcagctgtcccccggtcaccacggtccttatcaagcggccagacctcaagtaccagctgggcttcagcgtgcagaatggaattatctgcagcctcatgagagggggcattgctgagcgagggggcgtccgtgtgggccaccgcatcatcgagatcaacgggcagagcgtggtggccacagcccacgagaagatagtccaagctctgtccaactcggtcggagagatccacatgaagaccatgcccgccgccatgttcaggctcctcacgggtcaggagaccccgctgtacatctaggccaccccagcctggccacgcagccaggacaccgggcagggccgcccgggcccagaggagctgggagccgggccgcagacttgaccccgacgccacagcccagccacggacgctggctccccaaagggtgtgccctcaccacccacttgatttttttcattttgccaaaaaggggtatgtctttatcaaaggagagtcacagaacaaatgtttgtttgtaaagcgttccaagtattttgccacgttctggactgtcttctccctgcacaagccagggtgtgtctcggtagctgtgcgtggtgtggagtgtgtgtctttcctccctgaagctgtgcggagcgaactggcgcctccgagggacgcggctcccggggcagggcagccgtcacccctgcctcccgcccccttggctgggacgtctggggtcctgtggggcccccacaatggtcccaaacagctgcctctgccactgactgcagggacacgggcagcctggctcccaggacacgacttgtaatgaaagtttggggacatgtgattgattgattgattgtaaataaaggatgatggccacaacatgaaaactccatatttatttagatgctattattactgtttggacttttattttggcaggcttttttccagactctagggttttccaatgtgactaatgaccacacctgcctctcccgtcgtctcttctgggcaccctcccacccggctgcatacccgggcagggctcccacagagacaaggagggcacaggtgtctgccccctctttaaaatcgatctacacacatccacgcacatgcgaccccgaggaaacgaaacccactctagaaaacgcgaccttggccgcacctaaagcagccagccgtgagtgcagaccccttggccagcgtggcgcagtggccctgagcagtagtggcatgtgtgtagatcaagtcggatctagtccagctcggttcattagcgatccatgtaatctgacgtcatcttgtctcgaagtctctttttttggcccaggccttgaagaatacactgtgacttaagaagccttaccacgcagtaactaaagctttaggatgactgtattcgaggagtgccgtgtgttgcatgcagctacccgtaggaagacttcgcgcatatcactaataaacctgaagtcgtgatg

SEQ ID NO: 106975 - DNA, 3640 bp, Homo sapiens
  Payload ID: 1009
  Gene Symbol: APBA2
  Gene Name: amyloid beta (A4) precursor protein-binding, family A, member 2
  Uniprot ID: Q99767
  ENST ID: ENST00000620457
  CDS Start-End: 205-2454
tctcctgaatatttacgcgttgctgaatctcctgtggacaaaccaccaataggccaggactgtcctgtggacagacggggtgagcctcttcttgtgtctggagattctgaaaagatttgatcaccaggagatttttcgggacattaccaaaccactcattttagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggcctgcccacccatcaaggccagctgcagccccagcaggcacgaggcgaggcccaagtcgctgaacctccttcccgaggccaagcaccccggagacccccagagaggcttcaagcccaagaccaggaccccagaagagaggctgaagtggccccacgagcaggtttgcaatggtctggagcagccaaggaagcagcagcgctctgatctcaatggacctgttgacaataacaacattccagagacaaagaaggtggcatcatttccaagttttgtggctgttccagggccctgcgaaccagaagacctcatcgacgggatcatctttgctgccaattacctggggtccacccagctgctatcagaacggaacccttccaaaaacatcagaatgatgcaagcgcaggaggccgtcagccgggtcaagaggatgcaaaaggctgctaagatcaagaaaaaagcgaattctgagggggatgcccagacgctgacggaagtggacctcttcatttccacccagaggatcaaggttttaaatgcagacacgcaggaaaccatgatggaccacgccttgcgtaccatctcctacatcgccgacattgggaacattgtagtgctgatggccagacgccgcatgccccggtcagcctctcaggactgcatcgagaccacgcccggggcccaggaaggcaagaagcagtataagatgatctgccatgtgttcgagtcggaggatgcccagctcatcgcccagtctatcggccaggccttcagcgtggcctaccaggagttcctgcgagccaatggcatcaaccccgaagacttgagccagaaggaatacagcgacatcatcaacacccaggagatgtacaacgacgacctcatccacttctcaaactcggagaactgcaaggagctgcagctggagaagcacaagggcgagatcctgggcgtggtggtggtggagtcgggctggggctccatcctgcccacggtgatcctggccaacatgatgaatggcggcccggctgcccgctcggggaagctgagcatcggggaccagatcatgtccatcaatggcaccagcctggtggggctgcccctcgccacctgccaaggcatcatcaagggcctgaagaaccagacacaggtgaagctcaacattgtcagctgtcccccggtcaccacggtccttatcaagcggccagacctcaagtaccagctgggcttcagcgtgcagaatggaattatctgcagcctcatgagagggggcattgctgagcgagggggcgtccgtgtgggccaccgcatcatcgagatcaacgggcagagcgtggtggccacagcccacgagaagatagtccaagctctgtccaactcggtcggagagatccacatgaagaccatgcccgccgccatgttcaggctcctcacgggtcaggagaccccgctgtacatctaggccaccccagcctggccacgcagccaggacaccgggcagggccgcccgggcccagaggagctgggagccgggccgcagacttgaccccgacgccacagcccagccacggacgctggctccccaaagggtgtgccctcaccacccacttgatttttttcattttgccaaaaaggggtatgtctttatcaaaggagagtcacagaacaaatgtttgtttgtaaagcgttccaagtattttgccacgttctggactgtcttctccctgcacaagccagggtgtgtctcggtagctgtgcgtggtgtggagtgtgtgtctttcctccctgaagctgtgcggagcgaactggcgcctccgagggacgcggctcccggggcagggcagccgtcacccctgcctcccgcccccttggctgggacgtctggggtcctgtggggcccccacaatggtcccaaacagctgcctctgccactgactgcagggacacgggcagcctggctcccaggacacgacttgtaatgaaagtttggggacatgtgattgattgattgattgattgtaaataaaggatgatggccacaacatgaaaactccatatttatttagatgctattattactgtttggacttttattttggcaggcttttttccagactctagggttttccaatgtgactaatgaccacacctgcctctcccgtcgtctcttctgggcaccctcccacccggctgcatacccggccagggctcccacagagacaaggagggcacaggtgtctgccccctctttaaaatcgatctacacacatccacgcacatgcgaccccgaggaaacgaaacccactctagaaaacgcgaccttggccgcacctaaagcagccagccgtgagtgcagaccccttggccagcgtggcgcagtggccctgagcagtagtggcatgtgtgtagatcaagtcggatctagtccagctcggttcattagcgatccatgtaatctgacgtcatcttgtctcgaagtctctttttttggcccaggccttgaagaatacactgtgacttaagaagccttaccacgcagtaactaaagctttaggatgactgtattcgaggagtgccgtgtgttgcatgcagctacccgtaggaagacttcgcgcatatcactaataaacctgaagtcgtgatgaaaa

SEQ ID NO: 106976 - DNA, 3006 bp, Homo sapiens
  Payload ID: 1009
  Gene Symbol: APBA2
  Gene Name: amyloid beta (A4) precursor protein-binding, family A, member 2
  Uniprot ID: Q99767
  ENST ID: ENST00000612449
  CDS Start-End: 205-2418
tctcctgaatatttacgcgttgctgaatctcctgtggacaaaccaccaataggccaggactgtcctgtggacagacggggtgagcctcttcttgtgtctggagattctgaaaagatttgatcaccaggagatttttcgggacattaccaaaccactcattttagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggcctgcccacccatcaaggccagctgcagccccagcaggcacgaggcgaggcccaagtcgctgaacctccttcccgaggccaagcaccccggagacccccagagaggcttcaagcccaagaccaggaccccagaagagaggctgaagtggccccacgagcaggtttgcaatggtctggagcagccaaggaagcagcagcgctctgatctcaatggacctgttgacaataacaacattccagagacaaagaaggtggcatcatttccaagttttgtggctgttccagggccctgcgaaccagaagacctcatcgacgggatcatctttgctgccaattacctggggtccacccagctgctatcagaacggaacccttccaaaaacatcagaatgatgcaagcgcaggaggccgtcagccgggtcaagaattctgagggggatgcccagacgctgacggaagtggacctcttcatttccacccagaggatcaaggttttaaatgcagacacgcaggaaaccatgatggaccacgccttgcgtaccatctcctacatcgccgacattgggaacattgtagtgctgatggccagacgccgcatgccccggtcagcctctcaggactgcatcgagaccacgcccggggcccaggaaggcaagaagcagtataagatgatctgccatgtgttcgagtcggaggatgcccagctcatcgcccagtctatcggccaggccttcagcgtggcctaccaggagttcctgcgagccaatggcatcaaccccgaagacttgagccagaaggaatacagcgacatcatcaacacccaggagatgtacaacgacgacctcatccacttctcaaactcggagaactgcaaggagctgcagctggagaagcacaagggcgagatcctgggcgtggtggtggtggagtcgggctggggctccatcctgcccacggtgatcctggccaacatgatgaatggcggcccggctgcccgctcggggaagctgagcatcggggaccagatcatgtccatcaatggcaccagcctggtggggctgcccctcgccacctgccaaggcatcatcaagggcctgaagaaccagacacaggtgaagctcaacattgtcagctgtcccccggtcaccacggtccttatcaagcggccagacctcaagtaccagctgggcttcagcgtgcagaatggaattatctgcagcctcatgagagggggcattgctgagcgagggggcgtccgtgtgggccaccgcatcatcgagatcaacgggcagagcgtggtggccacagcccacgagaagatagtccaagctctgtccaactcggtcggagagatccacatgaagaccatgcccgccgccatgttcaggctcctcacgggtcaggagaccccgctgtacatctaggccaccccagcctggccacgcagccaggacaccgggcagggccgcccgggcccagaggagctgggagccgggccgcagacttgaccccgacgccacagcccagccacggacgctggctccccaaagggtgtgccctcaccacccacttgatttttttcattttgccaaaaaggggtatgtctttatcaaaggagagtcacagaacaaatgtttgtttgtaaagcgttccaagtattttgccacgttctggactgtcttctccctgcacaagccagggtgtgtctcggtagctgtgcgtggtgtggagtgtgtgtctttcctccctgaagctgtgcggagcgaactggcgcctccgagggacgcggctcccggggcagggcagccgtcacccctgcctcccgcccccttggctgggacgtctggggtcctgtggggcccccacaatggtcccaaacagctgcctctgccactgactgcagggacacgggcagcctggctcccaggacacgacttgtaatgaaagtttggggacatgtgattgattgattgattgattgtaaataaaggatgatggccacaacatgaaaa

SEQ ID NO: 106977 - DNA, 936 bp, Homo sapiens; identical to SEQ ID NO: 106971
  Payload ID: 1009
  Gene Symbol: APBA2
  Gene Name: amyloid beta (A4) precursor protein-binding, family A, member 2
  ENST ID: ENST00000632681
  CDS Start-End: 146-936

SEQ ID NO: 106978 - DNA, 554 bp, Homo sapiens; identical to SEQ ID NO: 106972
  Payload ID: 1009
  Gene Symbol: APBA2
  Gene Name: amyloid beta (A4) precursor protein-binding, family A, member 2
  ENST ID: ENST00000631996
  CDS Start-End: 473-554

SEQ ID NO: 106979 - DNA, 3011 bp, Homo sapiens
  Payload ID: 1009
  Gene Symbol: APBA2
  Gene Name: amyloid beta (A4) precursor protein-binding, family A, member 2
  Uniprot ID: Q99767
  ENST ID: ENST00000631894
  CDS Start-End: 174-2423
tctcctgaatatttacgcgttgctgaatctcctgtggacaaaccaccaataggccaggactgtcctgtggacagacgggaaagatttgatcaccaggagatttttcgggacattaccaaaccactcattttagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggcctgcccacccatcaaggccagctgcagccccagcaggcacgaggcgaggcccaagtcgctgaacctccttcccgaggccaagcaccccggagacccccagagaggcttcaagcccaagaccaggaccccagaagagaggctgaagtggccccacgagcaggtttgcaatggtctggagcagccaaggaagcagcagcgctctgatctcaatggacctgttgacaataacaacattccagagacaaagaaggtggcatcatttccaagttttgtggctgttccagggccctgcgaaccagaagacctcatcgacgggatcatctttgctgccaattacctggggtccacccagctgctatcagaacggaacccttccaaaaacatcagaatgatgcaagcgcaggaggccgtcagccgggtcaagaggatgcaaaaggctgctaagatcaagaaaaaagcgaattctgagggggatgcccagacgctgacggaagtggacctcttcatttccacccagaggatcaaggttttaaatgcagacacgcaggaaaccatgatggaccacgccttgcgtaccatctcctacatcgccgacattgggaacattgtagtgctgatggccagacgccgcatgccccggtcagcctctcaggactgcatcgagaccacgcccggggcccaggaaggcaagaagcagtataagatgatctgccatgtgttcgagtcggaggatgcccagctcatcgcccagtctatcggccaggccttcagcgtggcctaccaggagttcctgcgagccaatggcatcaaccccgaagacttgagccagaaggaatacagcgacatcatcaacacccaggagatgtacaacgacgacctcatccacttctcaaactcggagaactgcaaggagctgcagctggagaagcacaagggcgagatcctgggcgtggtggtggtggagtcgggctggggctccatcctgcccacggtgatcctggccaacatgatgaatggcggcccggctgcccgctcggggaagctgagcatcggggaccagatcatgtccatcaatggcaccagcctggtggggctgcccctcgccacctgccaaggcatcatcaagggcctgaagaaccagacacaggtgaagctcaacattgtcagctgtcccccggtcaccacggtccttatcaagcggccagacctcaagtaccagctgggcttcagcgtgcagaatggaattatctgcagcctcatgagagggggcattgctgagcgagggggcgtccgtgtgggccaccgcatcatcgagatcaacgggcagagcgtggtggccacagcccacgagaagatagtccaagctctgtccaactcggtcggagagatccacatgaagaccatgcccgccgccatgttcaggctcctcacgggtcaggagaccccgctgtacatctaggccaccccagcctggccacgcagccaggacaccgggcagggccgcccgggcccagaggagctgggagccgggccgcagacttgaccccgacgccacagcccagccacggacgctggctccccaaagggtgtgccctcaccacccacttgatttttttcattttgccaaaaaggggtatgtctttatcaaaggagagtcacagaacaaatgtttgtttgtaaagcgttccaagtattttgccacgttctggactgtcttctccctgcacaagccagggtgtgtctcggtagctgtgcgtggtgtggagtgtgtgtctttcctccctgaagctgtgcggagcgaactggcgcctccgagggacgcggctcccggggcagggcagccgtcacccctgcctcccgcccccttggctgggacgtctggggtcctgtggggcccccacaatggtcccaaacagctgcctctgccactgactgcagggacacgggcagcctggctcccaggacacgacttgtaatgaaagtttggggacatgtgattgattgattgattgattgtaaataaaggatgatggccacaacatgaaaa

SEQ ID NO: 106980 - DNA, 217 bp, Homo sapiens
  Payload ID: 1009
  Gene Symbol: APBA2
  Gene Name: amyloid beta (A4) precursor protein-binding, family A, member 2
  ENST ID: ENST00000631794
  CDS Start-End: 205-217
tctcctgaatatttacgcgttgctgaatctcctgtggacaaaccaccaataggccaggactgtcctgtggacagacggggtgagcctcttcttgtgtctggagattctgaaaagatttgatcaccaggagatttttcgggacattaccaaaccactcattttagtggctgcctccgggtgatgatggctgtgtgaacgactgccatggcccaccgga

SEQ ID NO: 106981 - DNA, 711 bp, Homo sapiens; identical to SEQ ID NO: 106968
  Payload ID: 1009
  Gene Symbol: APBA2
  Gene Name: amyloid beta (A4) precursor protein-binding, family A, member 2
  ENST ID: ENST00000632415
  CDS Start-End: 376-711

SEQ ID NO: 106982 - DNA, 535 bp, Homo sapiens; identical to SEQ ID NO: 106973
  Payload ID: 1009
  Gene Symbol: APBA2
  Gene Name: amyloid beta (A4) precursor protein-binding, family A, member 2
  ENST ID: ENST00000632247
  CDS Start-End: 326-535

SEQ ID NO: 106983 - DNA, 2075 bp, Homo sapiens
  Payload ID: 1010
  Gene Symbol: APBA3
  Gene Name: amyloid beta (A4) precursor protein-binding, family A, member 3
  Uniprot ID: O96018
  ENST ID: ENST00000316757
  CDS Start-End: 202-1929
catgctcaatgggccagggctctgcgcggatagaggagcgggcgccgggaccgggaatccccgagctgcgccttctggggacgcggcccgggctacgtcggggccgtccgtggggagcggggtcctggaggctgcgcggggctgaggcggcctcgatttgggaactgcctgaagatgccggcctaagcctggagtccaggcatggacttccccacaatttcccgatccccttcggggcctccagccatggacttggaggggcccagggacattcttgtgccttcggaggacctcacccctgacagccagtgggaccctatgccaggaggccccggcagcctcagtcggatggaacttgatgagtcaagccttcaggagctggtgcagcagtttgaagctctgccaggcgatctggtgggcccatccccaggtggagccccctgtcccctacacattgccacaggccatggcctggcctcccaggagattgctgatgcccacgggctcctgtctgccgaagctggccgggatgacctgctgggcctcttgcactgcgaggaatgcccgccttcccagactggtcctgaagagcctctagagcctgccccccgactgttgcagccccctgaggacccagatgaggattctgactccccagaatgggtggagggggcctctgctgagcaggagggcagcaggagctcaagcagttccccggaaccctggctggagacggtgcctctagtcacacctgaagagccacccgctggtgcccagagccccgagaccctggcttcctaccctgccccccaggaggtgcctggtccctgtgaccatgaagacctcctggacggtgtcatatttggggccaggtacctggggtccacccagctggtgtcggaacggaacccgcccaccagcacgcgcatggcccaggcccgggaggccatggaccgcgtcaaggcccccgatggggagacccagcccatgacggaggtggacctgttcgtctccaccaagaggatcaaggtcttgacagcggactcccaggaggccatgatggaccacgccctgcataccatctcctacacagccgacatcggctgcgtgctggtgctgatggcgcggcggcggctggcacggaggccggcaccccaggaccacggccgccgcctctacaagatgctctgccacgtattctacgcggaggacgcccagctcatcgcccaggccattggccaggccttcgccgccgcctacagccagttcctacgggaaagcggtattgaccccagccaggtgggcgtgcacccgagcccaggcgcctgccacctccataatggggacctggaccacttctccaacagtgacaactgccgggaggtgcacctcgagaagcggcgaggggagggcctgggcgtggccctggtggagtcgggctggggctccctgctgcccacagccgtcatcgccaacctgctgcacggggggcctgctgagcgctcgggggccctcagcatcggggaccgcctgaccgccatcaacgggaccagcctggtggggctgcccctggctgcgtgccaggccgctgtccgcgagacgaagtcgcagacgtcggtgacactcagcatcgtccactgccctcccgtcaccaccgccatcatccaccggccccacgcccgcgagcagctgggcttctgcgtggaggacggcatcatctgcagcctcctccgtggtggcatcgccgagcgtgggggcatccgcgtcggccaccgcatcattgagatcaatgggcagagtgtggtggccacgccacacgcccgcatcatcgagctgctcaccgaggcctatggcgaggtgcatatcaagacgatgccagctgccacatatcgcctccttacaggccaggagcagcccgtgtacctgtgaccacctcatcccttgcctgccactgtgccttcgcctccatggccccggagccccatcctgggcctgccctggctggccaggaccccagcggttcttggtcctgtatgatttcctaatataaaaacagtaaaagcttatgcatttgg

SEQ ID NO: 106984 - DNA, 2636 bp, Homo sapiens
  Payload ID: 1011
  Gene Symbol: APBB1
  Gene Name: amyloid beta (A4) precursor protein-binding, family B, member 1 (Fe65)
  Uniprot ID: O00213
  ENST ID: ENST00000299402
  CDS Start-End: 101-2227
atgttgtgatggagaagccgcggcggagcccgaaccccgcagcctgagccacctccgtcatctgggcccggggcctcaccgcgcaggagctgccaaggccatgtctgttccatcatcactgagccagtcggccattaatgccaacagccacggaggccccgcactgagcctacccctgcctctgcacgctgcccacaaccagctgctcaacgccaagctgcaggccacagctgtgggacccaaggacctgcgcagcgccatgggggagggtggtgggcctgagccaggccctgccaatgccaagtggctaaaagagggccagaaccagctccggcgggccgccacggcccaccgtgaccagaatcgcaatgtgaccttgaccttggcggaggaggccagccaggagcctgagatggcacccttgggccccaaaggcctgatacacctgtactctgagctggagctctcagctcacaacgcagccaaccgaggcctacgaggacctggcctgatcatcagcactcaagagcaggggccagatgagggagaggagaaggcggccggggaggccgaggaggaggaggaggatgatgatgatgaagaggaggaggaggacttatcttctcccccagggctgcctgagcccctggagagtgtggaggcccctcccaggccccaagcccttacagatggcccccgggaacacagcaagagtgccagcctcctgtttggcatgcggaacagtgcagccagtgatgaggactcaagctgggctaccttatcccagggcagcccctcctatggctccccagaggacacagattccttctggaaccccaacgccttcgagacggattccgacctgccggctggatggatgagggtccaggacacctcagggacctattactggcacatcccaacagggaccacccagtgggaaccccccggccgggcctccccctcacaggggagcagcccccaagaggagtcccagctcacctggacaggttttgctcatggagaaggctttgaggatggagaattttggaaggatgaacccagtgatgaggccccaatggagctgggactgaaggaacctgaggaggggacgttgaccttcccagctcagagcctcagcccagagccgttgccccaagaggaggagaagcttcccccacggaataccaacccagggatcaagtgtttcgccgtgcgctccctaggctgggtagagatgaccgaggaggagctggcccctggacgcagcagtgtggcagtcaacaattgcatccgtcagctctcttaccacaaaaacaacctgcatgaccccatgtctgggggctggggggaaggaaaggatctgctactgcagctggaggatgagacactaaagctagtggagccacagagccaggcactgctgcacgcccaacccatcatcagcatccgcgtgtggggcgtcgggcgggacagtggaagggactttgcctacgtagctcgtgataagctgacccagatgctcaagtgccacgtgtttcgctgtgaggcacctgccaagaacatcgccaccagcctgcatgagatctgctctaagatcatggccgaacggcgtaatgcccgctgcttggtaaatggactctccctggaccactctaaacttgtggatgtccctttccaagtggaattcccagcgcctaagaatgagttggtccagaagttccaagtctattacctggggaatgtacctgttgctaaacctgttggggtagatgtgattaatggggccctcgagtcagtcctgtcctccagcagccgtgaacaatggaccccaagtcatgtcagtgtggcccctgctaccctcaccatcttgcaccagcagacagaggcagtgctgggagagtgtcgggtgcgtttcctctccttcctggccgtgggcagagatgtccacacgtttgcattcatcatggctgccggcccagcctccttctgctgccacatgttctggtgcgagcccaatgctgccagcctctcagaggctgtgcaggctgcgtgcatgcttcgctaccagaagtgtctggatgcccgttcccaggcctccacctcctgcctcccagcaccccctgctgagtctgtggcacggcgtgtagggtggactgtccgcaggggtgttcagtcgctgtggggctccctgaagcccaaacggctgggggcccataccccatgaagaagcccccaccttccctccacctgcttgtgttgggccccagggaactaaagggtgtgggtcagggaggggtctagaggctattcctaggcctcaggcctcccaaatatgcccctccccagtagctacggttccctgcctaggagctggggagggagagatctaatcccttcaaggaagtgataacactggagtggtaacaagaggagcaggaagcaaggccagccctggttctccatccccatgtgtttcaggtggaacaggaggaactggtccaggccaggcctcatcctcctggacccagcaggggcagaaggaggaagggactggtccaggcatgggtcccttccccctgctccatgggcacctctgctgtattgatatcactaataaagtctgtctgcactgc

SEQ ID NO: 106985 - DNA, 2619 bp, Homo sapiens
  Payload ID: 1011
  Gene Symbol: APBB1
  Gene Name: amyloid beta (A4) precursor protein-binding, family B, member 1 (Fe65)
  Uniprot ID: O00213
  ENST ID: ENST00000311051
  CDS Start-End: 84-2210
tcgggctccagccccgtccgcgcgtctcccggcgtgggtgcgggaccagggcgctgcggggcgcgcagggagctgccaaggccatgtctgttccatcatcactgagccagtcggccattaatgccaacagccacggaggccccgcactgagcctacccctgcctctgcacgctgcccacaaccagctgctcaacgccaagctgcaggccacagctgtgggacccaaggacctgcgcagcgccatgggggagggtggtgggcctgagccaggccctgccaatgccaagtggctaaaagagggccagaaccagctccggcgggccgccacggcccaccgtgaccagaatcgcaatgtgaccttgaccttggcggaggaggccagccaggagcctgagatggcacccttgggccccaaaggcctgatacacctgtactctgagctggagctctcagctcacaacgcagccaaccgaggcctacgaggacctggcctgatcatcagcactcaagagcaggggccagatgagggagaggagaaggcggccggggaggccgaggaggaggaggaggatgatgatgatgaagaggaggaggaggacttatcttctcccccagggctgcctgagcccctggagagtgtggaggcccctcccaggccccaagcccttacagatggcccccgggaacacagcaagagtgccagcctcctgtttggcatgcggaacagtgcagccagtgatgaggactcaagctgggctaccttatcccagggcagcccctcctatggctccccagaggacacagattccttctggaaccccaacgccttcgagacggattccgacctgccggctggatggatgagggtccaggacacctcagggacctattactggcacatcccaacagggaccacccagtgggaaccccccggccgggcctccccctcacaggggagcagcccccaagaggagtcccagctcacctggacaggttttgctcatggagaaggctttgaggatggagaattttggaaggatgaacccagtgatgaggccccaatggagctgggactgaaggaacctgaggaggggacgttgaccttcccagctcagagcctcagcccagagccgttgccccaagaggaggagaagcttcccccacggaataccaacccagggatcaagtgtttcgccgtgcgctccctaggctgggtagagatgaccgaggaggagctggcccctggacgcagcagtgtggcagtcaacaattgcatccgtcagctctcttaccacaaaaacaacctgcatgaccccatgtctgggggctggggggaaggaaaggatctgctactgcagctggaggatgagacactaaagctagtggagccacagagccaggcactgctgcacgcccaacccatcatcagcatccgcgtgtggggcgtcgggcgggacagtggaagggactttgcctacgtagctcgtgataagctgacccagatgctcaagtgccacgtgtttcgctgtgaggcacctgccaagaacatcgccaccagcctgcatgagatctgctctaagatcatggccgaacggcgtaatgcccgctgcttggtaaatggactctccctggaccactctaaacttgtggatgtccctttccaagtggaattcccagcgcctaagaatgagttggtccagaagttccaagtctattacctggggaatgtacctgttgctaaacctgttggggtagatgtgattaatggggccctcgagtcagtcctgtcctccagcagccgtgaacaatggaccccaagtcatgtcagtgtggcccctgctaccctcaccatcttgcaccagcagacagaggcagtgctgggagagtgtcgggtgcgtttcctctccttcctggccgtgggcagagatgtccacacgtttgcattcatcatggctgccggcccagcctccttctgctgccacatgttctggtgcgagcccaatgctgccagcctctcagaggctgtgcaggctgcgtgcatgcttcgctaccagaagtgtctggatgcccgttcccaggcctccacctcctgcctcccagcaccccctgctgagtctgtggcacggcgtgtagggtggactgtccgcaggggtgttcagtcgctgtggggctccctgaagcccaaacggctgggggcccataccccatgaagaagcccccaccttccctccacctgcttgtgttgggccccagggaactaaagggtgtgggtcagggaggggtctagaggctattcctaggcctcaggcctcccaaatatgcccctccccagtagctacggttccctgcctaggagctggggagggagagatctaatcccttcaaggaagtgataacactggagtggtaacaagaggagcaggaagcaaggccagccctggttctccatccccatgtgtttcaggtggaacaggaggaactggtccaggccaggcctcatcctcctggacccagcaggggcagaaggaggaagggactggtccaggcatgggtcccttccccctgctccatgggcacctctgctgtattgatatcactaataaagtctgtctgcactgc

SEQ ID NO: 106986 - DNA, 2684 bp, Homo sapiens
  Payload ID: 1011
  Gene Symbol: APBB1
  Gene Name: amyloid beta (A4) precursor protein-binding, family B, member 1 (Fe65)
  ENST ID: ENST00000389906
  CDS Start-End: 142-2274
tcggggcgcggccccgcggcccgcgcgctcctgggcgggggatgttgtgatggagaagccgcggcggagcccgaaccccgcagcctgagccacctccgtcatctgggcccggggcctcaccgcgcaggagctgccaaggccatgtctgttccatcatcactgagccagtcggccattaatgccaacagccacggaggccccgcactgagcctacccctgcctctgcacgctgcccacaaccagctgctcaacgccaagctgcaggccacagctgtgggacccaaggacctgcgcagcgccatgggggagggtggtgggcctgagccaggccctgccaatgccaagtggctaaaagagggccagaaccagctccggcgggccgccacggcccaccgtgaccagaatcgcaatgtgaccttgaccttggcggaggaggccagccaggagcctgagatggcacccttgggccccaaaggcctgatacacctgtactctgagctggagctctcagctcacaacgcagccaaccgaggcctacgaggacctggcctgatcatcagcactcaagagcaggggccagatgagggagaggagaaggcggccggggaggccgaggaggaggaggaggatgatgatgatgaagaggaggaggaggacttatcttctcccccagggctgcctgagcccctggagagtgtggaggcccctcccaggccccaagcccttacagatggcccccgggaacacagcaagagtgccagcctcctgtttggcatgcggaacagtgcagccagtgatgaggactcaagctgggctaccttatcccagggcagcccctcctatggctccccagaggacacagattccttctggaaccccaacgccttcgagacggattccgacctgccggctggatggatgagggtccaggacacctcagggacctattactggcacatcccaacagggaccacccagtgggaaccccccggccgggcctccccctcacaggggagcagcccccaagaggagtcccagctcacctggacaggttttgctcatggagaaggctttgaggatggagaattttggaaggatgaacccagtgatgaggccccaatggagctgggactgaaggaacctgaggaggggacgttgaccttcccagctcagagcctcagcccagagccgttgccccaagaggaggagaagcttcccccacggaataccaacccagggatcaagtgtttcgccgtgcgctccctaggctgggtagagatgaccgaggaggagctggcccctggacgcagcagtgtggcagtcaacaattgcatccgtcagctctcttaccacaaaaacaacctgcatgaccccatgtctgggggctggggggaaggaaaggatctgctactgcagctggaggatgagacactaaagctagtggagccacagagccaggcactgctgcacgcccaacccatcatcagcatccgcgtgtggggcgtcgggcgggacagtggaagcaacagggactttgcctacgtagctcgtgataagctgacccagatgctcaagtgccacgtgtttcgctgtgaggcacctgccaagaacatcgccaccagcctgcatgagatctgctctaagatcatggccgaacggcgtaatgcccgctgcttggtaaatggactctccctggaccactctaaacttgtggatgtccctttccaagtggaattcccagcgcctaagaatgagttggtccagaagttccaagtctattacctggggaatgtacctgttgctaaacctgttggggtagatgtgattaatggggccctcgagtcagtcctgtcctccagcagccgtgaacaatggaccccaagtcatgtcagtgtggcccctgctaccctcaccatcttgcaccagcagacagaggcagtgctgggagagtgtcgggtgcgtttcctctccttcctggccgtgggcagagatgtccacacgtttgcattcatcatggctgccggcccagcctccttctgctgccacatgttctggtgcgagcccaatgctgccagcctctcagaggctgtgcaggctgcgtgcatgcttcgctaccagaagtgtctggatgcccgttcccaggcctccacctcctgcctcccagcaccccctgctgagtctgtggcacggcgtgtagggtggactgtccgcaggggtgttcagtcgctgtggggctccctgaagcccaaacggctgggggcccataccccatgaagaagcccccaccttccctccacctgcttgtgttgggccccagggaactaaagggtgtgggtcagggaggggtctagaggctattcctaggcctcaggcctcccaaatatgcccctccccagtagctacggttccctgcctaggagctggggagggagagatctaatcccttcaaggaagtgataacactggagtggtaacaagaggagcaggaagcaaggccagccctggttctccatccccatgtgtttcaggtggaacaggaggaactggtccaggccaggcctcatcctcctggacccagcaggggcagaaggaggaagggactggtccaggcatgggtcccttccccctgctccatgggcacctctgctgtattgatatcactaataaagtctgtctgcactgct

SEQ ID NO: 106987 - DNA, 1626 bp, Homo sapiens
  Payload ID: 1011
  Gene Symbol: APBB1
  Gene Name: amyloid beta (A4) precursor protein-binding, family B, member 1 (Fe65)
  Uniprot ID: O00213
  ENST ID: ENST00000530885
  CDS Start-End: 94-1560
gcttttctctgcagcccagcaccaggctgtgagcccagctggctgggctggaggggctgtgaggagggagggtggaggcaggaggggccgggaatgagcgccatgttctcccaggactttttcctggccattatcctgcaggacagcagcgcagattccttctggaaccccaacgccttcgagacggattccgacctgccggctggatggatgagggtccaggacacctcagggacctattactggcacatcccaacagggaccacccagtgggaaccccccggccgggcctccccctcacaggggagcagcccccaagaggagtcccagctcacctggacaggttttgctcatggagaaggctttgaggatggagaattttggaaggatgaacccagtgatgaggccccaatggagctgggactgaaggaacctgaggaggggacgttgaccttcccagctcagagcctcagcccagagccgttgccccaagaggaggagaagcttcccccacggaataccaacccagggatcaagtgtttcgccgtgcgctccctaggctgggtagagatgaccgaggaggagctggcccctggacgcagcagtgtggcagtcaacaattgcatccgtcagctctcttaccacaaaaacaacctgcatgaccccatgtctgggggctggggggaaggaaaggatctgctactgcagctggaggatgagacactaaagctagtggagccacagagccaggcactgctgcacgcccaacccatcatcagcatccgcgtgtggggcgtcgggcgggacagtggaagggactttgcctacgtagctcgtgataagctgacccagatgctcaagtgccacgtgtttcgctgtgaggcacctgccaagaacatcgccaccagcctgcatgagatctgctctaagatcatggccgaacggcgtaatgcccgctgcttggtaaatggactctccctggaccactctaaacttgtggatgtccctttccaagtggaattcccagcgcctaagaatgagttggtccagaagttccaagtctattacctggggaatgtacctgttgctaaacctgttggggtagatgtgattaatggggccctcgagtcagtcctgtcctccagcagccgtgaacaatggaccccaagtcatgtcagtgtggcccctgctaccctcaccatcttgcaccagcagacagaggcagtgctgggagagtgtcgggtgcgtttcctctccttcctggccgtgggcagagatgtccacacgtttgcattcatcatggctgccggcccagcctccttctgctgccacatgttctggtgcgagcccaatgctgccagcctctcagaggctgtgcaggctgcgtgcatgcttcgctaccagaagtgtctggatgcccgttcccaggcctccacctcctgcctcccagcaccccctgctgagtctgtggcacggcgtgtagggtggactgtccgcaggggtgttcagtcgctgtggggctccctgaagcccaaacggctgggggcccataccccatgaagaagcccccaccttccctccacctgcttgtgttgggccccagggaactaaagggtgtgggtcagg

SEQ ID NO: 106988 - DNA, 2128 bp, Homo sapiens
  Payload ID: 1011
  Gene Symbol: APBB1
  Gene Name: amyloid beta (A4) precursor protein-binding, family B, member 1 (Fe65)
  Uniprot ID: O00213
  ENST ID: ENST00000608394
  CDS Start-End: 382-1737
gagacgctgcagcctagctgggccctggcaggtgaggggtggggggtggtgctgggaagccccaagcccagcctcaagcttgctggggctcaggacctcaaagcccacccttgggttcaaactgctgtgcaggtcctggacaggggcgggatccctgaaggccttgaaaccacaccctatttatgctgacagctataggctctgcagggccccaggcagctggggtattccttaggggctgagtctcctggtatccctaagactgggcttggcttaggcactgaggactttttcctggccattatcctgcaggacagcagcgcagattccttctggaaccccaacgccttcgagacggattccgacctgccggctggatggatgagggtccaggacacctcagggacctattactggcacatcccaacagggaccacccagtgggaaccccccggccgggcctccccctcacaggggagcagcccccaagaggagtcccagctcacctggacaggttttgctcatggagaaggctttgaggatggagaattttggaaggatgaacccagtgatgaggccccaatggagctgggactgaaggaacctgaggaggggacgttgaccttcccagctcagagcctcagcccagagccgttgccccaagaggaggagaagcttcccccacggaataccaacccagggatcaagtgtttcgccgtgcgctccctaggctgggtagagatgaccgaggaggagctggcccctggacgcagcagtgtggcagtcaacaattgcatccgtcagctctcttaccacaaaaacaacctgcatgaccccatgtctgggggctggggggaaggaaaggatctgctactgcagctggaggatgagacactaaagctagtggagccacagagccaggcactgctgcacgcccaacccatcatcagcatccgcgtgtggggcgtcgggcgggacagtggaagagagagggactttgcctacgtagctcgtgataagctgacccagatgctcaagtgccacgtgtttcgctgtgaggcacctgccaagaacatcgccaccagcctgcatgagatctgctctaagatcatggccgaacggcgtaatgcccgctgcttggtaaatggactctccctggaccactctaaacttgtggatgtccctttccaagtggaattcccagcgcctaagaatgagttggtccagaagttccaagtctattacctggggaatgtacctgttgctaaacctgttggggtagatgtgattaatggggccctcgagtcagtcctgtcctccagcagccgtgaacaatggaccccaagtcatgtcagtgtggcccctgctaccctcaccatcttgcaccagcagacagaggcagtgctgggagagtgtcgggtgcgtttcctctccttcctggccgtgggcagagatgtccacacgtttgcattcatcatggctgccggcccagcctccttctgctgccacatgttctggtgcgagcccaatgctgccagcctctcagaggctgtgcaggctgcgtgcatgcttcgctaccagaagtgtctggatgcccgttcccaggcctccacctcctgcctcccagcaccccctgctgagtctgtggcacggcgtgtagggtggactgtccgcaggggtgttcagtcgctgtggggctccctgaagcccaaacggctgggggcccataccccatgaagaagcccccaccttccctccacctgcttgtgttgggccccagggaactaaagggtgtgggtcagggaggggtctagaggctattcctaggcctcaggcctcccaaatatgcccctccccagtagctacggttccctgcctaggagctggggagggagagatctaatcccttcaaggaagtgataacactggagtggtaacaagaggagcaggaagcaaggccagccctggttctccatccccatgtgtttcaggtggaacaggaggaactggtccaggccaggcctcatcctcctggacccagcaggggcagaaggaggaagggactggtccaggcatgggtcccttccccctgctccatgggcacctctgctgtattgatatcactaat

SEQ ID NO: 106989 - DNA, 1014 bp, Homo sapiens
  Payload ID: 1011
  Gene Symbol: APBB1
  Gene Name: amyloid beta (A4) precursor protein-binding, family B, member 1 (Fe65)
  ENST ID: ENST00000529890
  CDS Start-End: 230-1014
atgttctcccaggactttttcctggccattatcctgcaggacagcagcgcagtgtggccacattagccaccaacagggcccaggaggagacctgagccatgtcccctactggtggccccacatgtggtgactccagactataggctctaggcagaagcaggaactgtgttgtgattccttctggaaccccaacgccttcgagacggattccgacctgccggctggatggatgagggtccaggacacctcagggacctattactggcacatcccaacagggaccacccagtgggaaccccccggccgggcctccccctcacaggggagcagcccccaagaggagtcccagctcacctggacaggttttgctcatggagaaggctttgaggatggagaattttggaaggatgaacccagtgatgaggccccaatggagctgggactgaaggaacctgaggaggggacgttgaccttcccagctcagagcctcagcccagagccgttgccccaagaggaggagaagcttcccccacggaataccaacccagggatcaagtgtttcgccgtgcgctccctaggctgggtagagatgaccgaggaggagctggcccctggacgcagcagtgtggcagtcaacaattgcatccgtcagctctcttaccacaaaaacaacctgcatgaccccatgtctgggggctggggggaaggaaaggatctgctactgcagctggaggatgagacactaaagctagtggagccacagagccaggcactgctgcacgcccaacccatcatcagcatccgcgtgtggggcgtcgggcgggacagtggaagggactttgcctacgtagctcgtgataagctgacccagatgctcaagtgccacgtgtttcgctgtgaggcacctgccaagaacatcgccaccagcctgcatgagatctgctctaagatcatggccgaacggcgtaatgcccgctgcttggtaaatggactctccctggaccactctaaact

SEQ ID NO: 106990 - DNA, 1925 bp, Homo sapiens
  Payload ID: 1011
  Gene Symbol: APBB1
  Gene Name: amyloid beta (A4) precursor protein-binding, family B, member 1 (Fe65)
  Uniprot ID: O00213
  ENST ID: ENST00000608645
  CDS Start-End: 340-1695
gacgctgcagcctagctgggccctggcaggtgaggggtggggggtggtgctgggaagccccaagcccagcctcaagcttgctggggctcaggacctcaaagcccacccttgggttcaaactgctgtgcaggtcctggacaggggcgggatccctgaaggccttgaaaccacaccctatttatgctgacagctataggctctgcagggccccaggcagctggggtattccttaggggctgagtctcctggtatccctaagactgggcttggcttaggcactgagattccttctggaaccccaacgccttcgagacggattccgacctgccggctggatggatgagggtccaggacacctcagggacctattactggcacatcccaacagggaccacccagtgggaaccccccggccgggcctccccctcacaggggagcagcccccaagaggagtcccagctcacctggacaggttttgctcatggagaaggctttgaggatggagaattttggaaggatgaacccagtgatgaggccccaatggagctgggactgaaggaacctgaggaggggacgttgaccttcccagctcagagcctcagcccagagccgttgccccaagaggaggagaagcttcccccacggaataccaacccagggatcaagtgtttcgccgtgcgctccctaggctgggtagagatgaccgaggaggagctggcccctggacgcagcagtgtggcagtcaacaattgcatccgtcagctctcttaccacaaaaacaacctgcatgaccccatgtctgggggctggggggaaggaaaggatctgctactgcagctggaggatgagacactaaagctagtggagccacagagccaggcactgctgcacgcccaacccatcatcagcatccgcgtgtggggcgtcgggcgggacagtggaagagagagggactttgcctacgtagctcgtgataagctgacccagatgctcaagtgccacgtgtttcgctgtgaggcacctgccaagaacatcgccaccagcctgcatgagatctgctctaagatcatggccgaacggcgtaatgcccgctgcttggtaaatggactctccctggaccactctaaacttgtggatgtccctttccaagtggaattcccagcgcctaagaatgagttggtccagaagttccaagtctattacctggggaatgtacctgttgctaaacctgttggggtagatgtgattaatggggccctcgagtcagtcctgtcctccagcagccgtgaacaatggaccccaagtcatgtcagtgtggcccctgctaccctcaccatcttgcaccagcagacagaggcagtgctgggagagtgtcgggtgcgtttcctctccttcctggccgtgggcagagatgtccacacgtttgcattcatcatggctgccggcccagcctccttctgctgccacatgttctggtgcgagcccaatgctgccagcctctcagaggctgtgcaggctgcgtgcatgcttcgctaccagaagtgtctggatgcccgttcccaggcctccacctcctgcctcccagcaccccctgctgagtctgtggcacggcgtgtagggtggactgtccgcaggggtgttcagtcgctgtggggctccctgaagcccaaacggctgggggcccataccccatgaagaagcccccaccttccctccacctgcttgtgttgggccccagggaactaaagggtgtgggtcagggaggggtctagaggctattcctaggcctcaggcctcccaaatatgcccctccccagtagctacggttccctgcctaggagctggggagggagagatctaatcccttcaaggaagtgataacactggagtggtaacaagaggagcaggaagcaaggccagccctg

SEQ ID NO: 106991 - DNA, 424 bp, Homo sapiens
  Payload ID: 1011
  Gene Symbol: APBB1
  Gene Name: amyloid beta (A4) precursor protein-binding, family B, member 1 (Fe65)
  ENST ID: ENST00000532020
  CDS Start-End: 162-424
gcgcgctcctgggcgggggatgttgtgatggagaagccgcggcggagcccgaaccccgcagcctgagccacctccgtcatctgggcccggggcctcaccgcgcagattccttctggaaccccaacgccttcgagacggattccgacctgccggctggatggatgagggtccaggacacctcagggacctattactggcacatcccaacagggaccacccagtgggaaccccccggccgggcctccccctcacaggggagcagcccccaagaggagtcccagctcacctggacaggttttgctcatggagaaggctttgaggatggagaattttggaaggatgaacccagtgatgaggccccaatggagctgggactgaaggaacctgaggaggggacgttgaccttcccagctcagagcctcag

SEQ ID NO: 106992 - DNA, 2221 bp, Homo sapiens
  Payload ID: 1011
  Gene Symbol: APBB1
  Gene Name: amyloid beta (A4) precursor protein-binding, family B, member 1 (Fe65)
  ENST ID: ENST00000608435
  CDS Start-End: 102-2221
gatgttgtgatggagaagccgcggcggagcccgaaccccgcagcctgagccacctccgtcatctgggcccggggcctcaccgcgcaggagctgccaaggccatgtctgttccatcatcactgagccagtcggccattaatgccaacagccacggaggccccgcactgagcctacccctgcctctgcacgctgcccacaaccagctgctcaacgccaagctgcaggccacagctgtgggacccaaggacctgcgcagcgccatgggggagggtggtgggcctgagccaggccctgccaatgccaagtggctaaaagagggccagaaccagctccggcgggccgccacggcccaccgtgaccagaatcgcaatgtgaccttgaccttggcggaggaggccagccaggagcctgagatggcacccttgggccccaaaggcctgatacacctgtactctgagctggagctctcagctcacaacgcagccaaccgaggcctacgaggacctggcctgatcatcagcactcaagagcaggggccagatgagggagaggagaaggcggccggggaggccgaggaggaggaggaggatgatgatgatgaagaggaggaggaggacttatcttctcccccagggctgcctgagcccctggagagtgtggaggcccctcccaggccccaagcccttacagatggcccccgggaacacagcaagagtgccagcctcctgtttggcatgcggaacagtgcagccagtgatgaggactcaagctgggctaccttatcccagggcagcccctcctatggctccccagaggacacagattccttctggaaccccaacgccttcgagacggattccgacctgccggctggatggatgagggtccaggacacctcagggacctattactggcacatcccaacagggaccacccagtgggaaccccccggccgggcctccccctcacaggggagcagcccccaagaggagtcccagctcacctggacaggttttgctcatggagaaggctttgaggatggagaattttggaaggatgaacccagtgatgaggccccaatggagctgggactgaaggaacctgaggaggggacgttgaccttcccagctcagagcctcagcccagagccgttgccccaagaggaggagaagcttcccccacggaataccaacccagggatcaagtgtttcgccgtgcgctccctaggctgggtagagatgaccgaggaggagctggcccctggacgcagcagtgtggcagtcaacaattgcatccgtcagctctcttaccacaaaaacaacctgcatgaccccatgtctgggggctggggggaaggaaaggatctgctactgcagctggaggatgagacactaaagctagtggagccacagagccaggcactgctgcacgcccaacccatcatcagcatccgcgtgtggggcgtcgggcgggacagtggaagagagagggactttgcctacgtagctcgtgataagctgacccagatgctcaagtgccacgtgtttcgctgtgaggcacctgccaagaacatcgccaccagcctgcatgagatctgctctaagatcatggccgaacggcgtaatgcccgctgcttggtaaatggactctccctggaccactctaaacttgtggatgtccctttccaagtggaattcccagcgcctaagaatgagttggtccagaagttccaagtctattacctggggaatgtacctgttgctaaacctgttggggtagatgtgattaatggggccctcgagtcagtcctgtcctccagcagccgtgaacaatggaccccaagtcatgtcagtgtggcccctgctaccctcaccatcttgcaccagcagacagaggcagtgctgggagagtgtcgggtgcgtttcctctccttcctggccgtgggcagagatgtccacacgtttgcattcatcatggctgccggcccagcctccttctgctgccacatgttctggtgcgagcccaatgctgccagcctctcagaggctgtgcaggctgcgtgcatggtggaacaggaggaactggtccaggccaggcctcatcctcctggacccagcaggggcagaaggaggaagggactggtccaggcatgggtcccttccccctgctccatgggcacctctgctgtattgatatcactaataaagtctgtctgcactgc

SEQ ID NO: 106993 - DNA, 1920 bp, Homo sapiens
  Payload ID: 1011
  Gene Symbol: APBB1
  Gene Name: amyloid beta (A4) precursor protein-binding, family B, member 1 (Fe65)
  Uniprot ID: O00213
  ENST ID: ENST00000608655
  CDS Start-End: 39-1511
gctgtgaggagggagggtggaggcaggaggggccgggaatgagcgccatgttctcccaggactttttcctggccattatcctgcaggacagcagcgcagattccttctggaaccccaacgccttcgagacggattccgacctgccggctggatggatgagggtccaggacacctcagggacctattactggcacatcccaacagggaccacccagtgggaaccccccggccgggcctccccctcacaggggagcagcccccaagaggagtcccagctcacctggacaggttttgctcatggagaaggctttgaggatggagaattttggaaggatgaacccagtgatgaggccccaatggagctgggactgaaggaacctgaggaggggacgttgaccttcccagctcagagcctcagcccagagccgttgccccaagaggaggagaagcttcccccacggaataccaacccagggatcaagtgtttcgccgtgcgctccctaggctgggtagagatgaccgaggaggagctggcccctggacgcagcagtgtggcagtcaacaattgcatccgtcagctctcttaccacaaaaacaacctgcatgaccccatgtctgggggctggggggaaggaaaggatctgctactgcagctggaggatgagacactaaagctagtggagccacagagccaggcactgctgcacgcccaacccatcatcagcatccgcgtgtggggcgtcgggcgggacagtggaagagagagggactttgcctacgtagctcgtgataagctgacccagatgctcaagtgccacgtgtttcgctgtgaggcacctgccaagaacatcgccaccagcctgcatgagatctgctctaagatcatggccgaacggcgtaatgcccgctgcttggtaaatggactctccctggaccactctaaacttgtggatgtccctttccaagtggaattcccagcgcctaagaatgagttggtccagaagttccaagtctattacctggggaatgtacctgttgctaaacctgttggggtagatgtgattaatggggccctcgagtcagtcctgtcctccagcagccgtgaacaatggaccccaagtcatgtcagtgtggcccctgctaccctcaccatcttgcaccagcagacagaggcagtgctgggagagtgtcgggtgcgtttcctctccttcctggccgtgggcagagatgtccacacgtttgcattcatcatggctgccggcccagcctccttctgctgccacatgttctggtgcgagcccaatgctgccagcctctcagaggctgtgcaggctgcgtgcatgcttcgctaccagaagtgtctggatgcccgttcccaggcctccacctcctgcctcccagcaccccctgctgagtctgtggcacggcgtgtagggtggactgtccgcaggggtgttcagtcgctgtggggctccctgaagcccaaacggctgggggcccataccccatgaagaagcccccaccttccctccacctgcttgtgttgggccccagggaactaaagggtgtgggtcagggaggggtctagaggctattcctaggcctcaggcctcccaaatatgcccctccccagtagctacggttccctgcctaggagctggggagggagagatctaatcccttcaaggaagtgataacactggagtggtaacaagaggagcaggaagcaaggccagccctggttctccatccccatgtgtttcaggtggaacaggaggaactggtccaggccaggcctcatcctcctggacccagcaggggcagaaggaggaagggactggtccaggcatgggtcccttccccctgctccatgggcacctctgctgtattgatatcactaataaagtctgtctgcactgc

SEQ ID NO: 106994 - DNA, 2095 bp, Homo sapiens
  Payload ID: 1011
  Gene Symbol: APBB1
  Gene Name: amyloid beta (A4) precursor protein-binding, family B, member 1 (Fe65)
  Uniprot ID: O00213
  ENST ID: ENST00000608704
  CDS Start-End: 331-1686
tttggaagctgaggatggtgaagcaccctgcctgaataactctcgtcaggtgtgcagccaccttggcgtaaccacgcccactcccagccctgctgtgtctggttgcccagcagcagggtcttgggactgcctgtcccttagtactgcctcttggaccagtcaggattcctggtttccctggtaacgggaagcacgtcagcagtctgggcgctcccagccggtcctggtgctgcggttgccgaggagacgctgcagcctagctgggccctggcagattccttctggaaccccaacgccttcgagacggattccgacctgccggctggatggatgagggtccaggacacctcagggacctattactggcacatcccaacagggaccacccagtgggaaccccccggccgggcctccccctcacaggggagcagcccccaagaggagtcccagctcacctggacaggttttgctcatggagaaggctttgaggatggagaattttggaaggatgaacccagtgatgaggccccaatggagctgggactgaaggaacctgaggaggggacgttgaccttcccagctcagagcctcagcccagagccgttgccccaagaggaggagaagcttcccccacggaataccaacccagggatcaagtgtttcgccgtgcgctccctaggctgggtagagatgaccgaggaggagctggcccctggacgcagcagtgtggcagtcaacaattgcatccgtcagctctcttaccacaaaaacaacctgcatgaccccatgtctgggggctggggggaaggaaaggatctgctactgcagctggaggatgagacactaaagctagtggagccacagagccaggcactgctgcacgcccaacccatcatcagcatccgcgtgtggggcgtcgggcgggacagtggaagagagagggactttgcctacgtagctcgtgataagctgacccagatgctcaagtgccacgtgtttcgctgtgaggcacctgccaagaacatcgccaccagcctgcatgagatctgctctaagatcatggccgaacggcgtaatgcccgctgcttggtaaatggactctccctggaccactctaaacttgtggatgtccctttccaagtggaattcccagcgcctaagaatgagttggtccagaagttccaagtctattacctggggaatgtacctgttgctaaacctgttggggtagatgtgattaatggggccctcgagtcagtcctgtcctccagcagccgtgaacaatggaccccaagtcatgtcagtgtggcccctgctaccctcaccatcttgcaccagcagacagaggcagtgctgggagagtgtcgggtgcgtttcctctccttcctggccgtgggcagagatgtccacacgtttgcattcatcatggctgccggcccagcctccttctgctgccacatgttctggtgcgagcccaatgctgccagcctctcagaggctgtgcaggctgcgtgcatgcttcgctaccagaagtgtctggatgcccgttcccaggcctccacctcctgcctcccagcaccccctgctgagtctgtggcacggcgtgtagggtggactgtccgcaggggtgttcagtcgctgtggggctccctgaagcccaaacggctgggggcccataccccatgaagaagcccccaccttccctccacctgcttgtgttgggccccagggaactaaagggtgtgggtcagggaggggtctagaggctattcctaggcctcaggcctcccaaatatgcccctccccagtagctacggttccctgcctaggagctggggagggagagatctaatcccttcaaggaagtgataacactggagtggtaacaagaggagcaggaagcaaggccagccctggttctccatccccatgtgtttcaggtggaacaggaggaactggtccaggccaggcctcatcctcctggacccagcaggggcagaaggaggaagggactggtccaggcatgggtcccttccccctgctccatgggcacctctgctgtattgatatcactaataaagtctgtctgcactgc

SEQ ID NO: 106995 - DNA, 1442 bp, Homo sapiens
  Payload ID: 1011
  Gene Symbol: APBB1
  Gene Name: amyloid beta (A4) precursor protein-binding, family B, member 1 (Fe65)
  ENST ID: ENST00000529519
  CDS Start-End: 364-1071
ggtcctggtgctgcggttgccgaggagacgctgcagcctagctgggccctggcagctcacctggacaggttttgctcatggagaaggctttgaggatggagaattttggaaggatgaacccagtgatgaggccccaatggagctgggactgaaggaacctgaggaggggacgttgaccttcccagctcagagcctcagggaaaggatctgctactgcagctggaggatgagacactaaagctagtggagccacagagccaggcactgctgcacgcccaacccatcatcagcatccgcgtgtggggcgtcgggcgggacagtggaagggactttgcctacgtagctcgtgataagctgacccagatgctcaagtgccacgtgtttcgctgtgaggcacctgccaagaacatcgccaccagcctgcatgagatctgctctaagatcatggccgaacggcgtaatgcccgctgcttggtaaatggactctccctggaccactctaaacttgtggatgtccctttccaagtggaattcccagcgcctaagaatgagttggtccagaagttccaagtctattacctggggaatgtacctgttgctaaacctgttggggtagatgtgattaatggggccctcgagtcagtcctgtcctccagcagccgtgaacaatggaccccaagtcatgtcagtgtggcccctgctaccctcaccatcttgcaccagcagacagaggcagtgctgggagagtgtcgggtgcgtttcctctccttcctggccgtgggcagagatgtccacacgtttgcattcatcatggctgccggcccagcctccttctgctgccacatgttctggtgcgagcccaatgctgccagcctctcagaggctgtgcaggctgcgtgcatgcttcgctaccagaagtgtctggatgcccgttcccaggcctccacctcctgcctcccagcaccccctgctgagtctgtggcacggcgtgtagggtggactgtccgcaggggtgttcagtcgctgtggggctccctgaagcccaaacggctgggggcccataccccatgaagaagcccccaccttccctccacctgcttgtgttgggccccagggaactaaagggtgtgggtcagggaggggtctagaggctattcctaggcctcaggcctcccaaatatgcccctccccagtagctacggttccctgcctaggagctggggagggagagatctaatcccttcaaggaagtgataacactggagtggtaacaagaggagcaggaagcaaggccagccctggttctccatccccatgtgtttcaggtggaacaggaggaactggtccaggccaggcctcatcctcctggacccagcaggggcagaaggaggaagggactggtccaggcatgggtcccttccccctgctccatgggcacctct

SEQ ID NO: 106996 - DNA, 1574 bp, Homo sapiens
  Payload ID: 1011
  Gene Symbol: APBB1
  Gene Name: amyloid beta (A4) precursor protein-binding, family B, member 1 (Fe65)
  Uniprot ID: O00213
  ENST ID: ENST00000609331
  CDS Start-End: 43-1470
acagggttggagtggtgtggctctgccggcagacaagggtgtatgacacagatgcgagattccttctggaaccccaacgccttcgagacggattccgacctgccggctggatggatgagggtccaggacacctcagggacctattactggcacatcccaacagggaccacccagtgggaaccccccggccgggcctccccctcacaggggagcagcccccaagaggagtcccagctcacctggacaggttttgctcatggagaaggctttgaggatggagaattttggaaggatgaacccagtgatgaggccccaatggagctgggactgaaggaacctgaggaggggacgttgaccttcccagctcagagcctcagcccagagccgttgccccaagaggaggagaagcttcccccacggaataccaacccagggatcaagtgtttcgccgtgcgctccctaggctgggtagagatgaccgaggaggagctggcccctggacgcagcagtgtggcagtcaacaattgcatccgtcagctctcttaccacaaaaacaacctgcatgaccccatgtctgggggctggggggaaggaaaggatctgctactgcagctggaggatgagacactaaagctagtggagccacagagccaggcactgctgcacgcccaacccatcatcagcatccgcgtgtggggcgtcgggcgggacagtggaagagagagggactttgcctacgtagctcgtgataagctgacccagatgctcaagtgccacgtgtttcgctgtgaggcacctgccaagaacatcgccaccagcctgcatgagatctgctctaagatcatggccgaacggcgtaatgcccgctgcttggtaaatggactctccctggaccactctaaacttgtggatgtccctttccaagtggaattcccagcgcctaagaatgagttggtccagaagttccaagtctattacctggggaatgtacctgttgctaaacctgttggggtagatgtgattaatggggccctcgagtcagtcctgtcctccagcagccgtgaacaatggaccccaagtcatgtcagtgtggcccctgctaccctcaccatcttgcaccagcagacagaggcagtgctgggagagtgtcgggtgcgtttcctctccttcctggccgtgggcagagatgtccacacgtttgcattcatcatggctgccggcccagcctccttctgctgccacatgttctggtgcgagcccaatgctgccagcctctcagaggctgtgcaggctgcgtgcatgcttcgctaccagaagtgtctggatgcccgttcccaggcctccacctcctgcctcccagcaccccctgctgagtctgtggcacggcgtgtagggtggactgtccgcaggggtgttcagtcgctgtggggctccctgaagcccaaacggctgggggcccataccccatgaagaagcccccaccttccctccacctgcttgtgttgggccccagggaactaaagggtgtgggtcagggaggggtctagaggctattcctaggcctcaggcctccc

SEQ ID NO: 106997 - DNA, 2642 bp, Homo sapiens
  Payload ID: 1011
  Gene Symbol: APBB1
  Gene Name: amyloid beta (A4) precursor protein-binding, family B, member 1 (Fe65)
  Uniprot ID: O00213
  ENST ID: ENST00000609360
  CDS Start-End: 101-2233
atgttgtgatggagaagccgcggcggagcccgaaccccgcagcctgagccacctccgtcatctgggcccggggcctcaccgcgcaggagctgccaaggccatgtctgttccatcatcactgagccagtcggccattaatgccaacagccacggaggccccgcactgagcctacccctgcctctgcacgctgcccacaaccagctgctcaacgccaagctgcaggccacagctgtgggacccaaggacctgcgcagcgccatgggggagggtggtgggcctgagccaggccctgccaatgccaagtggctaaaagagggccagaaccagctccggcgggccgccacggcccaccgtgaccagaatcgcaatgtgaccttgaccttggcggaggaggccagccaggagcctgagatggcacccttgggccccaaaggcctgatacacctgtactctgagctggagctctcagctcacaacgcagccaaccgaggcctacgaggacctggcctgatcatcagcactcaagagcaggggccagatgagggagaggagaaggcggccggggaggccgaggaggaggaggaggatgatgatgatgaagaggaggaggaggacttatcttctcccccagggctgcctgagcccctggagagtgtggaggcccctcccaggccccaagcccttacagatggcccccgggaacacagcaagagtgccagcctcctgtttggcatgcggaacagtgcagccagtgatgaggactcaagctgggctaccttatcccagggcagcccctcctatggctccccagaggacacagattccttctggaaccccaacgccttcgagacggattccgacctgccggctggatggatgagggtccaggacacctcagggacctattactggcacatcccaacagggaccacccagtgggaaccccccggccgggcctccccctcacaggggagcagcccccaagaggagtcccagctcacctggacaggttttgctcatggagaaggctttgaggatggagaattttggaaggatgaacccagtgatgaggccccaatggagctgggactgaaggaacctgaggaggggacgttgaccttcccagctcagagcctcagcccagagccgttgccccaagaggaggagaagcttcccccacggaataccaacccagggatcaagtgtttcgccgtgcgctccctaggctgggtagagatgaccgaggaggagctggcccctggacgcagcagtgtggcagtcaacaattgcatccgtcagctctcttaccacaaaaacaacctgcatgaccccatgtctgggggctggggggaaggaaaggatctgctactgcagctggaggatgagacactaaagctagtggagccacagagccaggcactgctgcacgcccaacccatcatcagcatccgcgtgtggggcgtcgggcgggacagtggaagagagagggactttgcctacgtagctcgtgataagctgacccagatgctcaagtgccacgtgtttcgctgtgaggcacctgccaagaacatcgccaccagcctgcatgagatctgctctaagatcatggccgaacggcgtaatgcccgctgcttggtaaatggactctccctggaccactctaaacttgtggatgtccctttccaagtggaattcccagcgcctaagaatgagttggtccagaagttccaagtctattacctggggaatgtacctgttgctaaacctgttggggtagatgtgattaatggggccctcgagtcagtcctgtcctccagcagccgtgaacaatggaccccaagtcatgtcagtgtggcccctgctaccctcaccatcttgcaccagcagacagaggcagtgctgggagagtgtcgggtgcgtttcctctccttcctggccgtgggcagagatgtccacacgtttgcattcatcatggctgccggcccagcctccttctgctgccacatgttctggtgcgagcccaatgctgccagcctctcagaggctgtgcaggctgcgtgcatgcttcgctaccagaagtgtctggatgcccgttcccaggcctccacctcctgcctcccagcaccccctgctgagtctgtggcacggcgtgtagggtggactgtccgcaggggtgttcagtcgctgtggggctccctgaagcccaaacggctgggggcccataccccatgaagaagcccccaccttccctccacctgcttgtgttgggccccagggaactaaagggtgtgggtcagggaggggtctagaggctattcctaggcctcaggcctcccaaatatgcccctccccagtagctacggttccctgcctaggagctggggagggagagatctaatcccttcaaggaagtgataacactggagtggtaacaagaggagcaggaagcaaggccagccctggttctccatccccatgtgtttcaggtggaacaggaggaactggtccaggccaggcctcatcctcctggacccagcaggggcagaaggaggaagggactggtccaggcatgggtcccttccccctgctccatgggcacctctgctgtattgatatcactaataaagtctgtctgcactgc

SEQ ID NO: 106998 - DNA, 1907 bp, Homo sapiens
  Payload ID: 1011
  Gene Symbol: APBB1
  Gene Name: amyloid beta (A4) precursor protein-binding, family B, member 1 (Fe65)
  ENST ID: ENST00000621678
  CDS Start-End: 70-1497
aagagttagaggacgcatgagcgggttacagggttggagtggtgtggctctgccggcagacaagggtgtatgacacagatgcgagattccttctggaaccccaacgccttcgagacggattccgacctgccggctggatggatgagggtccaggacacctcagggacctattactggcacatcccaacagggaccacccagtgggaaccccccggccgggcctccccctcacaggggagcagcccccaagaggagtcccagctcacctggacaggttttgctcatggagaaggctttgaggatggagaattttggaaggatgaacccagtgatgaggccccaatggagctgggactgaaggaacctgaggaggggacgttgaccttcccagctcagagcctcagcccagagccgttgccccaagaggaggagaagcttcccccacggaataccaacccagggatcaagtgtttcgccgtgcgctccctaggctgggtagagatgaccgaggaggagctggcccctggacgcagcagtgtggcagtcaacaattgcatccgtcagctctcttaccacaaaaacaacctgcatgaccccatgtctgggggctggggggaaggaaaggatctgctactgcagctggaggatgagacactaaagctagtggagccacagagccaggcactgctgcacgcccaacccatcatcagcatccgcgtgtggggcgtcgggcgggacagtggaagcaacagggactttgcctacgtagctcgtgataagctgacccagatgctcaagtgccacgtgtttcgctgtgaggcacctgccaagaacatcgccaccagcctgcatgagatctgctctaagatcatggccgaacggcgtaatgcccgctgcttggtaaatggactctccctggaccactctaaacttgtggatgtccctttccaagtggaattcccagcgcctaagaatgagttggtccagaagttccaagtctattacctggggaatgtacctgttgctaaacctgttggggtagatgtgattaatggggccctcgagtcagtcctgtcctccagcagccgtgaacaatggaccccaagtcatgtcagtgtggcccctgctaccctcaccatcttgcaccagcagacagaggcagtgctgggagagtgtcgggtgcgtttcctctccttcctggccgtgggcagagatgtccacacgtttgcattcatcatggctgccggcccagcctccttctgctgccacatgttctggtgcgagcccaatgctgccagcctctcagaggctgtgcaggctgcgtgcatgcttcgctaccagaagtgtctggatgcccgttcccaggcctccacctcctgcctcccagcaccccctgctgagtctgtggcacggcgtgtagggtggactgtccgcaggggtgttcagtcgctgtggggctccctgaagcccaaacggctgggggcccataccccatgaagaagcccccaccttccctccacctgcttgtgttgggccccagggaactaaagggtgtgggtcagggaggggtctagaggctattcctaggcctcaggcctcccaaatatgcccctccccagtagctacggttccctgcctaggagctggggagggagagatctaatcccttcaaggaagtgataacactggagtggtaacaagaggagcaggaagcaaggccagccctggttctccatccccatgtgtttcaggtggaacaggaggaactggtccaggccaggcctcatcctcctggacccagcaggggcagaaggaggaagggactggtccaggcatgggtcccttccccctgctccatgggcacctctgctgtattgatatcactaataaagtctgtctgcactgct

SEQ ID NO: 106999 - DNA, 2147 bp, Homo sapiens
  Payload ID: 1011
  Gene Symbol: APBB1
  Gene Name: amyloid beta (A4) precursor protein-binding, family B, member 1 (Fe65)
  ENST ID: ENST00000610474
  CDS Start-End: 382-1737
gagacgctgcagcctagctgggccctggcaggtgaggggtggggggtggtgctgggaagccccaagcccagcctcaagcttgctggggctcaggacctcaaagcccacccttgggttcaaactgctgtgcaggtcctggacaggggcgggatccctgaaggccttgaaaccacaccctatttatgctgacagctataggctctgcagggccccaggcagctggggtattccttaggggctgagtctcctggtatccctaagactgggcttggcttaggcactgaggactttttcctggccattatcctgcaggacagcagcgcagattccttctggaaccccaacgccttcgagacggattccgacctgccggctggatggatgagggtccaggacacctcagggacctattactggcacatcccaacagggaccacccagtgggaaccccccggccgggcctccccctcacaggggagcagcccccaagaggagtcccagctcacctggacaggttttgctcatggagaaggctttgaggatggagaattttggaaggatgaacccagtgatgaggccccaatggagctgggactgaaggaacctgaggaggggacgttgaccttcccagctcagagcctcagcccagagccgttgccccaagaggaggagaagcttcccccacggaataccaacccagggatcaagtgtttcgccgtgcgctccctaggctgggtagagatgaccgaggaggagctggcccctggacgcagcagtgtggcagtcaacaattgcatccgtcagctctcttaccacaaaaacaacctgcatgaccccatgtctgggggctggggggaaggaaaggatctgctactgcagctggaggatgagacactaaagctagtggagccacagagccaggcactgctgcacgcccaacccatcatcagcatccgcgtgtggggcgtcgggcgggacagtggaagcaacagggactttgcctacgtagctcgtgataagctgacccagatgctcaagtgccacgtgtttcgctgtgaggcacctgccaagaacatcgccaccagcctgcatgagatctgctctaagatcatggccgaacggcgtaatgcccgctgcttggtaaatggactctccctggaccactctaaacttgtggatgtccctttccaagtggaattcccagcgcctaagaatgagttggtccagaagttccaagtctattacctggggaatgtacctgttgctaaacctgttggggtagatgtgattaatggggccctcgagtcagtcctgtcctccagcagccgtgaacaatggaccccaagtcatgtcagtgtggcccctgctaccctcaccatcttgcaccagcagacagaggcagtgctgggagagtgtcgggtgcgtttcctctccttcctggccgtgggcagagatgtccacacgtttgcattcatcatggctgccggcccagcctccttctgctgccacatgttctggtgcgagcccaatgctgccagcctctcagaggctgtgcaggctgcgtgcatgcttcgctaccagaagtgtctggatgcccgttcccaggcctccacctcctgcctcccagcaccccctgctgagtctgtggcacggcgtgtagggtggactgtccgcaggggtgttcagtcgctgtggggctccctgaagcccaaacggctgggggcccataccccatgaagaagcccccaccttccctccacctgcttgtgttgggccccagggaactaaagggtgtgggtcagggaggggtctagaggctattcctaggcctcaggcctcccaaatatgcccctccccagtagctacggttccctgcctaggagctggggagggagagatctaatcccttcaaggaagtgataacactggagtggtaacaagaggagcaggaagcaaggccagccctggttctccatccccatgtgtttcaggtggaacaggaggaactggtccaggccaggcctcatcctcctggacccagcaggggcagaaggaggaagggactggtccaggcatgggtcccttccccctgctccatgggcacctctgctgtattgatatcactaataaagtctgtctgcactgct

SEQ ID NO: 107000 - DNA, 2107 bp, Homo sapiens
  Payload ID: 1011
  Gene Symbol: APBB1
  Gene Name: amyloid beta (A4) precursor protein-binding, family B, member 1 (Fe65)
  ENST ID: ENST00000618005
  CDS Start-End: 342-1697
gagacgctgcagcctagctgggccctggcaggtgaggggtggggggtggtgctgggaagccccaagcccagcctcaagcttgctggggctcaggacctcaaagcccacccttgggttcaaactgctgtgcaggtcctggacaggggcgggatccctgaaggccttgaaaccacaccctatttatgctgacagctataggctctgcagggccccaggcagctggggtattccttaggggctgagtctcctggtatccctaagactgggcttggcttaggcactgagattccttctggaaccccaacgccttcgagacggattccgacctgccggctggatggatgagggtccaggacacctcagggacctattactggcacatcccaacagggaccacccagtgggaaccccccggccgggcctccccctcacaggggagcagcccccaagaggagtcccagctcacctggacaggttttgctcatggagaaggctttgaggatggagaattttggaaggatgaacccagtgatgaggccccaatggagctgggactgaaggaacctgaggaggggacgttgaccttcccagctcagagcctcagcccagagccgttgccccaagaggaggagaagcttcccccacggaataccaacccagggatcaagtgtttcgccgtgcgctccctaggctgggtagagatgaccgaggaggagctggcccctggacgcagcagtgtggcagtcaacaattgcatccgtcagctctcttaccacaaaaacaacctgcatgaccccatgtctgggggctggggggaaggaaaggatctgctactgcagctggaggatgagacactaaagctagtggagccacagagccaggcactgctgcacgcccaacccatcatcagcatccgcgtgtggggcgtcgggcgggacagtggaagcaacagggactttgcctacgtagctcgtgataagctgacccagatgctcaagtgccacgtgtttcgctgtgaggcacctgccaagaacatcgccaccagcctgcatgagatctgctctaagatcatggccgaacggcgtaatgcccgctgcttggtaaatggactctccctggaccactctaaacttgtggatgtccctttccaagtggaattcccagcgcctaagaatgagttggtccagaagttccaagtctattacctggggaatgtacctgttgctaaacctgttggggtagatgtgattaatggggccctcgagtcagtcctgtcctccagcagccgtgaacaatggaccccaagtcatgtcagtgtggcccctgctaccctcaccatcttgcaccagcagacagaggcagtgctgggagagtgtcgggtgcgtttcctctccttcctggccgtgggcagagatgtccacacgtttgcattcatcatggctgccggcccagcctccttctgctgccacatgttctggtgcgagcccaatgctgccagcctctcagaggctgtgcaggctgcgtgcatgcttcgctaccagaagtgtctggatgcccgttcccaggcctccacctcctgcctcccagcaccccctgctgagtctgtggcacggcgtgtagggtggactgtccgcaggggtgttcagtcgctgtggggctccctgaagcccaaacggctgggggcccataccccatgaagaagcccccaccttccctccacctgcttgtgttgggccccagggaactaaagggtgtgggtcagggaggggtctagaggctattcctaggcctcaggcctcccaaatatgcccctccccagtagctacggttccctgcctaggagctggggagggagagatctaatcccttcaaggaagtgataacactggagtggtaacaagaggagcaggaagcaaggccagccctggttctccatccccatgtgtttcaggtggaacaggaggaactggtccaggccaggcctcatcctcctggacccagcaggggcagaaggaggaagggactggtccaggcatgggtcccttccccctgctccatgggcacctctgctgtattgatatcactaataaagtctgtctgcactgct

SEQ ID NO: 107001 - DNA, 1513 bp, Homo sapiens
  Payload ID: 1012
  Gene Symbol: APBB1IP
  Gene Name: amyloid beta (A4) precursor protein-binding, family B, member 1 interacting protein
  Uniprot ID: Q7Z5R6
  ENST ID: ENST00000356785
  CDS Start-End: 234-752
cgctcctgagagaagggcgcgcgcggcacaggggccttccttgcacctcggagcaaagcagctcggatagcgccacacgtctgcgcgctgcgtgggaagggcagggctgacagcacttcctccccggggcagcgacctggagcccgggtgcggcagtctgcaccgcgcgtcgctttcccggccggagtctcgccgccttcccgcgccccgcagcgccccgcagagcagtcgagatgggtgagtcaagtgaagacatagaccaaatgttcagcactttgctgggagagatggatcttctgactcagagtttaggagttgacactctccctcctcctgaccctaatccacccagagctgaatttaactacagtgtggggtttaaagatttaaatgagtccttaaatgcactggaagaccaagatttagatgctctcatggcagatctggtagcagacataagtgaggctgagcagaggacaatccaggcacagaaagagtccttgcagaatcaacatcattcagcatctctacaagcatcaattttcagtggtgcagcctctcttggttatggaacaaatgttgctgccactggtatcagccaatatgaggatgacttaccacctccaccagccgatcctgtgttagaccttccactgccaccaccacctcctgaacctctctctcaggtaagtatgtgggaccagagatggcaggaccatcaacctctgctacctatcactgatgttccttgaagtgatcattacattcctaagttggtacatccaaagatctgagatactaaaaaacaaagatacagagcacgctcattgcaaagctagaaccctccgtaagcaagccacatgggtgtgtatcaagaatgtattagggccatattcaggatttactgtagtttgcttaaaaaatatttgtatgcaaaaactatttgataaaactcaatcttttgggggaaatgttttattaacatcatattgaaatgtggaactgattatatatttccatgtccctgttcttagctcagtacatagagaatagaaggcattcattatacattttctgagtagagtgaaattgaattttgttgaacttggcagccctgttcagtaggacaggtacatccaagtatcacttgtaatgtcatagttggggagggtgttacaaagcaggcagatgatgggtgcttgatattgataaatttctgaatattgaaaaacagacaactggaaagtttaaatgatcattatttgggatgttaactcatagtatgtctctcataaaagtaaaaagagcacttttaaggattttctttttagagtaagccaaatattttagaggagagtccagttcaatttcctgtggcttctacaatggtcacactgtgtcatgatgtttggtactcacaaataagaccctagggaccccgaaaggtcatacaatgccttttgaatgaacaaatattgaatataaatcaaatattaaattatactctatcaca

SEQ ID NO: 107002 - DNA, 2771 bp, Homo sapiens
  Payload ID: 1012
  Gene Symbol: APBB1IP
  Gene Name: amyloid beta (A4) precursor protein-binding, family B, member 1 interacting protein
  Uniprot ID: Q7Z5R6
  ENST ID: ENST00000376236
  CDS Start-End: 456-2456
agtccagccctgcaccgcgtcccctgagggcgggctgcaggcggccgggaagccttgcacaaccggcccaaaagaggaagcccagaaagtgctgaagtaaacactttgggagaccgttgcaacataaagcggcctctcagtctttggtggaaccatcactaggccccaatcccttagtccctcttgcgtcgaggctgcaaaatggttccattcgccaggagacgctcctgagagaagggcgcgcgcggcacaggggccttccttgcacctcggagcaaagcagctcggatagcgccacacgtctgcgcgctgcgtgggaagggcagggctgacagcacttcctccccggggcagcgacctggagcccgggtgcggcagtctgcaccgcgcgtcgctttcccggccggagtctcgccgccttcccgcgccccgcagcgccccgcagagcagtcgagatgggtgagtcaagtgaagacatagaccaaatgttcagcactttgctgggagagatggatcttctgactcagagtttaggagttgacactctccctcctcctgaccctaatccacccagagctgaatttaactacagtgtggggtttaaagatttaaatgagtccttaaatgcactggaagaccaagatttagatgctctcatggcagatctggtagcagacataagtgaggctgagcagaggacaatccaggcacagaaagagtccttgcagaatcaacatcattcagcatctctacaagcatcaattttcagtggtgcagcctctcttggttatggaacaaatgttgctgccactggtatcagccaatatgaggatgacttaccacctccaccagccgatcctgtgttagaccttccactgccaccaccacctcctgaacctctctctcaggaagaggaagaagcccaagccaaggctgataaaattaagctggcgctggaaaaactgaaggaggccaaggttaagaagctcgtcgtcaaggtgcacatgaatgataacagcacaaagtcactgatggtggatgagcggcagctggcccgagatgttctggacaaccttttcgagaaaactcattgtgactgcaatgtagactggtgtctttatgaaatctacccggaactacaaattgagaggttttttgaagaccatgaaaatgttgttgaagtcttatcagactggacaagagacacagaaaataaaatactatttttggagaaagaggagaaatatgctgtatttaaaaacccccagaatttctacttggataacagaggaaaaaaagaaagcaaggaaactaatgagaaaatgaatgctaagaacaaggaatccttacttgaggaaagtttctgtggaacatctatcattgtaccagaactggaaggagctctttatttgaaagaagatggaaagaaatcctggaaaaggcgctattttcttttacgggcttctggaatttattatgtacccaaaggaaagactaagacatctcgagatctggcgtgttttatacagtttgaaaatgtcaacatttactatgggactcagcataaaatgaaatataaagcgcccactgactattgctttgttttaaagcacccccaaattcagaaggagtcccagtatatcaagtatctctgctgtgatgacacaagaacccttaaccagtgggtcatgggaatacggatagccaagtatgggaagactctctatgataactaccagcgggctgtggcaaaggctggacttgcctctcggtggacaaacttggggacagtcaatgcagctgcaccagctcagccatctacaggacctaaaacaggcaccacccagcccaatggacagattccccaggctacacattctgtcagtgctgttctccaagaggcccagagacatgctgaaacatcgaaggataagaagccagccctcgggaaccaccacgacccggcagtgccccgggccccgcacgcccccaagtccagcctgcccccgccccctccggtgcggaggtcctccgacaccagcggcagtcccgccacgcccctcaaggccaagggcacaggcggcgggggcttgcccgccccacccgacgacttcctgccgccgccgccaccgccgccgcccctcgatgaccctgagctcccgccgccgcccccggacttcatggagccgcccccagacttcgtgcccccgcccccgccgtcgtacgcagggatcgcgggctcagagctgcccccgccgccgccgccgccgcccgcgcccgcgcccgcccccgtccccgactccgccaggccgccccccgcggtggccaagaggcctcctgtgccccccaagaggcaagagaacccagggcaccccggcggagcaggaggcggggagcaagatttcatgtcagacctcatgaaagctttgcaaaagaagagaggcaacgtgtcctagggacgggcatgatgagtgttccagagggagaagcatcgctgaccccgagcgcaggttttgctagcagattgccctgacatcttgttcatttcagataaaatgtgatgggaaacttctcactgatgtgctcaagtacaggcataaccattaacccagtagagttcagaatatctgcccaaatgtacatatcgttcccatgtattttaacctaaatggaatgtatcttcccttccaagctgcctaaagcgctgttttaggttcatttattttattatgttcagaagcatcaaataaaagttaaacgtttttccggaa

SEQ ID NO: 107003 - DNA, 8972 bp, Homo sapiens
  Payload ID: 1013
  Gene Symbol: APBB2
  Gene Name: amyloid beta (A4) precursor protein-binding, family B, member 2
  Uniprot ID: Q92870
  ENST ID: ENST00000295974
  CDS Start-End: 631-2907
gccaaagcctggagaagtggaatctcgtcagcgccgctccctgcgcgggactcgcggaacggcactgagcatgctcagttgccggagcccgttctggtctcaagtaggaagctagtgcgctgtaaccgcatctgatctgggcgctccgggaagggcgagactggagcagagccgctgggcgccggagccgaggcgagcgccgcgcgcaccactggttggagttgctgtgggtgagctgctgtggtctgtagccaagcatgctgtggtcggatctgcccagccgtggaacagaaacatttgctggatggaaaatccataaaagaaagctcctgtgaaaagctgaggctgacaataatttaagcaaaatcagatcgatctctttgggctgcctgacctccttgggtgcttgctattaattaacagactttgtggggaaaaaaaggagcttgccttctgagctttgtaccaaagacctgggaaaactaaccatctcagtctttcctgaggacttgggaactgccgaggcctctgccaatgtgttgactgtcgctatgggctcactgttgtccaggcagctcatatttcaaattataacctatttcctgcaccattgctgacgcctggtgatccatgtcagaagtacttccagctgactcaggtgttgacaccttggcagtgtttatggccagcagcggaactacagacgtcacaaatcggaacagcccagccacaccaccaaacacccttaacctccgatcctcccacaatgaactgttgaacgctgaaataaaacacacagaaaccaagaacagcacacctcccaaatgcaggaaaaaatatgcactaactaacatccaggcggccatgggcctctcggatccagctgcacagcccctgctgggaaatggctctgccaacatcaagctggtgaaaaatggggagaaccagctccgtaaggctgcagagcaagggcagcaggaccccaacaaaaacctgagccccactgcagtcatcaacataacttctgagaagttagagggtaaagagccccacccacaggattcctcgagctgtgagattttaccctcccagcccaggagaactaagagcttcctaaattactatgcagatctggaaacctcagccagagaactagagcagaaccgaggcaatcaccatgggactgcggaagagaaatcccagccagtccagggccaggcctccaccatcattgggaatggcgatttgctgctgcagaaaccaaacagaccccagtccagccctgaagacggccaagtagccacagtgtcatccagcccagaaaccaagaaggatcatccgaaaacaggggccaaaaccgactgtgcactgcaccggatccagaacctggcaccgagcgatgaggagtccagctggacaacgttgtcccaagacagtgcctcacccagctccccggatgaaacagatatatggagtgatcactcatttcagactgatccagatttgccgcctggctggaaaagagtcagtgacattgccgggacctattattggcacatcccaacaggaacgactcagtgggaacggcccgtctccatcccagcagatctccagggttctaggaaagggtcacttagttctgtaacgccatctcccaccccagagaacgagaaacagccatggagtgattttgctgttctgaatgggggaaagattaatagtgacatttggaaggatttgcatgcagccactgttaacccggaccccagtttaaaagagtttgaaggagcaaccctacgctatgcatctttgaaactcagaaatgccccacaccctgatgatgatgattcttgtagtatcaacagtgacccagaagccaagtgttttgctgtgcgttctctgggatgggtagagatggcagaagaggacctcgcccccggtaaaagtagtgttgcggtcaacaactgcatcaggcaactttcctactgcaaaaatgacatccgagacacagtcgggatttggggagaggggaaagacatgtacctgatcctggagaatgacatgctcagcctggtggaccccatggaccgcagcgtgctgcactcgcagcccatcgtcagcatccgcgtgtggggcgtgggccgcgacaatggccgggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagtagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgccactgtgactgtcatcagtgaaaagaatgaagaggaagtcttagtggaatgtcgtgtgcgattcctgtccttcatgggtgttgggaaggacgtccacacatttgccttcatcatggacacggggaaccagcgctttgagtgccacgttttctggtgcgagcctaatgctggtaacgtgtctgaggcggtgcaggccgcctgcatgttacgatatcagaagtgcttggtagccaggccgccttctcagaaagttcgaccacctccaccgccagcagattcagtaaccagaagagtcacaaccaatgtaaaacgaggggtcttatccctcattgacactttgaaacagaaacgccctgtcaccgaaatgccatagctgcacatgcaaaaggactcggctatttacctgaagattgactagctacactaaagaaaatgaactccgccatccgaccttccatccagttgctgatgctttgtcttcagagaatttacccttaaccaagcagtgttagacaagcatgttctctcgtcttgccaccatcatgtgatatgaaaagaagcatgaataattttttttgctgtaagttacatcatgcgcagtggaaggtctttttcttattgtaaatattgtgaacattacttaacttcacacacacacagagaagagtgtggccccacccctcctagtgaactaacgctgcgtccttggaatgaatgatgcgtgagttagtttcactgtcttcttggctggacctgtcacaagcaacctttaagtcctacagcactttgccctgttttcaacattggagtaggcactgcatagcagataccattgaattgctgtaaaaataggatggcgagtttgtgttttaatttttcataaaattgaacctgttggttgacaaaattggctgttggcatcagtatagaaaccaactggcagctttccctgacaagctctttgacacatggacaccatttcatgtctacagctgtttgtgggatgttggaaaaaaatgaaacttcaaaattgatgaaaaactaaattcgaggaattaaaatcgaacaaaacatagcctttcttttccgatggttttcaaactgattatttttaaaagagattaataaaatcataatgcattttgggtgggacatatttcaaacttctgccttatattgtacggtgcagctagagaattatagttcactatggccattctctacataaacattaagatgaaatactcctcatcagcctttcatccttagtttgagaattagctgatatgcaatttgaagttgaggaaatatcattgatatttctatcatgcacgattattttagatttctaccaccgtgtgatttttgctagtccatgtgctagaggtaaacgttctgctggaattctgcatccagctctatccccctctgatgctttttgcccagaaagctgtctgtccatcatgtattgtccatggcaacaaattacattaggttgaacctttccttgattttatgtatttaatattagaatttgttggactcaactagatatattttttaatttatattttttccattttactttgaagatttgaaatgttcatacctgagcaaagtctacacaggagtaatggactgtttaacaagtttcccaaaacagcattttcctgctccttcgtatgtaggtgagaaacttagctggaaagacatacaaatttagactctcgttgacattgtcgttttaaaaggaagttgctaaggcgatcaatctcaatattagtcttgtttacttcttcttaatgtcaaaattaacatttacaacatccaattataaaagtaatgctttatgtttatacactgctatgtacttgtcaaaatggtttccacattcttatcacatctgagccttaccaggtagagaaggtactaaatacactttagaagtaaaaatatgaagtaccgagaggctaaacccactggcctaagatctcaccaaagttcatgaaaaccaggactaggacccacggctcccaaagcccgttcttgctgtgttgtgctgcctccatatccgtcaggaagagcctttccagaatgattctgggcatatactaagaagagcaggtatggaaagatctattgtcagggaatcttagaattccctacacgagtgggagaaagatgtccaaattccttacgcagtggtattcatgatggtgccctatctaagtccaggactgttttcctacagcgtgcctcaaaagtgttgtagagggcaggattctacattcacagcctgttccatctacgagattttccagatgctacttgtggtagacattcctaactcatggtacttagccaccagagatcatgatggaatgagtgggtggcttttctacctgccattccctcagaattcatgaggggtgggggacagggggaccggaattgtcttagcaccccaatgttatgacaaaactatgctactttagaaacgcagtctgtttttcaccaattgacatactactgatctgaagtaaccagtgccatcataagaaattactgcattaagaaaatccttgctgtgccctttgaaaagctgttcagaaatcatttacagtgatctttcatctcggtcgctgtagtgaaacattttagtgtgataaatttcaaaattctaaacaaattacccacttttatattggaaatctctaccagaactccctcttcattttttaaggcatacatttgcttgttttcaagatcaagaattctgagctagctttaagtagcaaactgatttatatgtgcaattataggatgcattaagatgaatgatagcctttacatattgaaaactttgcagacgttttgttttgaaaatggcattgtatagtaaatgcaaattaattttgtaaaattatgttaaagagtatgttcagacactttctgccatggccaaaaagtatgtatgaaagtatgtgtgtatttgtttgtaaaaggatgccaatgttttacctgatatcttagtgacacttcagttatctatgcattctttagatctgtgattcggtaaacaggcagccatgttcacgatgccttctatgtcttaccatatttttaattaacctgttaaatacagcttaaaatatttttattttatttattctatttttactgaaatatactgcattattgtgttaatgtattatctttcctggatattatctcccagtgtatccagatctaagtaatctcagtgaactatacattgcctaaaaagtggttttgtaatgatttgtagtcacatttctattgggatatgtagaagaaaaggcaaaatgcttaaagttccttttattttttaaaagcagctagatagacacagacttgccacctcatacatctgctccttggcaacatcaaggggaacgactagccaacatgcctatggctaaaaactttcctttgcagactaaagcactgcttggtgcttcgtttttctacccttcacaacatgtgtgatttcatctaagagatatatacatgtacacatgccctttgtttccacctggatacaagatcactcatagctaattaggaccattgttttttgttcatctgtcttgttgcatgaagggacattagacccatttccattaaaataagttcttggtgataaactgtggcactgctacttctttttaaatccactttatgatttcaagatggacacttgtaagatgactcgacacaaggccattgcctggaagccccagagctttcctctgtttgtatggcccgttcatgtcccaggcattgcaacacaaactcctcaagatttcaccacaacatgacaagcattttcctaactgatattagcacaatttaactaataagccccttcgctctctagttggccaggcttaacctaatacacatctaacgtgtgtgccacacggccagtagaaagtttaacttcagcttcagggcaaagatacccactcacaccgtgtcaacgcaagcagtagttcctggcctccagagcagcttacttcccctgaaagaacgctttgttttcctttatgcccttttcctgttgaccacttttacacatttaaatgtaatttgttgtgagaataaatttagctgcataaaacgttcggctcatttatctgacatcttagtcacatatacaaggaatagaaatagaaactcggtgtctctagttatttttaaattattcttacctcagacttcttagaaatcactttagtaatggagcattttgctttgattagttactacatatttctgcctggtaagaactaggaagtaacttcaaattttgagtaatcaccctgtacttatttggtgatcaggaaggccagctggccttccggacatagaagcctatttagtcaccaactcgagtcttttgtaagcggtcttgctaggattgtgatattttagcacgaagaagtttatcacttcctttaagaacctgacatcaaagaataaagaatagaggtgtacacacactaaatccaaaatgaaaggtaactagagaaatcagttgaatctggtttagcttaactgttaggcgcaggaaggcagataaacagaatttaaagtatgtccccgctttttgttcatcttgcacttccacagtggtttctctctagtcagtaacaaaatttcattatggtttcaggcattatatggtggtaaataatttcagattaaaaatgtgtttgctattggagtatctgaatactagtaatttcattatttagaattttgcagcacttttatctcaagaagaagtccaagaatgtaaaatgccaaatgaaacatgtcagtggaatcaatattctccttcattagaattccctcatattgctttttttttttttcttcagacagaggagtcttactctggagtgcagtggtgtaatttcagctcaccacaacctccacctcccaagttcaagcaattctcgcctcagcctcctgagtagctgggattacaggcatgcaccgccacgcctggccaatttgtatatttttagtagagacagggtttcgccacgttggccaggctggtctcgaactcctgacctcaggtgatccgcccgccccaacctcccaaagtatgtgagccaccacgtccggcctcatattgcttttatccaaaattcttttcccttttcactctaccaaagtatttaaataatcctgtccttcatagaagattctcaaagaagaaaactgcagtgtaattaatgaatggtttaattcagaatcttcatatacttctaaagagaaaaataatttagtgccaaatgcatgttaggagataatcaatgtaagtggcaacaaattgtgacttcacatgctactgtagagatcagaaaattatcctaaactattccataacaatgagacaacatcacagaaaatacacttgaaaataaaaatctcaagaccagctacttctggacaatggaatacttttcagtctggtatggtggagggcccgaaaaggataagggattcttatgatacacaatgggattctttactgaacaatatgttaaattaagctgcaccgccttccttgaggcatggactaccctaaccaaccagatagaaatctgggtgggataagaggatgagccacacgctataattttagggcaaggagatagtgtttgattttcaaaatcagcaaaataagctgagcactttatatctttctgtacaagagtgataacatgaagaattcttcttcagggatttaaaatacaataagcctggttcaactataaaaagtcttgtttcctttcttcattgacacttttttttttttttttttttttttgaggcaaggtctcactctgcttcccaggctggagtgcagtggggcaatattggctcactgcaacctgcacctcctggactcaagagatcctcgtacctcagcctcctaagtagctgggactacaggcgtgtcccaccacacccagctaatttttgtattttttgtagagatggggttttggggtttcgccatgttgtccaggctcgtctggaactccggtgctcaagtggcgtgcccacctcagcctcccaaactgctgagattacagatgtgagccactgcacccagcccactgacacgttttactgataaatgtaaatctaagctaaaataaaaataatgtattaccgctataatacaattcaccattctcttttctcacttcaagtaagaaagtaaaaatagaatatcagagctgaagtagacctaagtattcatcttgaagaagataatattctaaaaatcatgccacctgaattgagcatttaggaatttatgtaacatttctatacaactgaattgcaaaaataaaactttaaattcaaacttta

SEQ ID NO: 107004 - DNA, 544 bp, Homo sapiens
  Payload ID: 1013
  Gene Symbol: APBB2
  Gene Name: amyloid beta (A4) precursor protein-binding, family B, member 2
  ENST ID: ENST00000503503
  CDS Start-End: 515-544
gatctgggcgctccgggaagggcgagactggagcagagccgctgggcgccggagccgaggcgagcgccgcgcgcaccactggttggagttgctgtgggtgagctgctgtggtctgtagccaagcatgctgtggtcggatctgcccagccgtggaacagaaacatttgctggatggaaaatccataaaagaaagctcctgtgaaaagctgaggctgacaataatttaagcaaaatcagtctcactctgtcaccaggctggagtgcagtgacgtgatctcggctcacagcaaccgctgtctgccaggttcaagtgattctcctgcctcagcctctcgagtaactggaactacagatcgatctctttgggctgcctgacctccttgggtgcttgctattaattaacagactttgtggggaaaaaaaggagcttgccttctgagctttgtaccaaagacctgggaaaaatttcaaattataacctatttcctgcaccattgctgacgcctggtgatccatgtcagaagtacttccagctgactcaggt

SEQ ID NO: 107005 - DNA, 537 bp, Homo sapiens
  Payload ID: 1013
  Gene Symbol: APBB2
  Gene Name: amyloid beta (A4) precursor protein-binding, family B, member 2
  ENST ID: ENST00000513516
  CDS Start-End: 277-537
aggcgcgggcgccgctctcttcaacttgagcccggggcagtgcgcgcggctgcttgagcgacggcaccgctggctggtgccggcaccctggggcttgtcgtagcacctggggcggcatccccgcccgacttcggaaggaccgggaggcaaagagagagggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagtagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgcc

SEQ ID NO: 107006 - DNA, 3316 bp, Homo sapiens
  Payload ID: 1013
  Gene Symbol: APBB2
  Gene Name: amyloid beta (A4) precursor protein-binding, family B, member 2
  ENST ID: ENST00000506352
  CDS Start-End: 628-2841
aaagcctggagaagtggaatctcgtcagcgccgctccctgcgcgggactcgcggaacggcactgagcatgctcagttgccggagcccgttctggtctcaagtaggaagctagtgcgctgtaaccgcatctgatctgggcgctccgggaagggcgagactggagcagagccgctgggcgccggagccgaggcgagcgccgcgcgcaccactggttggagttgctgtgggtgagctgctgtggtctgtagccaagcatgctgtggtcggatctgcccagccgtggaacagaaacatttgctggatggaaaatccataaaagaaagctcctgtgaaaagctgaggctgacaataatttaagcaaaatcagatcgatctctttgggctgcctgacctccttgggtgcttgctattaattaacagactttgtggggaaaaaaaggagcttgccttctgagctttgtaccaaagacctgggaaaactaaccatctcagtctttcctgaggacttgggaactgccgaggcctctgccaatgtgttgactgtcgctatgggctcactgttgtccaggcagctcatatttcaaattataacctatttcctgcaccattgctgacgcctggtgatccatgtcagaagtacttccagctgactcaggtgttgacaccttggcagtgtttatggccagcagcggaactacagacgtcacaaatcggaacagcccagccacaccaccaaacacccttaacctccgatcctcccacaatgaactgttgaacgctgaaataaaacacacagaaaccaagaacagcacacctcccaaatgcaggaaaaaatatgcactaactaacatccaggcggccatgggcctctcggatccagctgcacagcccctgctgggaaatggctctgccaacatcaagctggtgaaaaatggggagaaccagctccgtaaggctgcagagcaagggcagcaggaccccaacaaaaacctgagccccactgcagtcatcaacataacttctgagaagttagagggtaaagagccccacccacaggattcctcgagctgtgagattttaccctcccagcccaggagaactaagagcttcctaaattactatgcagatctggaaacctcagccagagaactagagcagaaccgaggcaatcaccatgggactgcggaagagaaatcccagccagtccagggccaggcctccaccatcattgggaatggcgatttgctgctgcagaaaccaaacagaccccagtccagccctgaagacggccaagtagccacagtgtcatccagcccagaaaccaagaaggatcatccgaaaacaggggccaaaaccgactgtgcactgcaccggatccagaacctggcaccgagcgatgaggagtccagctggacaacgttgtcccaagacagtgcctcacccagctccccggatgaaacagatatatggagtgatcactcatttcagactgatccagatttgccgcctggctggaaaagagtcagtgacattgccgggacctattattggcacatcccaacaggaacgactcagtgggaacggcccgtctccatcccagcagatctccagggttctaggaaagggtcacttagttctgtaacgccatctcccaccccagagaacgaggatttgcatgcagccactgttaacccggaccccagtttaaaagagtttgaaggagcaaccctacgctatgcatctttgaaactcagaaatgccccacaccctgatgatgatgattcttgtagtatcaacagtgacccagaagccaagtgttttgctgtgcgttctctgggatgggtagagatggcagaagaggacctcgcccccggtaaaagtagtgttgcggtcaacaactgcatcaggcaactttcctactgcaaaaatgacatccgagacacagtcgggatttggggagaggggaaagacatgtacctgatcctggagaatgacatgctcagcctggtggaccccatggaccgcagcgtgctgcactcgcagcccatcgtcagcatccgcgtgtggggcgtgggccgcgacaatggccgggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagtagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgccactgtgactgtcatcagtgaaaagaatgaagaggaagtcttagtggaatgtcgtgtgcgattcctgtccttcatgggtgttgggaaggacgtccacacatttgccttcatcatggacacggggaaccagcgctttgagtgccacgttttctggtgcgagcctaatgctggtaacgtgtctgaggcggtgcaggccgcctgcatgttacgatatcagaagtgcttggtagccaggccgccttctcagaaagttcgaccacctccaccgccagcagattcagtaaccagaagagtcacaaccaatgtaaaacgaggggtcttatccctcattgacactttgaaacagaaacgccctgtcaccgaaatgccatagctgcacatgcaaaaggactcggctatttacctgaagattgactagctacactaaagaaaatgaactccgccatccgaccttccatccagttgctgatgctttgtcttcagagaatttacccttaaccaagcagtgttagacaagcatgttctctcgtcttgccaccatcatgtgatatgaaaagaagcatgaataattttttttgctgtaagttacatcatgcgcagtggaaggtctttttcttattgtaaatattgtgaacattacttaacttcacacacacacagagaagagtgtggccccacccctcctagtgaactaacgctgcgtccttggaatgaatgatgcgtgagttagtttcactgtcttcttggctggacctgtcacaagcaacctttaagtcctacagcactttgccctgttttcaacattggagtaggcactgcatagcagataccattgaattgctgtaaaa

SEQ ID NO: 107007 - DNA, 550 bp, Homo sapiens
  Payload ID: 1013
  Gene Symbol: APBB2
  Gene Name: amyloid beta (A4) precursor protein-binding, family B, member 2
  ENST ID: ENST00000514920
  CDS Start-End: 266-550
attaattgctgcagagttgggaaattagatgagctgtcagtgctcagactcgctgttaacggggctgtgttattggcgggatgccgtgtgaatgctaacgtgttgtttctgctctgttccctcacgccttcccggattcagagagagggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagtagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgccactgtgactgtcatcagtgaaaag

SEQ ID NO: 107008 - DNA, 604 bp, Homo sapiens
  Payload ID: 1013
  Gene Symbol: APBB2
  Gene Name: amyloid beta (A4) precursor protein-binding, family B, member 2
  ENST ID: ENST00000508676
  CDS Start-End: 523-604
ggagaagtggaatctcgtcagcgccgctccctgcgcgggactcgcggaacggcactgagcatgctcagttgccggagcccgttctggtctcaagtaggaagctagtgcgctgtaaccgcatctgatctgggcgctccgggaagggcgagactggagcagagccgctgggcgccggagccgaggcgagcgccgcgcgcaccactggttggagttgctgtgggtgagctgctgtggtctgtagccaagcatgctgtggtcggatctgcccagccgtggaacagaaacatttgctggatggaaaatccataaaagaaagctcctgtgaaaagctgaggctgacaataatttaagcaaaatcagatcgatctctttgggctgcctgacctccttgggtgcttgctattaattaacagactttgtggggaaaaaaaggagcttgccttctgagctttgtaccaaagacctgggaaaaatttcaaattataacctatttcctgcaccattgctgacgcctggtgatccatgtcagaagtacttccagctgactcaggtgttgacaccttggcagtgtttatggccagcagcggaactacagacgtcacaa

SEQ ID NO: 107009 - DNA, 701 bp, Homo sapiens
  Payload ID: 1013
  Gene Symbol: APBB2
  Gene Name: amyloid beta (A4) precursor protein-binding, family B, member 2
  ENST ID: ENST00000510925
  CDS Start-End: 1-125
gtgacacaccagcaaaagccattgccacaagtctccacgagatctgctccaaggtaagattatggctgaacggaagaatgccaaagcgctggcctgcagctccttacaggaaagggccaatgtgaacctcgatgtccctttgcaagtagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgccactgtgactgtcatcagtgaaaagaatgaagaggaagtcttagtggaatgtcgtgtgcgattcctgtccttcatgggtgttgggaaggacgtccacacatttgccttcatcatggacacggggaaccagcgctttgagtgccacgttttctggtgcgagcctaatgctggtaacgtgtctgaggcggtgcaggccgcctgcatgttacgatatcagaagtgcttggtagccaggccgccttctcagaaagttcgaccacctccaccgccagcagattcagtaaccagaagagtcacaaccaatgtaaaacgaggggtcttatccctcattgacactttgaaacagaaacgccctgtcaccgaaatgccatagctgcaca

SEQ ID NO: 107010 - DNA, 1274 bp, Homo sapiens
  Payload ID: 1013
  Gene Symbol: APBB2
  Gene Name: amyloid beta (A4) precursor protein-binding, family B, member 2
  Uniprot ID: Q92870
  ENST ID: ENST00000504305
  CDS Start-End: 296-928
aacttgagcccggggcagtgcgcgcggctgcttgagcgacggcaccgctggctggtgccggcaccctggggcttgtcgtagcacctggggcggcatccccgcccgacttcggaaggaccgggaggcaaaggtgaggaagttggcgaaggaacggctctcctttgtttgcagagagagggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagtagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgccactgtgactgtcatcagtgaaaagaatgaagaggaagtcttagtggaatgtcgtgtgcgattcctgtccttcatgggtgttgggaaggacgtccacacatttgccttcatcatggacacggggaaccagcgctttgagtgccacgttttctggtgcgagcctaatgctggtaacgtgtctgaggcggtgcaggccgcctgcatgttacgatatcagaagtgcttggtagccaggccgccttctcagaaagttcgaccacctccaccgccagcagattcagtaaccagaagagtcacaaccaatgtaaaacgaggggtcttatccctcattgacactttgaaacagaaacgccctgtcaccgaaatgccatagctgcacatgcaaaaggactcggctatttacctgaagattgactagctacactaaagaaaatgaactccgccatccgaccttccatccagttgctgatgctttgtcttcagagaatttacccttaaccaagcagtgttagacaagcatgttctctcgtcttgccaccatcatgtgatatgaaaagaagcatgaataattttttttgctgtaagttacatcatgcgcagtggaaggtctttttcttattgtaaatattgtgaacattacttaacttcacacacacacagagaagagtgtggccccacccctcctagtgaactaacgctgcgtccttggaatgaatgat

SEQ ID NO: 107011 - DNA, 907 bp, Homo sapiens
  Payload ID: 1013
  Gene Symbol: APBB2
  Gene Name: amyloid beta (A4) precursor protein-binding, family B, member 2
  ENST ID: ENST00000509446
  CDS Start-End: 488-907
ccgcatctgatctgggcgctccgggaagggcgagactggagcagagccgctgggcgccggagccgaggcgagcgccgcgcgcaccactggttggagttgctgtgggtgagctgctgtggtctgtagccaagcatgctgtggtcggatctgcccagccgtggaacagaaacatttgctggatggaaaatccataaaagaaagctcctgtgaaaagctgaggctgacaataatttaagcaaaatcagatcgatctctttgggctgcctgacctccttgggtgcttgctattaattaacagactttgtggggaaaaaaaggagcttgccttctgagctttgtaccaaagacctgggaaaactaaccatctcagtctttcctgaggacttgggaactgccgaggcctctgccaatgtgttgactgtcgctatgggctcactgttgtccaggcagctcatctgactcaggtgttgacaccttggcagtgtttatggccagcagcggaactacagacgtcacaaatcggaacagcccagccacaccaccaaacacccttaacctccgatcctcccacaatgaactgttgaacgctgaaataaaacacacagaaaccaagaacagcacacctcccaaatgcaggaaaaaatatgcactaactaacatccaggcggccatgggcctctcggatccagctgcacagcccctgctgggaaatggctctgccaacatcaagctggtgaaaaatggggagaaccagctccgtaaggctgcagagcaagggcagcaggaccccaacaaaaacctgagccccactgcagtcatcaacataacttctgagaagttagagggtaaagagccccacccacaggattcctcgagctgtgagattttaccctcccagcccaggaga

SEQ ID NO: 107012 - DNA, 639 bp, Homo sapiens
  Payload ID: 1013
  Gene Symbol: APBB2
  Gene Name: amyloid beta (A4) precursor protein-binding, family B, member 2
  ENST ID: ENST00000508707
  CDS Start-End: 435-639
ctcaagtaggaagctagtgcgctgtaaccgcatctgatctgggcgctccgggaagggcgagactggagcagagccgctgggcgccggagccgaggcgagcgccgcgcgcaccactggttggagttgctgtgggtgagctgctgtggtctgtagccaagcatgctgtggtcggatctgcccagccgtggaacagaaacatttgctggatggaaaatccataaaagaaagctcctgtgaaaagctgaggctgacaataatttaagcaaaatcagatcgatctctttgggctgcctgacctccttgggtgcttgctattaattaacagactttgtggggaaaaaaaggagcttgccttctgagctttgtaccaaagacctgggaaaaatttcaaattataacctatttcctgcaccattgctgacgcctggtgatccatgtcagaagtacttccagctgactcaggtgttgacaccttggcagtgtttatggccagcagcggaactacagacgtcacaaatcggaacagcccagccacaccaccaaacacccttaacctccgatcctcccacaatgaactgttgaacgctgaaataaaacacacagaaaccaagaacagcacacctcccaaatgcaggaaaa

SEQ ID NO: 107013 - DNA, 426 bp, Homo sapiens
  Payload ID: 1013
  Gene Symbol: APBB2
  Gene Name: amyloid beta (A4) precursor protein-binding, family B, member 2
  ENST ID: ENST00000513493
  CDS Start-End: 1-426
ggggagaggggaaagacatgtacctgatcctggagaatgacatgctcagcctggtggaccccatggaccgcagcgtgctgcactcgcagcccatcgtcagcatccgcgtgtggggcgtgggccgcgacaatggccgagagagggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagattttccaacaccaaagactgagctggtccagaagttccacgtgcagtacttgggcatgttacctgtagacaaaccagtcg

SEQ ID NO: 107014 - DNA, 493 bp, Homo sapiens
  Payload ID: 1013
  Gene Symbol: APBB2
  Gene Name: amyloid beta (A4) precursor protein-binding, family B, member 2
  ENST ID: ENST00000503264
  CDS Start-End: 415-493
caagtaggaagctagtgcgctgtaaccgcatctgatctgggcgctccgggaagggcgagactggagcagagccgctgggcgccggagccgaggcgagcgccgcgcgcaccactggttggagttgctgtgggtgagctgctgtggtctgtagccaagcatgctgtggtcggatctgcccagccgtggaacagaaacatttgctggatggaaaatccataaaagaaagctcctgtgaaaagctgaggctgacaataatttaagcaaaatcagatcgatctctttgggctgcctgacctccttgggtgcttgctattaattaacagactttgtggggaaaaaaaggagcttgccttctgagctttgtaccaaagacctgggaaaactgactcaggtgttgacaccttggcagtgtttatggccagcagcggaactacagacgtcacaaatcggaacagcccagccacaccaccaaacacccttaacctccgatcct

SEQ ID NO: 107015 - DNA, 1681 bp, Homo sapiens
  Payload ID: 1013
  Gene Symbol: APBB2
  Gene Name: amyloid beta (A4) precursor protein-binding, family B, member 2
  Uniprot ID: Q92870
  ENST ID: ENST00000502841
  CDS Start-End: 290-922
aacttgagcccggggcagtgcgcgcggctgcttgagcgacggcaccgctggctggtgccggcaccctggggcttgtcgtagcacctggggcggcatccccgcccgacttcggaaggaccgggaggcaaaggtgaggaagttggcgaaggaacggctctcctttgtttgcagggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagtagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgccactgtgactgtcatcagtgaaaagaatgaagaggaagtcttagtggaatgtcgtgtgcgattcctgtccttcatgggtgttgggaaggacgtccacacatttgccttcatcatggacacggggaaccagcgctttgagtgccacgttttctggtgcgagcctaatgctggtaacgtgtctgaggcggtgcaggccgcctgcatgttacgatatcagaagtgcttggtagccaggccgccttctcagaaagttcgaccacctccaccgccagcagattcagtaaccagaagagtcacaaccaatgtaaaacgaggggtcttatccctcattgacactttgaaacagaaacgccctgtcaccgaaatgccatagctgcacatgcaaaaggactcggctatttacctgaagattgactagctacactaaagaaaatgaactccgccatccgaccttccatccagttgctgatgctttgtcttcagagaatttacccttaaccaagcagtgttagacaagcatgttctctcgtcttgccaccatcatgtgatatgaaaagaagcatgaataattttttttgctgtaagttacatcatgcgcagtggaaggtctttttcttattgtaaatattgtgaacattacttaacttcacacacacacagagaagagtgtggccccacccctcctagtgaactaacgctgcgtccttggaatgaatgatgcgtgagttagtttcactgtcttcttggctggacctgtcacaagcaacctttaagtcctacagcactttgccctgttttcaacattggagtaggcactgcatagcagataccattgaattgctgtaaaaataggatggcgagtttgtgttttaatttttcataaaattgaacctgttggttgacaaaattggctgttggcatcagtatagaaaccaactggcagctttccctgacaagctctttgacacatggacaccatttcatgtctacagctgtttgtgggatgttggaaaaaaatgaaacttcaaaattgatgaaaaactaaattcgaggaattaaaatcgaacaaaacatagcctttcttttccgatggttttcaaactgattatttttaaaagagattaataaaatc

SEQ ID NO: 107016 - DNA, 4166 bp, Homo sapiens
  Payload ID: 1013
  Gene Symbol: APBB2
  Gene Name: amyloid beta (A4) precursor protein-binding, family B, member 2
  Uniprot ID: Q92870
  ENST ID: ENST00000513140
  CDS Start-End: 471-2681
ctggagcagagccgctgggcgccggagccgaggcgagcgccgcgcgcaccactggttggagttgctgtgggtgagctgctgtggtctgtagccaagcatgctgtggtcggatctgcccagccgtggaacagaaacatttgctggatggaaaatccataaaagaaagctcctgtgaaaagctgaggctgacaataatttaagcaaaatcagatcgatctctttgggctgcctgacctccttgggtgcttgctattaattaacagactttgtggggaaaaaaaggagcttgccttctgagctttgtaccaaagacctgggaaaactaaccatctcagtctttcctgaggacttgggaactgccgaggcctctgccaatgtgttgactgtcgctatgggctcactgttgtccaggcagctcatatttcaaattataacctatttcctgcaccattgctgacgcctggtgatccatgtcagaagtacttccagctgactcaggtgttgacaccttggcagtgtttatggccagcagcggaactacagacgtcacaaatcggaacagcccagccacaccaccaaacacccttaacctccgatcctcccacaatgaactgttgaacgctgaaataaaacacacagaaaccaagaacagcacacctcccaaatgcaggaaaaaatatgcactaactaacatccaggcggccatgggcctctcggatccagctgcacagcccctgctgggaaatggctctgccaacatcaagctggtgaaaaatggggagaaccagctccgtaaggctgcagagcaagggcagcaggaccccaacaaaaacctgagccccactgcagtcatcaacataacttctgagaagttagagggtaaagagccccacccacaggattcctcgagctgtgagattttaccctcccagcccaggagaactaagagcttcctaaattactatgcagatctggaaacctcagccagagaactagagcagaaccgaggcaatcaccatgggactgcggaagagaaatcccagccagtccagggccaggcctccaccatcattgggaatggcgatttgctgctgcagaaaccaaacagaccccagtccagccctgaagacggccaagtagccacagtgtcatccagcccagaaaccaagaaggatcatccgaaaacaggggccaaaaccgactgtgcactgcaccggatccagaacctggcaccgagcgatgaggagtccagctggacaacgttgtcccaagacagtgcctcacccagctccccggatgaaacagatatatggagtgatcactcatttcagactgatccagatttgccgcctggctggaaaagagtcagtgacattgccgggacctattattggcacatcccaacaggaacgactcagtgggaacggcccgtctccatcccagcagatctccagggttctaggaaagggtcacttagttctgtaacgccatctcccaccccagagaacgaggatttgcatgcagccactgttaacccggaccccagtttaaaagagtttgaaggagcaaccctacgctatgcatctttgaaactcagaaatgccccacaccctgatgatgatgattcttgtagtatcaacagtgacccagaagccaagtgttttgctgtgcgttctctgggatgggtagagatggcagaagaggacctcgcccccggtaaaagtagtgttgcggtcaacaactgcatcaggcaactttcctactgcaaaaatgacatccgagacacagtcgggatttggggagaggggaaagacatgtacctgatcctggagaatgacatgctcagcctggtggaccccatggaccgcagcgtgctgcactcgcagcccatcgtcagcatccgcgtgtggggcgtgggccgcgacaatggccgggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgccactgtgactgtcatcagtgaaaagaatgaagaggaagtcttagtggaatgtcgtgtgcgattcctgtccttcatgggtgttgggaaggacgtccacacatttgccttcatcatggacacggggaaccagcgctttgagtgccacgttttctggtgcgagcctaatgctggtaacgtgtctgaggcggtgcaggccgcctgcatgttacgatatcagaagtgcttggtagccaggccgccttctcagaaagttcgaccacctccaccgccagcagattcagtaaccagaagagtcacaaccaatgtaaaacgaggggtcttatccctcattgacactttgaaacagaaacgccctgtcaccgaaatgccatagctgcacatgcaaaaggactcggctatttacctgaagattgactagctacactaaagaaaatgaactccgccatccgaccttccatccagttgctgatgctttgtcttcagagaatttacccttaaccaagcagtgttagacaagcatgttctctcgtcttgccaccatcatgtgatatgaaaagaagcatgaataattttttttgctgtaagttacatcatgcgcagtggaaggtctttttcttattgtaaatattgtgaacattacttaacttcacacacacacagagaagagtgtggccccacccctcctagtgaactaacgctgcgtccttggaatgaatgatgcgtgagttagtttcactgtcttcttggctggacctgtcacaagcaacctttaagtcctacagcactttgccctgttttcaacattggagtaggcactgcatagcagataccattgaattgctgtaaaaataggatggcgagtttgtgttttaatttttcataaaattgaacctgttggttgacaaaattggctgttggcatcagtatagaaaccaactggcagctttccctgacaagctctttgacacatggacaccatttcatgtctacagctgtttgtgggatgttggaaaaaaatgaaacttcaaaattgatgaaaaactaaattcgaggaattaaaatcgaacaaaacatagcctttcttttccgatggttttcaaactgattatttttaaaagagattaataaaatcataatgcattttgggtgggacatatttcaaacttctgccttatattgtacggtgcagctagagaattatagttcactatggccattctctacataaacattaagatgaaatactcctcatcagcctttcatccttagtttgagaattagctgatatgcaatttgaagttgaggaaatatcattgatatttctatcatgcacgattattttagatttctaccaccgtgtgatttttgctagtccatgtgctagaggtaaacgttctgctggaattctgcatccagctctatccccctctgatgctttttgcccagaaagctgtctgtccatcatgtattgtccatggcaacaaattacattaggttgaacctttccttgattttatgtatttaatattagaatttgttggactcaactagatatattttttaatttatattttttccattttactttgaagatttgaaatgttcatacctgagcaaagtctacacaggagtaatggactgtttaacaagtttcccaaaacagcattttcctgctccttcgtatgtaggtgagaaacttagctggaaagacatacaaatttagactctcgttgacattgtcgttttaaaaggaagttgctaaggcgatcaatctcaatattagtcttgtttacttcttcttaatgtcaaaattaacatttacaacatccaattataaaagtaatgctttatgtttata

SEQ ID NO: 107017 - DNA, 539 bp, Homo sapiens
  Payload ID: 1013
  Gene Symbol: APBB2
  Gene Name: amyloid beta (A4) precursor protein-binding, family B, member 2
  ENST ID: ENST00000512510
  CDS Start-End: 1-539
gtgctgcactcgcagcccatcgtcagcatccgcgtgtggggcgtgggccgcgacaatggccgagagagggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagtagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgccactgtgactgtcatcagtgaaaagaatgaagaggaagtcttagtggaatgtcgtgtgcgattcctgtccttcatgggtgttgggaaggacgt

SEQ ID NO: 107018 - DNA, 591 bp, Homo sapiens
  Payload ID: 1013
  Gene Symbol: APBB2
  Gene Name: amyloid beta (A4) precursor protein-binding, family B, member 2
  ENST ID: ENST00000510670
  CDS Start-End: 286-591
agggagggcgcagggaggcgcgggcgccgctctcttcaacttgagcccggggcagtgcgcgcggctgcttgagcgacggcaccgctggctggtgccggcaccctggggcttgtcgtagcacctggggcggcatccccgcccgacttcggaaggaccgggaggcaaagggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagtagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgccactgtgactgtcatcagtgaaaagaatgaagaggaagtcttagtg

SEQ ID NO: 107019 - DNA, 3592 bp, Homo sapiens
  Payload ID: 1013
  Gene Symbol: APBB2
  Gene Name: amyloid beta (A4) precursor protein-binding, family B, member 2
  Uniprot ID: Q92870
  ENST ID: ENST00000508593
  CDS Start-End: 545-2824
gcccgttctggtctcaagtaggaagctagtgcgctgtaaccgcatctgatctgggcgctccgggaagggcgagactggagcagagccgctgggcgccggagccgaggcgagcgccgcgcgcaccactggttggagttgctgtgggtgagctgctgtggtctgtagccaagcatgctgtggtcggatctgcccagccgtggaacagaaacatttgctggatggaaaatccataaaagaaagctcctgtgaaaagctgaggctgacaataatttaagcaaaatcagatcgatctctttgggctgcctgacctccttgggtgcttgctattaattaacagactttgtggggaaaaaaaggagcttgccttctgagctttgtaccaaagacctgggaaaactaaccatctcagtctttcctgaggacttgggaactgccgaggcctctgccaatgtgttgactgtcgctatgggctcactgttgtccaggcagctcatatttcaaattataacctatttcctgcaccattgctgacgcctggtgatccatgtcagaagtacttccagctgactcaggtgttgacaccttggcagtgtttatggccagcagcggaactacagacgtcacaaatcggaacagcccagccacaccaccaaacacccttaacctccgatcctcccacaatgaactgttgaacgctgaaataaaacacacagaaaccaagaacagcacacctcccaaatgcaggaaaaaatatgcactaactaacatccaggcggccatgggcctctcggatccagctgcacagcccctgctgggaaatggctctgccaacatcaagctggtgaaaaatggggagaaccagctccgtaaggctgcagagcaagggcagcaggaccccaacaaaaacctgagccccactgcagtcatcaacataacttctgagaagttagagggtaaagagccccacccacaggattcctcgagctgtgagattttaccctcccagcccaggagaactaagagcttcctaaattactatgcagatctggaaacctcagccagagaactagagcagaaccgaggcaatcaccatgggactgcggaagagaaatcccagccagtccagggccaggcctccaccatcattgggaatggcgatttgctgctgcagaaaccaaacagaccccagtccagccctgaagacggccaagtagccacagtgtcatccagcccagaaaccaagaaggatcatccgaaaacaggggccaaaaccgactgtgcactgcaccggatccagaacctggcaccgagcgatgaggagtccagctggacaacgttgtcccaagacagtgcctcacccagctccccggatgaaacagcagatatatggagtgatcactcatttcagactgatccagatttgccgcctggctggaaaagagtcagtgacattgccgggacctattattggcacatcccaacaggaacgactcagtgggaacggcccgtctccatcccagcagatctccagggttctaggaaagggtcacttagttctgtaacgccatctcccaccccagagaacgagaaacagccatggagtgattttgctgttctgaatgggggaaagattaatagtgacatttggaaggatttgcatgcagccactgttaacccggaccccagtttaaaagagtttgaaggagcaaccctacgctatgcatctttgaaactcagaaatgccccacaccctgatgatgatgattcttgtagtatcaacagtgacccagaagccaagtgttttgctgtgcgttctctgggatgggtagagatggcagaagaggacctcgcccccggtaaaagtagtgttgcggtcaacaactgcatcaggcaactttcctactgcaaaaatgacatccgagacacagtcgggatttggggagaggggaaagacatgtacctgatcctggagaatgacatgctcagcctggtggaccccatggaccgcagcgtgctgcactcgcagcccatcgtcagcatccgcgtgtggggcgtgggccgcgacaatggccgggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagtagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgccactgtgactgtcatcagtgaaaagaatgaagaggaagtcttagtggaatgtcgtgtgcgattcctgtccttcatgggtgttgggaaggacgtccacacatttgccttcatcatggacacggggaaccagcgctttgagtgccacgttttctggtgcgagcctaatgctggtaacgtgtctgaggcggtgcaggccgcctgcatgttacgatatcagaagtgcttggtagccaggccgccttctcagaaagttcgaccacctccaccgccagcagattcagtaaccagaagagtcacaaccaatgtaaaacgaggggtcttatccctcattgacactttgaaacagaaacgccctgtcaccgaaatgccatagctgcacatgcaaaaggactcggctatttacctgaagattgactagctacactaaagaaaatgaactccgccatccgaccttccatccagttgctgatgctttgtcttcagagaatttacccttaaccaagcagtgttagacaagcatgttctctcgtcttgccaccatcatgtgatatgaaaagaagcatgaataattttttttgctgtaagttacatcatgcgcagtggaaggtctttttcttattgtaaatattgtgaacattacttaacttcacacacacacagagaagagtgtggccccacccctcctagtgaactaacgctgcgtccttggaatgaatgatgcgtgagttagtttcactgtcttcttggctggacctgtcacaagcaacctttaagtcctacagcactttgccctgttttcaacattggagtaggcactgcatagcagataccattgaattgctgtaaaaataggatggcgagtttgtgttttaatttttcataaaattgaacctgttggttgacaaaattggctgttggcatcagtatagaaaccaactggcagctttccctgacaagctctttgacacatggacaccatttcatgtctacagctgtttgtgggatgttggaaaaaaatgaaacttcaaaattgatgaaaaactaaattcgaggaattaaaatcgaacaaaacatagcctttcttttccgatggttttcaaactgattatttttaaaagagattaataaaatcataatgcat

SEQ ID NO: 107020 - DNA, 2964 bp, Homo sapiens
  Payload ID: 1013
  Gene Symbol: APBB2
  Gene Name: amyloid beta (A4) precursor protein-binding, family B, member 2
  ENST ID: ENST00000513611
  CDS Start-End: 1-2185
tgacaccttggcagtgtttatggccagcagcggaactacagacgtcacaaatcggaacagcccagccacaccaccaaacacccttaacctccgatcctcccacaatgaactgttgaacgctgaaataaaacacacagaaaccaagaacagcacacctcccaaatgcaggaaaaaatatgcactaactaacatccaggcggccatgggcctctcggatccagctgcacagcccctgctgggaaatggctctgccaacatcaagctggtgaaaaatggggagaaccagctccgtaaggctgcagagcaagggcagcaggaccccaacaaaaacctgagccccactgcagtcatcaacataacttctgagaagttagagggtaaagagccccacccacaggattcctcgagctgtgagattttaccctcccagcccaggagaactaagagcttcctaaattactatgcagatctggaaacctcagccagagaactagagcagaaccgaggcaatcaccatgggactgcggaagagaaatcccagccagtccagggccaggcctccaccatcattgggaatggcgatttgctgctgcagaaaccaaacagaccccagtccagccctgaagacggccaagtagccacagtgtcatccagcccagaaaccaagaaggatcatccgaaaacaggggccaaaaccgactgtgcactgcaccggatccagaacctggcaccgagcgatgaggagtccagctggacaacgttgtcccaagacagtgcctcacccagctccccggatgaaacagcagatatatggagtgatcactcatttcagactgatccagatttgccgcctggctggaaaagagtcagtgacattgccgggacctattattggcacatcccaacaggaacgactcagtgggaacggcccgtctccatcccagcagatctccagggttctaggaaagggtcacttagttctgtaacgccatctcccaccccagagaacgaggatttgcatgcagccactgttaacccggaccccagtttaaaagagtttgaaggagcaaccctacgctatgcatctttgaaactcagaaatgccccacaccctgatgatgatgattcttgtagtatcaacagtgacccagaagccaagtgttttgctgtgcgttctctgggatgggtagagatggcagaagaggacctcgcccccggtaaaagtagtgttgcggtcaacaactgcatcaggcaactttcctactgcaaaaatgacatccgagacacagtcgggatttggggagaggggaaagacatgtacctgatcctggagaatgacatgctcagcctggtggaccccatggaccgcagcgtgctgcactcgcagcccatcgtcagcatccgcgtgtggggcgtgggccgcgacaatggccgggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagtagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgccactgtgactgtcatcagtgaaaagaatgaagaggaagtcttagtggaatgtcgtgtgcgattcctgtccttcatgggtgttgggaaggacgtccacacatttgccttcatcatggacacggggaaccagcgctttgagtgccacgttttctggtgcgagcctaatgctggtaacgtgtctgaggcggtgcaggccgcctgcatgttacgatatcagaagtgcttggtagccaggccgccttctcagaaagttcgaccacctccaccgccagcagattcagtaaccagaagagtcacaaccaatgtaaaacgaggggtcttatccctcattgacactttgaaacagaaacgccctgtcaccgaaatgccatagctgcacatgcaaaaggactcggctatttacctgaagattgactagctacactaaagaaaatgaactccgccatccgaccttccatccagttgctgatgctttgtcttcagagaatttacccttaaccaagcagtgttagacaagcatgttctctcgtcttgccaccatcatgtgatatgaaaagaagcatgaataattttttttgctgtaagttacatcatgcgcagtggaaggtctttttcttattgtaaatattgtgaacattacttaacttcacacacacacagagaagagtgtggccccacccctcctagtgaactaacgctgcgtccttggaatgaatgatgcgtgagttagtttcactgtcttcttggctggacctgtcacaagcaacctttaagtcctacagcactttgccctgttttcaacattggagtaggcactgcatagcagataccattgaattgctgtaaaaataggatggcgagtttgtgttttaatttttcataaaattgaacctgttggttgacaaaattggctgttggcatcagtatagaaaccaactggcagctttccctgacaagctctttgacacatggacaccatttcatgtctacagctgtttgtgggatgttggaaaaaaatgaaacttcaaaattgatgaaaaactaaattcgaggaattaaaatcgaacaaaacatagcctttcttttccgatggttttcaaactgattatttttaaaagagattaataaaatcataatgcattttgggtggga

SEQ ID NO: 107021 - DNA, 6992 bp, Homo sapiens
  Payload ID: 1013
  Gene Symbol: APBB2
  Gene Name: amyloid beta (A4) precursor protein-binding, family B, member 2
  Uniprot ID: Q92870
  ENST ID: ENST00000543538
  CDS Start-End: 296-928
aacttgagcccggggcagtgcgcgcggctgcttgagcgacggcaccgctggctggtgccggcaccctggggcttgtcgtagcacctggggcggcatccccgcccgacttcggaaggaccgggaggcaaaggtgaggaagttggcgaaggaacggctctcctttgtttgcaggcacagggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagtagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgccactgtgactgtcatcagtgaaaagaatgaagaggaagtcttagtggaatgtcgtgtgcgattcctgtccttcatgggtgttgggaaggacgtccacacatttgccttcatcatggacacggggaaccagcgctttgagtgccacgttttctggtgcgagcctaatgctggtaacgtgtctgaggcggtgcaggccgcctgcatgttacgatatcagaagtgcttggtagccaggccgccttctcagaaagttcgaccacctccaccgccagcagattcagtaaccagaagagtcacaaccaatgtaaaacgaggggtcttatccctcattgacactttgaaacagaaacgccctgtcaccgaaatgccatagctgcacatgcaaaaggactcggctatttacctgaagattgactagctacactaaagaaaatgaactccgccatccgaccttccatccagttgctgatgctttgtcttcagagaatttacccttaaccaagcagtgttagacaagcatgttctctcgtcttgccaccatcatgtgatatgaaaagaagcatgaataattttttttgctgtaagttacatcatgcgcagtggaaggtctttttcttattgtaaatattgtgaacattacttaacttcacacacacacagagaagagtgtggccccacccctcctagtgaactaacgctgcgtccttggaatgaatgatgcgtgagttagtttcactgtcttcttggctggacctgtcacaagcaacctttaagtcctacagcactttgccctgttttcaacattggagtaggcactgcatagcagataccattgaattgctgtaaaaataggatggcgagtttgtgttttaatttttcataaaattgaacctgttggttgacaaaattggctgttggcatcagtatagaaaccaactggcagctttccctgacaagctctttgacacatggacaccatttcatgtctacagctgtttgtgggatgttggaaaaaaatgaaacttcaaaattgatgaaaaactaaattcgaggaattaaaatcgaacaaaacatagcctttcttttccgatggttttcaaactgattatttttaaaagagattaataaaatcataatgcattttgggtgggacatatttcaaacttctgccttatattgtacggtgcagctagagaattatagttcactatggccattctctacataaacattaagatgaaatactcctcatcagcctttcatccttagtttgagaattagctgatatgcaatttgaagttgaggaaatatcattgatatttctatcatgcacgattattttagatttctaccaccgtgtgatttttgctagtccatgtgctagaggtaaacgttctgctggaattctgcatccagctctatccccctctgatgctttttgcccagaaagctgtctgtccatcatgtattgtccatggcaacaaattacattaggttgaacctttccttgattttatgtatttaatattagaatttgttggactcaactagatatattttttaatttatattttttccattttactttgaagatttgaaatgttcatacctgagcaaagtctacacaggagtaatggactgtttaacaagtttcccaaaacagcattttcctgctccttcgtatgtaggtgagaaacttagctggaaagacatacaaatttagactctcgttgacattgtcgttttaaaaggaagttgctaaggcgatcaatctcaatattagtcttgtttacttcttcttaatgtcaaaattaacatttacaacatccaattataaaagtaatgctttatgtttatacactgctatgtacttgtcaaaatggtttccacattcttatcacatctgagccttaccaggtagagaaggtactaaatacactttagaagtaaaaatatgaagtaccgagaggctaaacccactggcctaagatctcaccaaagttcatgaaaaccaggactaggacccacggctcccaaagcccgttcttgctgtgttgtgctgcctccatatccgtcaggaagagcctttccagaatgattctgggcatatactaagaagagcaggtatggaaagatctattgtcagggaatcttagaattccctacacgagtgggagaaagatgtccaaattccttacgcagtggtattcatgatggtgccctatctaagtccaggactgttttcctacagcgtgcctcaaaagtgttgtagagggcaggattctacattcacagcctgttccatctacgagattttccagatgctacttgtggtagacattcctaactcatggtacttagccaccagagatcatgatggaatgagtgggtggcttttctacctgccattccctcagaattcatgaggggtgggggacagggggaccggaattgtcttagcaccccaatgttatgacaaaactatgctactttagaaacgcagtctgtttttcaccaattgacatactactgatctgaagtaaccagtgccatcataagaaattactgcattaagaaaatccttgctgtgccctttgaaaagctgttcagaaatcatttacagtgatctttcatctcggtcgctgtagtgaaacattttagtgtgataaatttcaaaattctaaacaaattacccacttttatattggaaatctctaccagaactccctcttcattttttaaggcatacatttgcttgttttcaagatcaagaattctgagctagctttaagtagcaaactgatttatatgtgcaattataggatgcattaagatgaatgatagcctttacatattgaaaactttgcagacgttttgttttgaaaatggcattgtatagtaaatgcaaattaattttgtaaaattatgttaaagagtatgttcagacactttctgccatggccaaaaagtatgtatgaaagtatgtgtgtatttgtttgtaaaaggatgccaatgttttacctgatatcttagtgacacttcagttatctatgcattctttagatctgtgattcggtaaacaggcagccatgttcacgatgccttctatgtcttaccatatttttaattaacctgttaaatacagcttaaaatatttttattttatttattctatttttactgaaatatactgcattattgtgttaatgtattatctttcctggatattatctcccagtgtatccagatctaagtaatctcagtgaactatacattgcctaaaaagtggttttgtaatgatttgtagtcacatttctattgggatatgtagaagaaaaggcaaaatgcttaaagttccttttattttttaaaagcagctagatagacacagacttgccacctcatacatctgctccttggcaacatcaaggggaacgactagccaacatgcctatggctaaaaactttcctttgcagactaaagcactgcttggtgcttcgtttttctacccttcacaacatgtgtgatttcatctaagagatatatacatgtacacatgccctttgtttccacctggatacaagatcactcatagctaattaggaccattgttttttgttcatctgtcttgttgcatgaagggacattagacccatttccattaaaataagttcttggtgataaactgtggcactgctacttctttttaaatccactttatgatttcaagatggacacttgtaagatgactcgacacaaggccattgcctggaagccccagagctttcctctgtttgtatggcccgttcatgtcccaggcattgcaacacaaactcctcaagatttcaccacaacatgacaagcattttcctaactgatattagcacaatttaactaataagccccttcgctctctagttggccaggcttaacctaatacacatctaacgtgtgtgccacacggccagtagaaagtttaacttcagcttcagggcaaagatacccactcacaccgtgtcaacgcaagcagtagttcctggcctccagagcagcttacttcccctgaaagaacgctttgttttcctttatgcccttttcctgttgaccacttttacacatttaaatgtaatttgttgtgagaataaatttagctgcataaaacgttcggctcatttatctgacatcttagtcacatatacaaggaatagaaatagaaactcggtgtctctagttatttttaaattattcttacctcagacttcttagaaatcactttagtaatggagcattttgctttgattagttactacatatttctgcctggtaagaactaggaagtaacttcaaattttgagtaatcaccctgtacttatttggtgatcaggaaggccagctggccttccggacatagaagcctatttagtcaccaactcgagtcttttgtaagcggtcttgctaggattgtgatattttagcacgaagaagtttatcacttcctttaagaacctgacatcaaagaataaagaatagaggtgtacacacactaaatccaaaatgaaaggtaactagagaaatcagttgaatctggtttagcttaactgttaggcgcaggaaggcagataaacagaatttaaagtatgtccccgctttttgttcatcttgcacttccacagtggtttctctctagtcagtaacaaaatttcattatggtttcaggcattatatggtggtaaataatttcagattaaaaatgtgtttgctattggagtatctgaatactagtaatttcattatttagaattttgcagcacttttatctcaagaagaagtccaagaatgtaaaatgccaaatgaaacatgtcagtggaatcaatattctccttcattagaattccctcatattgctttttttttttttcttcagacagaggagtcttactctggagtgcagtggtgtaatttcagctcaccacaacctccacctcccaagttcaagcaattctcgcctcagcctcctgagtagctgggattacaggcatgcaccgccacgcctggccaatttgtatatttttagtagagacagggtttcgccacgttggccaggctggtctcgaactcctgacctcaggtgatccgcccgccccaacctcccaaagtatgtgagccaccacgtccggcctcatattgcttttatccaaaattcttttcccttttcactctaccaaagtatttaaataatcctgtccttcatagaagattctcaaagaagaaaactgcagtgtaattaatgaatggtttaattcagaatcttcatatacttctaaagagaaaaataatttagtgccaaatgcatgttaggagataatcaatgtaagtggcaacaaattgtgacttcacatgctactgtagagatcagaaaattatcctaaactattccataacaatgagacaacatcacagaaaatacacttgaaaataaaaatctcaagaccagctacttctggacaatggaatacttttcagtctggtatggtggagggcccgaaaaggataagggattcttatgatacacaatgggattctttactgaacaatatgttaaattaagctgcaccgccttccttgaggcatggactaccctaaccaaccagatagaaatctgggtgggataagaggatgagccacacgctataattttagggcaaggagatagtgtttgattttcaaaatcagcaaaataagctgagcactttatatctttctgtacaagagtgataacatgaagaattcttcttcagggatttaaaatacaataagcctggttcaactataaaaagtcttgtttcctttcttcattgacacttttttttttttttttttttttttgaggcaaggtctcactctgcttcccaggctggagtgcagtggggcaatattggctcactgcaacctgcacctcctggactcaagagatcctcgtacctcagcctcctaagtagctgggactacaggcgtgtcccaccacacccagctaatttttgtattttttgtagagatggggttttggggtttcgccatgttgtccaggctcgtctggaactccggtgctcaagtggcgtgcccacctcagcctcccaaactgctgagattacagatgtgagccactgcacccagcccactgacacgttttactgataaatgtaaatctaagctaaaataaaaataatgtattaccgctataatacaattcaccattctcttttctcacttcaagtaagaaagtaaaaatagaatatcagagctgaagtagacctaagtattcatcttgaagaagataatattctaaaaatcatgccacctgaattgagcatttaggaatttatgtaacatttctatacaactgaattgcaaaaataaaactttaaattcaaacttt

SEQ ID NO: 107022 - DNA, 1810 bp, Homo sapiens
  Payload ID: 1014
  Gene Symbol: APBB3
  Gene Name: amyloid beta (A4) precursor protein-binding, family B, member 3
  Uniprot ID: O95704
  ENST ID: ENST00000354402
  CDS Start-End: 16-1497
ggagcagccggggttatgctgggcaaggattacatgctggccatcattctggtcaactgcgatgatgacttgtggggggaccacagtctggaggtggaggctggcctgcctcctggctggaggaagatccacgatgctgcaggtacttactactggcatgtacccagcggtagcacccagtggcagcgcccaacctgggaactaggagatgcagaggacccaggcacgggaacggaggggatctggggactgcggccccccaaagggagatccttctccagcctggagagttcactggaccggagtaactctctgtcctggtatggtggggaatcctacatccagagcatggagccaggggctaagtgctttgcagtccgctctctgggctgggtagaggtacctgaagaggacctggcaccggggaagagcagtattgcagtcaataactgtatccagcagctggcccagacccgcagccggagccagcctccagatggtgcctggggtgagggccagaacatgctgatgatcctgaagaaggatgccatgagcctagtgaatcccctggaccacagtctgatccactgccagcctctggtgcacatccgtgtgtggggcgtggggagctccaagggccgtgacagccccatctctgcccctgctagggacttcgcttttgtggcaagtgacaaagatagctgtatgctcaagtgccatgtgttttgctgtgatgtccctgccaaggccattgccagtgccctacatgggctttgtgcccagatcttgtcagagcgagtagaggtcagtggtgatgcctcttgctgctccccagaccccatctctcctgaagacctgccacggcaagtggagctgctggatgcggtaagccaagctgctcagaagtacgaggcactgtatatggggacactgccagtcaccaaggccatgggcatggatgtgctgaacgaggccattggtaccctcaccgccaggggggaccggaatgcctgggtccccaccatgctcagtgtgtctgactctctcatgactgcacaccccattcaggcagaggccagtacagaggaggagccattgtggcagtgccctgtgcgccttgtgacatttattggtgttggccgcgacccacacacctttggcctcatcgctgacctgggccgtcagagcttccagtgcgcagccttctggtgccagccccatgcagggggactctctgaagctgtgcaggctgcctgtatggttcagtaccagaagtgtcttgtggcctctgcagctcgaggcaaggcctggggtgcccaggcccgtgcccgcctgcggctcaagcggaccagctccatggattccccaggaggtcccctgcccctccccctgctcaaaggaggggttggcggtgcaggggcaacccctcgaaagcggggtgtcttctcttttcttgatgccttccggctgaaaccctctctgctccatatgccctaaacttatctgggaaggctggggaagtaggctctgggtccatgcctaactctgtaccgttttattcctcaaggcctatagcctgtcactccttgaagccttctctgcctgtccctccgatccttgtccaccgtctatttattgcccaatttattgtttatacggatgactgggaggcactgcaccacaacgtaggaccctggctcccctttccttgggtccttgtgttccttgcccctgtccaaccctggacagttggctctacctcagtaacactttatagcaaaatcagtgcaaataaaaatccctcagtgac

SEQ ID NO: 107023 - DNA, 1804 bp, Homo sapiens
  Payload ID: 1014
  Gene Symbol: APBB3
  Gene Name: amyloid beta (A4) precursor protein-binding, family B, member 3
  Uniprot ID: O95704
  ENST ID: ENST00000356738
  CDS Start-End: 16-1491
ggagcagccggggttatgctgggcaaggattacatgctggccatcattctggtcaactgcgatgatgacttgtggggggaccacagtctggaggtggaggctggcctgcctcctggctggaggaagatccacgatgctgcaggtacttactactggcatgtacccagcggtagcacccagtggcagcgcccaacctgggaactaggagatgcagaggacccaggcacgggaacggaggggatctggggactgcggccccccaaagggagatccttctccagcctggagagttcactggaccggagtaactctctgtcctggtatggtggggaatcctacatccagagcatggagccaggggctaagtgctttgcagtccgctctctgggctgggtagaggtacctgaagaggacctggcaccggggaagagcagtattgcagtcaataactgtatccagcagctggcccagacccgcagccggagccagcctccagatggtgcctggggtgagggccagaacatgctgatgatcctgaagaaggatgccatgagcctagtgaatcccctggaccacagtctgatccactgccagcctctggtgcacatccgtgtgtggggcgtggggagctccaagggccgccccatctctgcccctgctagggacttcgcttttgtggcaagtgacaaagatagctgtatgctcaagtgccatgtgttttgctgtgatgtccctgccaaggccattgccagtgccctacatgggctttgtgcccagatcttgtcagagcgagtagaggtcagtggtgatgcctcttgctgctccccagaccccatctctcctgaagacctgccacggcaagtggagctgctggatgcggtaagccaagctgctcagaagtacgaggcactgtatatggggacactgccagtcaccaaggccatgggcatggatgtgctgaacgaggccattggtaccctcaccgccaggggggaccggaatgcctgggtccccaccatgctcagtgtgtctgactctctcatgactgcacaccccattcaggcagaggccagtacagaggaggagccattgtggcagtgccctgtgcgccttgtgacatttattggtgttggccgcgacccacacacctttggcctcatcgctgacctgggccgtcagagcttccagtgcgcagccttctggtgccagccccatgcagggggactctctgaagctgtgcaggctgcctgtatggttcagtaccagaagtgtcttgtggcctctgcagctcgaggcaaggcctggggtgcccaggcccgtgcccgcctgcggctcaagcggaccagctccatggattccccaggaggtcccctgcccctccccctgctcaaaggaggggttggcggtgcaggggcaacccctcgaaagcggggtgtcttctcttttcttgatgccttccggctgaaaccctctctgctccatatgccctaaacttatctgggaaggctggggaagtaggctctgggtccatgcctaactctgtaccgttttattcctcaaggcctatagcctgtcactccttgaagccttctctgcctgtccctccgatccttgtccaccgtctatttattgcccaatttattgtttatacggatgactgggaggcactgcaccacaacgtaggaccctggctcccctttccttgggtccttgtgttccttgcccctgtccaaccctggacagttggctctacctcagtaacactttatagcaaaatcagtgcaaataaaaatccctcagtgac

SEQ ID NO: 107024 - DNA, 2218 bp, Homo sapiens
  Payload ID: 1014
  Gene Symbol: APBB3
  Gene Name: amyloid beta (A4) precursor protein-binding, family B, member 3
  Uniprot ID: O95704
  ENST ID: ENST00000357560
  CDS Start-End: 445-1905
acgtgaccccctcccgtcgagtctcaggctgcgtgtgagcgcactcacgaccggggcgcgatgatctcactcgtgcgcgagtgcgcgcggcgcatgttcggcgtgtcggtcttcaggcgcctgatgagttcatagttgggcggtggtgtcagcggtttcgctggcgttcgtgggcctcccccggacccacacacggaaacacgcaaccattcggggatccagacgcccgtttacacgcaccacccctgggcgggctgtgcggctcaggccctcccccgggaccggcccgtgtcccgccccgtgtcccgccccgtatttgtgcggcgccagctggccccgcagcctgcggcgcagagaggctgggcttgcaggcgcagtagctccagaggtcgcgctgggctgagagtgcgggccggcagaggctggcggggagcagccggggttatgctgggcaaggattacatgctggccatcattctggtcaactgcgatgatgacttgtggggggaccacagtctggaggtggaggctggcctgcctcctggctggaggaagatccacgatgctgcaggtacttactactggcatgtacccagcggtagcacccagtggcagcgcccaacctgggaactaggagatgcagaggacccaggcacgggaacggaggggatctggggactgcggccccccaaagggagatccttctccagcctggagagttcactggaccggagtaactctctgtcctggtatggtggggaatcctacatccagagcatggagccaggggctaagtgctttgcagtccgctctctgggctgggtagaggtacctgaagaggacctggcaccggggaagagcagtattgcagtcaataactgtatccagcagctggcccagacccgcagccggagccagcctccagatggtgcctggggtgagggccagaacatgctgatgatcctgaagaaggatgccatgagcctagtgaatcccctggaccacagtctgatccactgccagcctctggtgcacatccgtgtgtggggcgtggggagctccaagggccgtgacagggacttcgcttttgtggcaagtgacaaagatagctgtatgctcaagtgccatgtgttttgctgtgatgtccctgccaaggccattgccagtgccctacatgggctttgtgcccagatcttgtcagagcgagtagaggtcagtggtgatgcctcttgctgctccccagaccccatctctcctgaagacctgccacggcaagtggagctgctggatgcggtaagccaagctgctcagaagtacgaggcactgtatatggggacactgccagtcaccaaggccatgggcatggatgtgctgaacgaggccattggtaccctcaccgccaggggggaccggaatgcctgggtccccaccatgctcagtgtgtctgactctctcatgactgcacaccccattcaggcagaggccagtacagaggaggagccattgtggcagtgccctgtgcgccttgtgacatttattggtgttggccgcgacccacacacctttggcctcatcgctgacctgggccgtcagagcttccagtgcgcagccttctggtgccagccccatgcagggggactctctgaagctgtgcaggctgcctgtatggttcagtaccagaagtgtcttgtggcctctgcagctcgaggcaaggcctggggtgcccaggcccgtgcccgcctgcggctcaagcggaccagctccatggattccccaggaggtcccctgcccctccccctgctcaaaggaggggttggcggtgcaggggcaacccctcgaaagcggggtgtcttctcttttcttgatgccttccggctgaaaccctctctgctccatatgccctaaacttatctgggaaggctggggaagtaggctctgggtccatgcctaactctgtaccgttttattcctcaaggcctatagcctgtcactccttgaagccttctctgcctgtccctccgatccttgtccaccgtctatttattgcccaatttattgtttatacggatgactgggaggcactgcaccacaacgtaggaccctggctcccctttccttgggtccttgtgttccttgcccctgtccaaccctggacagttggctctacctcagtaacactttatagcaaaatcagtgcaaataaaaatccctcagtgac

SEQ ID NO: 107025 - DNA, 2020 bp, Homo sapiens
  Payload ID: 1014
  Gene Symbol: APBB3
  Gene Name: amyloid beta (A4) precursor protein-binding, family B, member 3
  ENST ID: ENST00000358580
  CDS Start-End: 360-1379
cgcggcgcatgttcggcgtgtcggtcttcaggcgcctgatgagttcatagttgggcggtggtgtcagcggtttcgctggcgttcgtgggcctcccccggacccacacacggaaacacgcaaccattcggggatccagacgcccgtttacacgcaccacccctgggcgggctgtgcggctcaggccctcccccgggaccggcccgtgtcccgccccgtgtcccgccccgtatttgtgcggcgccagctggccccgcagcctgcggcgcagagaggctgggcttgcaggcgcagtagctccagaggtcgcgctgggctgagagtgcgggccggcagaggctggcggggagcagccggggttatgctgggcaaggattacatgctggccatcattctggtcaactgcgatgatgacttgtggggggaccacagtctggaggtggaggctggcctgcctcctggctggaggaagatccacgatgctgcaggtacttactactggcatgtacccagcggtagcacccagtggcagcgcccaacctgggaactaggagatgcagaggacccaggcacgggaacggaggggatctggggactgcggccccccaaagggagatccttctccagcctggagagttcactggaccggagtaactctctgtcctggtatggtggggaatcctacatccagagcatggagccaggggctaagtgctttgcagtccgctctctgggctgggtagaggtacctgaagaggacctggcaccggggaagagcagtattgcagtcaataactgtatccagcagctggcccagacccgcagccggagccagcctccagatggtgcctggggtgagggccagaacatgctgatgatcctgaagaaggatgccatgagcctagtgaatcccctggaccacagtctgatccactgccagcctctggtgcacatccgtgtgtggggcgtggggagctccaagggccgtgacagggacttcgcttttgtggcaagtgacaaagatagctgtatgctcaagtgccatgtgttttgctgtgatgtccctgccaaggccattgccagtgccctacatgggctttgtgcccagatcttgtcagagcgagtagaggtcagtggtgatgcctcttgctgctccccagaccccatctctcctgaagacctgccacggcaagtggagctgctggatgcggtaagccaagctgctcagaagtacgaggcactgtatatggggacactgccagtcaccaaggccatgggcagaggccagtacagaggaggagccattgtggcagtgccctgtgcgccttgtgacatttattggtgttggccgcgacccacacacctttggcctcatcgctgacctgggccgtcagagcttccagtgcgcagccttctggtgccagccccatgcagggggactctctgaagctgtgcaggctgcctgtatggttcagtaccagaagtgtcttgtggcctctgcagctcgaggcaaggcctggggtgcccaggcccgtgcccgcctgcggctcaagcggaccagctccatggattccccaggaggtcccctgcccctccccctgctcaaaggaggggttggcggtgcaggggcaacccctcgaaagcggggtgtcttctcttttcttgatgccttccggctgaaaccctctctgctccatatgccctaaacttatctgggaaggctggggaagtaggctctgggtccatgcctaactctgtaccgttttattcctcaaggcctatagcctgtcactccttgaagccttctctgcctgtccctccgatccttgtccaccgtctatttattgcccaatttattgtttatacggatgactgggaggcactgcaccacaacgtaggaccctggctcccctttccttgggtccttgtgttccttgcccctgtccaaccctggacagttggctctacctcagtaacactttatagcaaaatcagtgcaaataaaaatccctcagtgacctc

SEQ ID NO: 107026 - DNA, 1455 bp, Homo sapiens
  Payload ID: 1014
  Gene Symbol: APBB3
  Gene Name: amyloid beta (A4) precursor protein-binding, family B, member 3
  Uniprot ID: O95704
  ENST ID: ENST00000412920
  CDS Start-End: 1-1455
atgctgggcaaggattacatgctggccatcattctggtcaactgcgatgatgacttgtggggggaccacagtctggaggtggaggctggcctgcctcctggctggaggaagatccacgatgctgcaggtacttactactggcatgtacccagcggtagcacccagtggcagcgcccaacctgggaactaggagatgcagaggacccaggcacgggaacggaggggatctggggactgcggccccccaaagggagatccttctccagcctggagagttcactggaccggagtaactctctgtcctggtatggtggggaatcctacatccagagcatggagccaggggctaagtgctttgcagtccgctctctgggctgggtagaggtacctgaagaggacctggcaccggggaagagcagtattgcagtcaataactgtatccagcagctggcccagacccgcagccggagccagcctccagatggtgcctggggtgagggccagaacatgctgatgatcctgaagaaggatgccatgagcctagtgaatcccctggaccacagtctgatccactgccagcctctggtgcacatccgtgtgtggggcgtggggagctccaagggccgggacttcgcttttgtggcaagtgacaaagatagctgtatgctcaagtgccatgtgttttgctgtgatgtccctgccaaggccattgccagtgccctacatgggctttgtgcccagatcttgtcagagcgagtagaggtcagtggtgatgcctcttgctgctccccagaccccatctctcctgaagacctgccacggcaagtggagctgctggatgcggtaagccaagctgctcagaagtacgaggcactgtatatggggacactgccagtcaccaaggccatgggcatggatgtgctgaacgaggccattggtaccctcaccgccaggggggaccggaatgcctgggtccccaccatgctcagtgtgtctgactctctcatgactgcacaccccattcaggcagaggccagtacagaggaggagccattgtggcagtgccctgtgcgccttgtgacatttattggtgttggccgcgacccacacacctttggcctcatcgctgacctgggccgtcagagcttccagtgcgcagccttctggtgccagccccatgcagggggactctctgaagctgtgcaggctgcctgtatggttcagtaccagaagtgtcttgtggcctctgcagctcgaggcaaggcctggggtgcccaggcccgtgcccgcctgcggctcaagcggaccagctccatggattccccaggaggtcccctgcccctccccctgctcaaaggaggggttggcggtgcaggggcaacccctcgaaagcggggtgtcttctcttttcttgatgccttccggctgaaaccctctctgctccatatgccctaa

SEQ ID NO: 107027 - DNA, 1920 bp, Homo sapiens
  Payload ID: 1014
  Gene Symbol: APBB3
  Gene Name: amyloid beta (A4) precursor protein-binding, family B, member 3
  Uniprot ID: O95704
  ENST ID: ENST00000467078
  CDS Start-End: 1-738
atgctgggcaaggattacatgctggccatcattctggtcaactgcgatgatgacttgtggggggaccacagtctggaggtggaggctggcctgcctcctggctggaggaagatccacgatgctgcaggtacttactactggcatgtacccagcggtagcacccagtggcagcgcccaacctgggaactaggagatgcagaggacccaggcacgggaacggaggggatctggggactgcggccccccaaagggagatccttctccagcctggagagttcactggaccggagtaactctctgtcctggtatggtggggaatcctacatccagagcatggagccaggggctaagtgctttgcagtccgctctctgggctgggtagaggtacctgaagaggacctggcaccggggaagagcagtattgcagtcaataactgtatccagcagctggcccagacccgcagccggagccagcctccagatggtgcctggggtgagggccagaacatgctgatgatcctgaagaaggatgccatgagcctagtgaatcccctggaccacagtctgatccactgccagcctctggtgcacatccgtgtgtggggcgtggggagctccaagggccgatcctctgatgtggacccaggactgcttcccctgcctggtccagccctggttggggagggtgggcccagctcagcagggacagtttggggagagtccgagaggctgggctgattcccttctgtgctcccacatgcttccggaacagtgacagggacttcgcttttgtggcaagtgacaaagatagctgtatgctcaagtgccatgtgttttgctgtgatgtccctgccaaggccattgccagtgccctacatgggctttgtgcccagatcttgtcagagcgagtagaggtcagtggtgatgcctcttgctgctccccagaccccatctctcctgaagacctgccacggcaagtggagctgctggatgcggtaagccaagctgctcagaagtacgaggcactgtatatggggacactgccagtcaccaaggccatgggcatggatgtgctgaacgaggccattggtaccctcaccgccaggggggaccggaatgcctgggtccccaccatgctcagtgtgtctgactctctcatgactgcacaccccattcaggcagaggccagtacagaggaggagccattgtggcagtgccctgtgcgccttgtgacatttattggtgttggccgcgacccacacacctttggcctcatcgctgacctgggccgtcagagcttccagtgcgcagccttctggtgccagccccatgcagggggactctctgaagctgtgcaggctgcctgtatggttcagtaccagaagtgtcttgtggcctctgcagctcgaggcaaggcctggggtgcccaggcccgtgcccgcctgcggctcaagcggaccagctccatggattccccaggaggtcccctgcccctccccctgctcaaaggaggggttggcggtgcaggggcaacccctcgaaagcggggtgtcttctcttttcttgatgccttccggctgaaaccctctctgctccatatgccctaaacttatctgggaaggctggggaagtaggctctgggtccatgcctaactctgtaccgttttattcctcaaggcctatagcctgtcactccttgaagccttctctgcctgtccctccgatccttgtccaccgtctatttattgcccaatttattgtttatacggatgactgggaggcactgcaccacaacgtaggaccctggctcccctttccttgggtccttgtgttccttgcccctgtccaaccctggacagttggctctacctcagtaacactttatagcaaaatcagtgcaaataaaaatccctcagtgac

SEQ ID NO: 107028 - DNA, 1014 bp, Homo sapiens
  Payload ID: 1014
  Gene Symbol: APBB3
  Gene Name: amyloid beta (A4) precursor protein-binding, family B, member 3
  ENST ID: ENST00000511201
  CDS Start-End: 1-1014
atgctgggcaaggattacatgctggccatcattctggtcaactgcgatgatgacttgtggggggaccacagtctggaggtggaggctggcctgcctcctggctggaggaagatccacgatgctgcaggtacttactactggcatgtacccagcggtagcacccagtggcagcgcccaacctgggaactaggagatgcagaggacccaggcacgggaacggaggggatctggggactgcggccccccaaagggagatccttctccagcctggagagttcactggaccggagtaactctctgtcctggtatggtggggaatcctacatccagagcatggagccaggggctaagtgctttgcagtccgctctctgggctgggtagaggtacctgaagaggacctggcaccggggaagagcagtattgcagtcaataactgtatccagcagctggcccagacccgcagccggagccagcctccagatggtgcctggggtgagggccagaacatgctgatgatcctgaagaaggatgccatgagcctagtgaatcccctggaccacagtctgatccactgccagcctctggtgcacatccgtgtgtggggcgtggggagctccaagggccgggacttcgcttttgtggcaagtgacaaagatagctgtatgctcaagtgccatgtgttttgctgtgatgtccctgccaaggccattgccagtgccctacatgggctttgtgcccagatcttgtcagagcgagtagaggtcagtggtgatgcctcttgctgctccccagaccccatctctcctgaagacctgccacggcaagtggagctgctggatgcggtaagccaagctgctcagaagtacgaggcactgtatatggggacactgccagtcaccaaggccatgggcagaggccagtacagaggaggagccattgtggcagtgccctgtgcgccttgtgacatttattggtgttggccgcgacccacacacctttggcctcatcgctga

SEQ ID NO: 107029 - DNA, 2020 bp, Homo sapiens
  Payload ID: 1014
  Gene Symbol: APBB3
  Gene Name: amyloid beta (A4) precursor protein-binding, family B, member 3
  Uniprot ID: O95704
  ENST ID: ENST00000509914
  CDS Start-End: 88-732
ggctgggcttgcaggcgcagtagctccagaggtcgcgctgggctgagagtgcgggccggcagaggctggcggggagcagccggggttatgctgggcaaggattacatgctggccatcattctggtcaactgcgatgatgacttgtggggggaccacagtctggaggtggaggctggcctgcctcctggctggaggaagatccacgatgctgcaggtacttactactggcatgtacccagcggtagcacccagtggcagcgcccaacctgggaactaggagatgcagaggacccaggcacgggaacggaggggatctggggactgcggccccccaaagggagatccttctccagcctggagagttcactggaccggagtaactctctgtcctggtatggtggggaatcctacatccagagcatggagccaggggctaagtgctttgcagtccgctctctgggctgggtagaggtacctgaagaggacctggcaccggggaagagcagtattgcagtcaataactgtatccagcagctggcccagacccgcagccggagccagcctccagatggtgcctggggtgagggccagaacatgctgatgatcctgaagaaggatgccatgagcctagtgaatcccctggaccacagtctgatccactgccagcctctggctgtgatccccactgatgctgatccccagtacttgaacccctggacacagatcctctgatgtggacccaggactgcttcccctgcctggtccagccctggttggggagggtgggcccagctcagcagggacagtttggggagagtccgagaggctgggctgattcccttctgtgctcccacatgcttccggaacagtgacagggacttcgcttttgtggcaagtgacaaagatagctgtatgctcaagtgccatgtgttttgctgtgatgtccctgccaaggccattgccagtgccctacatgggctttgtgcccagatcttgtcagagcgagtagaggtcagtggtgatgcctcttgctgctccccagaccccatctctcctgaagacctgccacggcaagtggagctgctggatgcggtaagccaagctgctcagaagtacgaggcactgtatatggggacactgccagtcaccaaggccatgggcatggatgtgctgaacgaggccattggtaccctcaccgccaggggggaccggaatgcctgggtccccaccatgctcagtgtgtctgactctctcatgactgcacaccccattcaggcagaggccagtacagaggaggagccattgtggcagtgccctgtgcgccttgtgacatttattggtgttggccgcgacccacacacctttggcctcatcgctgacctgggccgtcagagcttccagtgcgcagccttctggtgccagccccatgcagggggactctctgaagctgtgcaggctgcctgtatggttcagtaccagaagtgtcttgtggcctctgcagctcgaggcaaggcctggggtgcccaggcccgtgcccgcctgcggctcaagcggaccagctccatggattccccaggaggtcccctgcccctccccctgctcaaaggaggggttggcggtgcaggggcaacccctcgaaagcggggtgtcttctcttttcttgatgccttccggctgaaaccctctctgctccatatgccctaaacttatctgggaaggctggggaagtaggctctgggtccatgcctaactctgtaccgttttattcctcaaggcctatagcctgtcactccttgaagccttctctgcctgtccctccgatccttgtccaccgtctatttattgcccaatttattgtttatacggatgactgggaggcactgcaccacaacgtaggaccctggctcccctttccttgggtccttgtgttccttgcccctgtccaaccctggacagttggctctacctcagtaacactttatagcaaaatcagtgcaaataaaaatccctcagtgacctc

SEQ ID NO: 107030 - DNA, 2032 bp, Homo sapiens
  Payload ID: 1014
  Gene Symbol: APBB3
  Gene Name: amyloid beta (A4) precursor protein-binding, family B, member 3
  ENST ID: ENST00000511896
  CDS Start-End: 127-618
gtgcggcgccagctggccccgcagcctgcggcgcagagaggctgggcttgcaggcgcagtagctccagaggtcgcgctgggctgagagtgcgggccggcagaggctggcggggagcagccggggttatgctgggcaaggattacatgctggccatcattctggtcaactgcgatgatgacttgtggggggaccacagtctggaggtggaggctggcctgcctcctggctggaggaagatccacgatgctgcaggtacttactactggcatgtacccagcggtagcacccagtggcagcgcccaacctgggaactaggagatgcagaggacccaggcacgtgctttgcagtccgctctctgggctgggtagaggtacctgaagaggacctggcaccggggaagagcagtattgcagtcaataactgtatccagcagctggcccagacccgcagccggagccagcctccagatggtgcctggggtgagggccagaacatgctgatgatcctgaagaaggatgccatgagcctagtgaatcccctggaccacagtctgatccactgccagcctctggtgcacatccgtgtgtggggcgtggggagctccaagggccggtgaggatgcctacatcccccaagcaagagctacttctccctcccggctgcaggctgtgatccccactgatgctgatccccagtacttgaacccctggacacagatcctctgatgtggacccaggactgcttcccctgcctggtccagccctggttggggagggtgggcccagctcagcagggacagtttggggagagtccgagaggctgggctgattcccttctgtgctcccacatgcttccggaacagtgacaggtgagtgaaaaccaggtatcctgagccccatccctgatgtccctactccatccctgctatatccctagcctgactttccagcctcctgcaggctcctgcctctaaccagcttctaccccagccccatctctgcccctgctagggacttcgcttttgtggcaagtgacaaagatagctgtatgctcaagtgccatgtgttttgctgtgatgtccctgccaaggccattgccagtgccctacatgggctttgtgcccagatcttgtcagagcgagtagaggtcagtggtgatgcctcttgctgctccccagaccccatctctcctgaagacctgccacggcaagtggagctgctggatgcggtaagccaagctgctcagaagtacgaggcactgtatatggggacactgccagtcaccaaggccatgggcatggatgtgctgaacgaggccattggtaccctcaccgccaggggggaccggaatgcctgggtccccaccatgctcagtgtgtctgactctctcatgactgcacaccccattcaggcagaggccagtacagaggaggagccattgtggcagtgccctgtgcgccttgtgacatttattggtgttggccgcgacccacacacctttggcctcatcgctgacctgggccgtcagagcttccagtgcgcagccttctggtgccagccccatgcagggggactctctgaagctgtgcaggctgcctgtatggttcagtaccagaagtgtcttgtggcctctgcagctcgaggcaaggcctggggtgcccaggcccgtgcccgcctgcggctcaagcggaccagctccatggattccccaggaggtcccctgcccctccccctgctcaaaggaggggttggcggtgcaggggcaacccctcgaaagcggggtgtcttctcttttcttgatgccttccggctgaaaccctctctgctccatatgccctaaacttatctgggaaggctggggaagtaggctctgggtccatgcctaactctgtaccgttttattcctcaaggcctatagcctgtcactccttgaagccttctctgcctgtccctccgatccttgtccaccgtctatttattgcccaatttattgtttatacggatgactgggaggcactgcaccacaacgta

SEQ ID NO: 107031 - DNA, 2495 bp, Homo sapiens
  Payload ID: 1015
  Gene Symbol: APLP1
  Gene Name: amyloid beta (A4) precursor-like protein 1
  Uniprot ID: P51693
  ENST ID: ENST00000221891
  CDS Start-End: 193-2148
actctgcgcgaagccgccacgctattgtcctgaccaggaaggcggggccggcgcggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatgcagacacccccatgacccttccaaaagggtccacagaacaagatgctgcatcccctgagaaagagaagatgaacccgctggaacagtatgagcgaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccct

SEQ ID NO: 107032 - DNA, 2266 bp, Homo sapiens
  Payload ID: 1015
  Gene Symbol: APLP1
  Gene Name: amyloid beta (A4) precursor-like protein 1
  ENST ID: ENST00000537454
  CDS Start-End: 346-2181
aatcctgaggtgctgcatccacagtgggcatggtgctggtgcctgcttggatgatccttaaagaaaggtcctgggggctttggttcatggatccttgagctaggagttaaaggtccaggcccctgggacccttgggaagcagagcaagaagagtgaactcctgggtctgaaggagaatgggctgggggcttggtctctggtcctgagagagaaggtgcccagacttctggatctgaaagaggaagggactaggtctcaactgctgccttcttgactggggacattttggaggcctgtattcctgagccctcaacagaggaatgtactaggggatgggggtctctgatgcttgcatccttggaaaaggacaaaactgccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatgacacccccatgacccttccaaaagggtccacagaacaagatgctgcatcccctgagaaagagaagatgaacccgctggaacagtatgagcgaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagca

SEQ ID NO: 107033 - DNA, 2052 bp, Homo sapiens
  Payload ID: 1015
  Gene Symbol: APLP1
  Gene Name: amyloid beta (A4) precursor-like protein 1
  ENST ID: ENST00000586861
  CDS Start-End: 66-2000
atagcaacgggagcgctggggcgcccccgccctacgggagctgtttcccagggaacggtgcctccatggaggcggtgtgcggtgcttgggggagggggctggtgctgggggtctcggtcctagggagcaaagaaccaggggaccctcatgccaacgccccccgagccctcactgtcctttccacttccatccaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatgacacccccatgacccttccaaaagggtccacagaacaagatgctgcatcccctgagaaagagaagatgaacccgctggaacagtatgagcgaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggag

SEQ ID NO: 107034 - DNA, 586 bp, Homo sapiens
  Payload ID: 1015
  Gene Symbol: APLP1
  Gene Name: amyloid beta (A4) precursor-like protein 1
  ENST ID: ENST00000589743
  CDS Start-End: 68-586
aaatttataacgggaagggagagttttggagaggcggaatagaggaaaaggcggggcctaaaggaggatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtc

SEQ ID NO: 107035 - DNA, 664 bp, Homo sapiens
  Payload ID: 1015
  Gene Symbol: APLP1
  Gene Name: amyloid beta (A4) precursor-like protein 1
  ENST ID: ENST00000588808
  CDS Start-End: 1-664
gtgaatgggccatggcagacaaccagtccaagaacctgcctaaagccgacagacaggccctgaatgaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatgacacccccatgacccttccaaaagggtccacagaacaagatgctgcatcccctgagaaagagaagatgaacccgctggaacagtatgagcgaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcg

SEQ ID NO: 107036 - DNA, 2295 bp, Homo sapiens
  Payload ID: 1015
  Gene Symbol: APLP1
  Gene Name: amyloid beta (A4) precursor-like protein 1
  ENST ID: ENST00000590561
  CDS Start-End: 75-431
gctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatgcagacacccccatgacccttccaaaagggtccacagaacaagatgctgcatcccctgagaaagagaagatgaacccgctggaacagtatgagcgaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccct

SEQ ID NO: 107037 - DNA, 1324 bp, Homo sapiens
  Payload ID: 1015
  Gene Symbol: APLP1
  Gene Name: amyloid beta (A4) precursor-like protein 1
  ENST ID: ENST00000592316
  CDS Start-End: 443-1324
ctagggaagcgatgtcctcatgaatactagagccttgaaaacggacctggccgggcgcggtggctcacgcctgtaatcgcagcacttggggaggccgaggcaggcggatcacctgaggtcagaagttcgagaccagcctggccaacacggcgaaactccgtctctactaaaaatacaaaaattagcctggcatggtggtgcgtgcctgtaatcccagctactcaggaggctgagacaggagaatcgcttgaacctgggaggaggaggttgcagtgagccgagattgtaccattccactccagcctgggcgacaagagcaaatctccgtctcaaagaaagaaagaaagagggagaaagaaagagaaaagggacctgactactggagaggggtggctggcaggggcggggcagtgggctgattgcccccatctgatccccccagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgcc

SEQ ID NO: 107038 - DNA, 1179 bp, Homo sapiens
  Payload ID: 1015
  Gene Symbol: APLP1
  Gene Name: amyloid beta (A4) precursor-like protein 1
  ENST ID: ENST00000587274
  CDS Start-End: 1-869
tccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatgggtccacagaacaagatgctgcatcccctgagaaagagaagatgaacccgctggaacagtatgagcgaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcat

SEQ ID NO: 107039 - DNA, 3727 bp, Homo sapiens
  Payload ID: 1016
  Gene Symbol: APLP2
  Gene Name: amyloid beta (A4) precursor-like protein 2
  Uniprot ID: Q06481
  ENST ID: ENST00000263574
  CDS Start-End: 73-2364
gtcgcggtgtgctaagcgaggagtccgagtgtgtgagcttgagagccgcgcgctagagcgacccggcgagggatggcggccaccgggaccgcggccgccgcagccacgggcaggctcctgcttctgctgctggtggggctcacggcgcctgccttggcgctggccggctacatcgaggctcttgcagccaatgccggaacaggatttgctgttgctgagcctcaaatcgcaatgttttgtgggaagttaaatatgcatgtgaacattcagactgggaaatgggaacctgatccaacaggcaccaagagctgctttgaaacaaaagaagaagttcttcagtactgtcaggagatgtatccagagctacagatcacaaatgtgatggaggcaaaccagcgggttagtattgacaactggtgccggagggacaaaaagcaatgcaagagtcgctttgttacacctttcaagtgtctcgtgggtgaatttgtaagtgatgtcctgctagttccagaaaagtgccagtttttccacaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagctgtctgctcccaggaggcgatgacggggccctgccgggccgtgatgcctcgttggtacttcgacctctccaagggaaagtgcgtgcgctttatatatggtggctgcggcggcaacaggaacaattttgagtctgaggattattgtatggctgtgtgtaaagcgatgattcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaagacactcagccggagttgtaccacccaatgaaaaaaggatctggagtgggagagcaggatgggggactgatcggtgccgaagagaaagtgattaacagtaagaataaagtggatgaaaacatggtcattgacgagactctggatgttaaggaaatgattttcaatgccgagagagttggaggcctcgaggaagagcgggaatccgtgggcccactgcgggaggacttcagtctgagtagcagtgctctcattggcctgctggtcatcgcagtggccattgccacggtcatcgtcatcagcctggtgatgctgaggaagaggcagtatggcaccatcagccacgggatcgtggaggttgatccaatgctcaccccagaagagcgtcacctgaacaagatgcagaaccatggctatgagaaccccacctacaaatacctggagcagatgcagatttaggtggcagggagcgcggcagccctggcggagggatgcaggtgggccggaagatcccacgattccgatcgactgccaagcagcagccgctgccaggggctgcgtctgacatcctgacctcctggactgtaggactatataaagtactactgtagaactgcaatttccattcttttaaatgggtgaaaaatggtaatataacaatatatgatatataaaccttaaatgaaaaaaatgatctattgcagatatttgatgtagttttcttttttaaattaatcagaaaccccacttccattgtattgtctgacacatgctctcaatatataataaatgggaaatgtcgattttcaataatagacttatatgcaggctgtcgttccggttatgttgtgtaagtcaactcttcagcctcattcactgtcctggcttttatttaaagaaaaaaaaggcagtattccctttttaaatgagctttcaggaagttgctgagaaatggggtggaatagggaactgtaatggccactgaagcacgtgagagaccctcgcaaaatgatgtgaaaggaccagtttcttgaagtccagtgtttccacggctggatacctgtgtgtctccataaaagtcctgtcaccaaggacgttaaaggcattttattccagcgtcttctagagagcttagtgtatacagatgagggtgtccgctgctgctttccttcggaatccagtgcttccacagagattagcctgtagcttatatttgacattcttcactgtctgttgtttacctaccgtagctttttaccgttcacttccccttccaactatgtccagatgtgcaggctcctcctctctggactttctccaaaggcactgaccctcggcctctactttgtcccctcacctccaccccctcctgtcaccggccttgtgacattcactcagagaagaccacaccaaggaggcggccgctggcccaggagagaacacggggaggtttgtttgtgtgaaaggaaagtagtccaggctgtccctgaaactgagtctgtggacactgtggaaagctttgaacaattgtgttttcgtcacaggagtctttgtaatgcttgtacagttgatgtcgatgctcactgcttctgctttttctttctttttattttaaatctgaaggttctggtaacctgtggtgtatttttattttcctgtgactgtttttgttttgtttttttcctttttcctcccctttgaccctattcatgtctctacccactatgcacagattaaacttcacctacaaactccttaatatgatctgtggagaatgtacacagtttaaacacatcaataaatactttaacttccaccgaga

SEQ ID NO: 107040 - DNA, 1862 bp, Homo sapiens
  Payload ID: 1016
  Gene Symbol: APLP2
  Gene Name: amyloid beta (A4) precursor-like protein 2
  Uniprot ID: Q06481
  ENST ID: ENST00000345598
  CDS Start-End: 63-1631
gctaagcgaggagtccgagtgtgtgagcttgagagccgcgcgctagagcgacccggcgagggatggcggccaccgggaccgcggccgccgcagccacgggcaggctcctgcttctgctgctggtggggctcacggcgcctgccttggcgctggccggctacatcgaggctcttgcagccaatgccggaacaggatttgctgttgctgagcctcaaatcgcaatgttttgtgggaagttaaatatgcatgtgaacattcagactgggaaatgggaacctgatccaacaggcaccaagagctgctttgaaacaaaagaagaagttcttcagtactgtcaggagatgtatccagagctacagatcacaaatgtgatggaggcaaaccagcgggttagtattgacaactggtgccggagggacaaaaagcaatgcaagagtcgctttgttacacctttcaagtgtctcgttcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaaggatctggagtgggagagcaggatgggggactgatcggtgccgaagagaaagtgattaacagtaagaataaagtggatgaaaacatggtcattgacgagactctggatgttaaggaaatgattttcaatgccgagagagttggaggcctcgaggaagagcgggaatccgtgggcccactgcgggaggacttcagtctgagtagcagtgctctcattggcctgctggtcatcgcagtggccattgccacggtcatcgtcatcagcctggtgatgctgaggaagaggcagtatggcaccatcagccacgggatcgtggaggttgatccaatgctcaccccagaagagcgtcacctgaacaagatgcagaaccatggctatgagaaccccacctacaaatacctggagcagatgcagatttaggtggcagggagcgcggcagccctggcggagggatgcaggtgggccggaagatcccacgattccgatcgactgccaagcagcagccgctgccaggggctgcgtctgacatcctgacctcctggactgtaggactatataaagtactactgtagaactgcaatttccattcttttaaatgggtgaaaaatggtaatataacaatatatgatatataaaccttaaatgaaaaaa

SEQ ID NO: 107041 - DNA, 3687 bp, Homo sapiens
  Payload ID: 1016
  Gene Symbol: APLP2
  Gene Name: amyloid beta (A4) precursor-like protein 2
  Uniprot ID: Q06481
  ENST ID: ENST00000278756
  CDS Start-End: 46-2331
tttgttgccaggtggacgcggccccggccttcgcgcgcggcagggatgctgcgagccccgggggagctcccgcgccaggccgcccgctgctccctctgccgcctggggccgggtcgcggacgcgcattttttaagtggcgctgtttgcctgcgtccgtagaccgaggaaacccgctctgggctcttgcagccaatgccggaacaggatttgctgttgctgagcctcaaatcgcaatgttttgtgggaagttaaatatgcatgtgaacattcagactgggaaatgggaacctgatccaacaggcaccaagagctgctttgaaacaaaagaagaagttcttcagtactgtcaggagatgtatccagagctacagatcacaaatgtgatggaggcaaaccagcgggttagtattgacaactggtgccggagggacaaaaagcaatgcaagagtcgctttgttacacctttcaagtgtctcgtgggtgaatttgtaagtgatgtcctgctagttccagaaaagtgccagtttttccacaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagctgtctgctcccaggaggcgatgacggggccctgccgggccgtgatgcctcgttggtacttcgacctctccaagggaaagtgcgtgcgctttatatatggtggctgcggcggcaacaggaacaattttgagtctgaggattattgtatggctgtgtgtaaagcgatgattcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaaggatctggagtgggagagcaggatgggggactgatcggtgccgaagagaaagtgattaacagtaagaataaagtggatgaaaacatggtcattgacgagactctggatgttaaggaaatgattttcaatgccgagagagttggaggcctcgaggaagagcgggaatccgtgggcccactgcgggaggacttcagtctgagtagcagtgctctcattggcctgctggtcatcgcagtggccattgccacggtcatcgtcatcagcctggtgatgctgaggaagaggcagtatggcaccatcagccacgggatcgtggaggttgatccaatgctcaccccagaagagcgtcacctgaacaagatgcagaaccatggctatgagaaccccacctacaaatacctggagcagatgcagatttaggtggcagggagcgcggcagccctggcggagggatgcaggtgggccggaagatcccacgattccgatcgactgccaagcagcagccgctgccaggggctgcgtctgacatcctgacctcctggactgtaggactatataaagtactactgtagaactgcaatttccattcttttaaatgggtgaaaaatggtaatataacaatatatgatatataaaccttaaatgaaaaaaatgatctattgcagatatttgatgtagttttcttttttaaattaatcagaaaccccacttccattgtattgtctgacacatgctctcaatatataataaatgggaaatgtcgattttcaataatagacttatatgcaggctgtcgttccggttatgttgtgtaagtcaactcttcagcctcattcactgtcctggcttttatttaaagaaaaaaaaggcagtattccctttttaaatgagctttcaggaagttgctgagaaatggggtggaatagggaactgtaatggccactgaagcacgtgagagaccctcgcaaaatgatgtgaaaggaccagtttcttgaagtccagtgtttccacggctggatacctgtgtgtctccataaaagtcctgtcaccaaggacgttaaaggcattttattccagcgtcttctagagagcttagtgtatacagatgagggtgtccgctgctgctttccttcggaatccagtgcttccacagagattagcctgtagcttatatttgacattcttcactgtctgttgtttacctaccgtagctttttaccgttcacttccccttccaactatgtccagatgtgcaggctcctcctctctggactttctccaaaggcactgaccctcggcctctactttgtcccctcacctccaccccctcctgtcaccggccttgtgacattcactcagagaagaccacaccaaggaggcggccgctggcccaggagagaacacggggaggtttgtttgtgtgaaaggaaagtagtccaggctgtccctgaaactgagtctgtggacactgtggaaagctttgaacaattgtgttttcgtcacaggagtctttgtaatgcttgtacagttgatgtcgatgctcactgcttctgctttttctttctttttattttaaatctgaaggttctggtaacctgtggtgtatttttattttcctgtgactgtttttgttttgtttttttcctttttcctcccctttgaccctattcatgtctctacccactatgcacagattaaacttcacctacaaactccttaatatgatctgtggagaatgtacacagtttaaacacatcaataaatactttaacttcc

SEQ ID NO: 107042 - DNA, 3270 bp, Homo sapiens
  Payload ID: 1016
  Gene Symbol: APLP2
  Gene Name: amyloid beta (A4) precursor-like protein 2
  Uniprot ID: Q06481
  ENST ID: ENST00000338167
  CDS Start-End: 58-2313
gcgaggagtccgagtgtgtgagcttgagagccgcgcgctagagcgacccggcgagggatggcggccaccgggaccgcggccgccgcagccacgggcaggctcctgcttctgctgctggtggggctcacggcgcctgccttggcgctggccggctacatcgaggctcttgcagccaatgccggaacaggatttgctgttgctgagcctcaaatcgcaatgttttgtgggaagttaaatatgcatgtgaacattcagactgggaaatgggaacctgatccaacaggcaccaagagctgctttgaaacaaaagaagaagttcttcagtactgtcaggagatgtatccagagctacagatcacaaatgtgatggaggcaaaccagcgggttagtattgacaactggtgccggagggacaaaaagcaatgcaagagtcgctttgttacacctttcaagtgtctcgtgggtgaatttgtaagtgatgtcctgctagttccagaaaagtgccagtttttccacaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagctgtctgctcccaggaggcgatgacggggccctgccgggccgtgatgcctcgttggtacttcgacctctccaagggaaagtgcgtgcgctttatatatggtggctgcggcggcaacaggaacaattttgagtctgaggattattgtatggctgtgtgtaaagcgatgattcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaaggatctggagtgggagagcaggatgggggactgatcggtgccgaagagaaagtgattaacagtaagaataaagtggatgaaaacatggtcattgacgagactctggatgttaaggaaatgattttcaatgccgagagagttggaggcctcgaggaagagcgggaatccgtgggcccactgcgggaggacttcagtctgagtagcagtgctctcattggcctgctggtcatcgcagtggccattgccacggtcatcgtcatcagcctggtgatgctgaggaagaggcagtatggcaccatcagccacgggatcgtggaggttgatccaatgctcaccccagaagagcgtcacctgaacaagatgcagaaccatggctatgagaaccccacctacaaatacctggagcagatgcagatttaggtggcagggagcgcggcagccctggcggagggatgcaggtgggccggaagatcccacgattccgatcgactgccaagcagcagccgctgccaggggctgcgtctgacatcctgacctcctggactgtaggactatataaagtactactgtagaactgcaatttccattcttttaaatgggtgaaaaatggtaatataacaatatatgatatataaaccttaaatgaaaaaaatgatctattgcagatatttgatgtagttttcttttttaaattaatcagaaaccccacttccattgtattgtctgacacatgctctcaatatataataaatgggaaatgtcgattttcaataatagacttatatgcaggctgtcgttccggttatgttgtgtaagtcaactcttcagcctcattcactgtcctggcttttatttaaagaaaaaaaaggcagtattccctttttaaatgagctttcaggaagttgctgagaaatggggtggaatagggaactgtaatggccactgaagcacgtgagagaccctcgcaaaatgatgtgaaaggaccagtttcttgaagtccagtgtttccacggctggatacctgtgtgtctccataaaagtcctgtcaccaaggacgttaaaggcattttattccagcgtcttctagagagcttagtgtatacagatgagggtgtccgctgctgctttccttcggaatccagtgcttccacagagattagcctgtagcttatatttgacattcttcactgtctgttgtttacctaccgtagctttttaccgttcacttccccttccaactatgtccagatgtgcaggctcctcctctctggactttctccaaaggcactgaccctcggcctctactttgtcccctcacctccaccccctcctgtcaccggccttgtgacattcactcagagaagaccacaccaagga

SEQ ID NO: 107043 - DNA, 542 bp, Homo sapiens
  Payload ID: 1016
  Gene Symbol: APLP2
  Gene Name: amyloid beta (A4) precursor-like protein 2
  ENST ID: ENST00000530132
  CDS Start-End: 85-192
agatgcttctgggtcgcggtgtgctaagcgaggagtccgagtgtgtgagcttgagagccgcgcgctagagcgacccggcgagggatggcggccaccgggaccgcggccgccgcagccacgggcaggctcctgcttctgctgctggtggggctcacggcgcctgccttggcgctggccggctacatcgagtagtacagtgagtagaagagtaatggttggccgaggccagtccctagtgtctccataccccctggaaataagtttcatggacttcctattttataatgggcaatcagaaaaaaaacacagggactgatgaagaacctgttcatttgagaatttcaggctcttgcagccaatgccggaacaggatttgctgttgctgagcctcaaatcgcaatgttttgtgggaagttaaatatgcatgtgaacattcagactgggaaatgggaacctgatccaacaggcaccaagagctgctttgaaacaaaagaagaagttcttcagtactgtcaggagatgtatccagagctacagatcac

SEQ ID NO: 107044 - DNA, 560 bp, Homo sapiens
  Payload ID: 1016
  Gene Symbol: APLP2
  Gene Name: amyloid beta (A4) precursor-like protein 2
  ENST ID: ENST00000533195
  CDS Start-End: 85-560
agatgcttctgggtcgcggtgtgctaagcgaggagtccgagtgtgtgagcttgagagccgcgcgctagagcgacccggcgagggatggcggccaccgggaccgcggccgccgcagccacgggcaggctcctgcttctgctgctggtggggctcacggcgcctgccttggcgctggccggctacatcgagtcttctcagatctgttgcagtccccggtctttcctgatcagcaccctcaaatgtctcattgtggatgagattaatgctcttgcagccaatgccggaacaggatttgctgttgctgagcctcaaatcgcaatgttttgtgggaagttaaatatgcatgtgaacattcagactgggaaatgggaacctgatccaacaggcaccaagagctgctttgaaacaaaagaagaagttcttcagtactgtcaggagatgtatccagagctacagatcacaaatgtgatggaggcaaaccagcgggttagtattgacaactggtgccggagggacaaaaagcaatgcaagagtcgctttgttacacctttcaagtgtct

SEQ ID NO: 107045 - DNA, 560 bp, Homo sapiens
  Payload ID: 1016
  Gene Symbol: APLP2
  Gene Name: amyloid beta (A4) precursor-like protein 2
  ENST ID: ENST00000533713
  CDS Start-End: 85-560
agatgcttctgggtcgcggtgtgctaagcgaggagtccgagtgtgtgagcttgagagccgcgcgctagagcgacccggcgagggatggcggccaccgggaccgcggccgccgcagccacgggcaggctcctgcttctgctgctggctcttgcagccaatgccggaacaggatttgctgttgctgagcctcaaatcgcaatgttttgtgggaagttaaatatgcatgtgaacattcagactgggaaatgggaacctgatccaacaggcaccaagagctgctttgaaacaaaagaagaagttcttcagtactgtcaggagatgtatccagagctacagatcacaaatgtgatggaggcaaaccagcgggttagtattgacaactggtgccggagggacaaaaagcaatgcaagagtcgctttgttacacctttcaagtgtctcgtgggtgaatttgtaagtgatgtcctgctagttccagaaaagtgccagtttttccacaaagagcggatggaggtgtgtgagaatcaccagcactggcacacggtagtcaaagaggtaag

SEQ ID NO: 107046 - DNA, 2041 bp, Homo sapiens
  Payload ID: 1016
  Gene Symbol: APLP2
  Gene Name: amyloid beta (A4) precursor-like protein 2
  ENST ID: ENST00000533616
  CDS Start-End: 142-261
aatatgaagtcagttccggttggtgtaaaacccccggggcggcggcgaactggctttagatgcttctgggtcgcggtgtgctaagcgaggagtccgagtgtgtgagcttgagagccgcgcgctagagcgacccggcgagggatggcggccaccgggaccgcggccgccgcagccacgggcaggctcctgcttctgctgctggtggggctcacggcgcctgccttggcgctggccggctacatcgagtgggtgaatttgtaagtgatgtcctgctagttccagaaaagtgccagtttttccacaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagttcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaagacactcagccggagttgtaccacccaatgaaaaaaggatctggagtgggagagcaggatgggggactgatcggtgccgaagagaaagtgattaacagtaagaataaagtggatgaaaacatggtcattgacgagactctggatgttaaggaaatgattttcaatgccgagagagttggaggcctcgaggaagagcgggaatccgtgggcccactgcgggaggacttcagtctgagtagcagtgctctcattggcctgctggtcatcgcagtggccattgccacggtcatcgtcatcagcctggtgatgctgaggaagaggcagtatggcaccatcagccacgggatcgtggaggttgatccaatgctcaccccagaagagcgtcacctgaacaagatgcagaaccatggctatgagaaccccacctacaaatacctggagcagatgcagatttaggtggcagggagcgcggcagccctggcggagggatgcaggtgggccggaagatcccacgattccgatcgactgcc

SEQ ID NO: 107047 - DNA, 556 bp, Homo sapiens
  Payload ID: 1016
  Gene Symbol: APLP2
  Gene Name: amyloid beta (A4) precursor-like protein 2
  ENST ID: ENST00000534582
  CDS Start-End: 85-435
agatgcttctgggtcgcggtgtgctaagcgaggagtccgagtgtgtgagcttgagagccgcgcgctagagcgacccggcgagggatggcggccaccgggaccgcggccgccgcagccacgggcaggctcctgcttctgctgctggtggggctcacggcgcctgccttggcgctggccggctacatcgaggctcttgcagccaatgccggaacaggatttgctgttgctgagcctcaaatcgcaatgttttgtgggaagttaaatatgcatgtgaacattcagactgggaaatgggaacctgatccaacaggcaccaagagctgctttgaaacaaaagaagaagttcttcagtactgtcaggagatgtatccagagctacagatcacaaatagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattgg

SEQ ID NO: 107048 - DNA, 2530 bp, Homo sapiens
  Payload ID: 1016
  Gene Symbol: APLP2
  Gene Name: amyloid beta (A4) precursor-like protein 2
  Uniprot ID: Q06481
  ENST ID: ENST00000528499
  CDS Start-End: 85-2172
agatgcttctgggtcgcggtgtgctaagcgaggagtccgagtgtgtgagcttgagagccgcgcgctagagcgacccggcgagggatggcggccaccgggaccgcggccgccgcagccacgggcaggctcctgcttctgctgctggtggggctcacggcgcctgccttggcgctggccggctacatcgaggctcttgcagccaatgccggaacaggatttgctgttgctgagcctcaaatcgcaatgttttgtgggaagttaaatatgcatgtgaacattcagactgggaaatgggaacctgatccaacaggcaccaagagctgctttgaaacaaaagaagaagttcttcagtactgtcaggagatgtatccagagctacagatcacaaatgtgatggaggcaaaccagcgggttagtattgacaactggtgccggagggacaaaaagcaatgcaagagtcgctttgttacacctttcaagtgtctcgtgggtgaatttgtaagtgatgtcctgctagttccagaaaagtgccagtttttccacaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagttcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaaggatctggagtgggagagcaggatgggggactgatcggtgccgaagagaaagtgattaacagtaagaataaagtggatgaaaacatggtcattgacgagactctggatgttaaggaaatgattttcaatgccgagagagttggaggcctcgaggaagagcgggaatccgtgggcccactgcgggaggacttcagtctgagtagcagtgctctcattggcctgctggtcatcgcagtggccattgccacggtcatcgtcatcagcctggtgatgctgaggaagaggcagtatggcaccatcagccacgggatcgtggaggttgatccaatgctcaccccagaagagcgtcacctgaacaagatgcagaaccatggctatgagaaccccacctacaaatacctggagcagatgcagatttaggtggcagggagcgcggcagccctggcggagggatgcaggtgggccggaagatcccacgattccgatcgactgccaagcagcagccgctgccaggggctgcgtctgacatcctgacctcctggactgtaggactatataaagtactactgtagaactgcaatttccattcttttaaatgggtgaaaaatggtaatataacaatatatgatatataaaccttaaatgaaaaaaatgatctattgcagatatttgatgtagttttcttttttaaattaatcagaaaccccacttccattgtattgtctgacacatgctctcaatatataataaatgggaaatgtcgattttcaataataga

SEQ ID NO: 107049 - DNA, 6478 bp, Homo sapiens
  Payload ID: 1017
  Gene Symbol: APPBP2
  Gene Name: amyloid beta precursor protein (cytoplasmic tail) binding protein 2
  Uniprot ID: Q92624
  ENST ID: ENST00000083182
  CDS Start-End: 289-2046
gagatcagcgctgggacggaacccgggttcctctcgaaccgggattgtgacgcttttggcctggctggccgctgttttctgtcccactttttactcgggcctgcgtccgctgccgccgtccctcagtttgcccccggaggaggcagggcggccgtgccttctgccgtgcgcccgcgtggctgccaccgcccctccgaatcctccggggccgcagaggggttcgctacggagggaggtgggggccttcgggaggaggaggcggaggaggcggaggaggagggaaggaagatggcggccgtggaactagagtggatcccagagactctctataacaccgccatctccgctgtcgtggacaactacatccgctcccgccgagacatccgctccttgcccgagaacatccagtttgatgtttactacaagctttaccaacagggacgcttatgtcaactgggcagtgaattttgtgaattggaagtttttgctaaagtactgagagctttggataaaagacatttgcttcatcattgttttcaggctttgatggatcatggtgttaaagttgcttcagtcttggcctactcattcagtaggcggtgctcttatatagcagaatcagatgctgcagtaaaggaaaaagccattcaggttggctttgttttaggtggctttctttcagatgcaggctggtacagtgatgctgagaaagtttttctgtcctgccttcagttgtgtactctacacgatgagatgcttcattggtttcgtgcagtagaatgttgtgtgaggttgcttcatgtgcgaaatggaaactgcaaatatcatttgggtgaagaaacatttaaattagctcagacatatatggataaactatcaaaacatggccagcaagcaaataaagctgcactctatggagaactgtgtgcactcctatttgcaaaaagtcactatgatgaggcatacaaatggtgcatcgaggcaatgaaagaaattacagcaggcttaccagtgaaagttgtggtggatgtcttaagacaagcttctaaggcttgtgtagtaaaacgtgaatttaagaaggcagaacagttaattaaacatgcagtgtatttggcacgggatcattttggatccaaacacccaaaatattctgatacactgctagattatgggttctacttactcaatgtagataatatctgtcagtctgttgcaatttatcaggcagcccttgacattagacagtcagtgtttggtggcaaaaatatccacgtagcaacagctcatgaagatttggcctactcttcttatgtccaccagtatagctctgggaaatttgacaatgcactatttcatgcagaaagagctattggtatcattacccacatcctacctgaagatcatcttcttttggcttcttcaaagagggtgaaagcacttattttagaggagattgcaattgattgtcataataaggaaactgaacagaggctgcttcaagaagctcatgatttgcacctgtcttcactccaactagctaaaaaagcttttggggaatttaatgtacagactgcaaaacactatggaaaccttggaagactttatcagtcaatgagaaaatttaaggaagctgaagaaatgcacatcaaagcaattcagattaaagaacaacttcttggtcaagaagattatgaagtagccctttcagtgggacatctggcttctttatataattatgacatgaatcagtatgaaaatgctgagaaactttatttgcgatctatagcaattgggaagaaactttttggtgagggctacagtggactagaatatgattatcgaggtctcattaaactttacaactccattggaaattacgagaaagtgtttgaatatcacaatgttctgtctaactggaaccggttgcgagatcggcaatattcagtgacagatgctcttgaagatgtcagcaccagcccccagtccactgaagaagtggtgcagtccttcctgatttctcagaatgtcgagggaccgagctgctgagggaggacctcagttaaccaattaccttttcccggattccagggaattcatactgtgaaatcaaaaccatgttgttttggggggctggaatttgcattgaaacactggtccagtccattgaagaccctattttgggtgatccctatcttgcagaatgtctgtaggaataagcatatattcagttatattcagcatgtaccgcatgtgtaagtagtctggcccacattttcaacctagtagaacaaacaacaggaaatcttttttttgttgtttttaaaaaattcattttgcagaaagcctgaaagaaaaaaaatacccctaaataaaactatttaagagtttaaaagagttgcattcttattatgtaaggatgattttaacaactttttaatatgtaattcttccatgtggaggtattcaatactgtagtgtaaagaaattttatgcggaaaatctttatatgcagtatagaaaagttaacacaagtactaataaaagagggacatcccgacttacgtttttctaccttgcccagataagtggatacaaccactctatattacaaggaaaggactgtcagattcatctgaactggaccagtgttgatctgtaatgtaatagaaaatctgatagaccagcacttctgacttttttttttttggtacaacaatgcaagatgctctgatagcatttgctaacaggaccaggaggatctaaaaaggaccagcctaatgtagaaggtggttacttggaccagaggctttagattattattttagatcctacatatacttttatcagtagaatgatttcatttagatgtataatgaaaaaggataatgcaaaaattatgtaatagataccaaattagggaagtttggcaatttcaatggcatatttttagtcaaggtacacagatggcagtgccataagcaagtctataaatatcggctgcagccatccccctcattttaaatgttgccctaataatcaatgcagttaacaagtatattggctgtgtgtcatgaaatagttcatgttcagatggaaatgttaggttactgtatggtttatggagattaatgaaaatgaatgcccaaaaataagtcttagaaaatcctccatttttatggtaaatagtaatacaactaggtcatttcatttgaaatctaggagtcaaatggaaagatcccctaataatacacctatttcactaacttgtctttctgtttattgggttttgatttgattttttgtaagccagtcaggttatttaatgatgaggtaataatcaaatttaagaatttgtgacatgtagcaattcaagaaacaaaaaggtattttgctgttacctcaattcttactgtagtagcccatctgatgcttctatagttaagaatctgggttccccccctattttcaggggttcatgacttggctgttaaagatgttgctcctagctaatgcttggagtagtctgtgggtgaatggatgtgtgttgaattttagttttcttttaacatgcatgttgggtgagaggggaaaaaaatctaagctgtctgccacattgagtacagaaaagttgtagatttcaaattttattaatattttaagcacttttttgaacttcccaaccttgtttgaagctgttatttgcagtcctattagttttgagccattgcatttaagttccctaggagggggttggttgggggatgtactgaaagagatgaagcaaacccacaccctaagatggtaactgtgtgatttagaaacctgagtttactcctcaaatcgaattattttctttttaaattttggaaagagtaaattgacgtacttgcagtttatgaagctgccccccacccctcagttaattgcagtctaatgtcaagaggcacttctttattaattaccaaatagtctttgtgaccaaggactaacatttttaagttactcagctctatcctcatgggcctatatatttaatacctccaaagatattttcaggataggctttgtatacttttattggttatttagaatccagtggtatgtttgtggtataggaatgtcatggtaaattgtttttcaataaatattttgaaacatgtttccatatgaagtttttttttcaatctgtattttttggttttgtgcacatacagcatttcctaggataaaaataaacaaatgacttacagcctcatcctccctaactccatttgaactcaacttagctcacactcagtgataaaacaacatggtatgtagaagcctaggatcacagggtgataatgtcaattggcagccagttgtgtttttttgaaacatcattattggcagtttctccttatcaccactgctttaatgtagtttttttgtaaatccatatactttaatgcatacactctagcttaagaaaacattgccattttggttagggatatgacttaatgtgctattatttctggttctaatgaagaataataccctatgactttaagtgtaagattcatcctttaagtagggatgtttaggataagttagatgtgtgccactatgatttattgggtttcttaaaaatcttgaagaaaataataaaatttatctcacaataagttaacttgcgcaaactttttacatatggtgaggtgcgtaaggaagccctggccaacttaaagatttttctggaggttcagcaaagttatgttaaattaggggcctttggtctcatccttctctgactcttctacccagtcttttcctaaagttcggtgctactccagttgggtgcatcagggagctccgtcagcactcgcatgtgtcgctcaggtggccactcatgcctgcattccatttaatagagtcaattggaatttttagagcataatctttatggatcctcaaagctgactttgccaaagggattgagacccttactaccatcaaatctctgtctctgcttggttaaaaattggctcactattgctttgtagtaacccctgcccaggtattttttcacttgtgaaaataatttgagaaagacctttgttcctagcctgttgggaaaagtttataattttatgaaaattaagtacagaggctgcgatcttagaaataatgaaggtgccatttggctgctccttaatagtgcagacagaaaactgcagtgaacacatgccaaaacatgattgaagcctttggctgaaactttatacatagaaataatgatttgctcataacaggtatcattaactgccactttttatgttttccctagaatttgtagccttgctgcttgcttttcttctgggtggcaaagttactactggaaaaacactataagtacaaagtttttggggttttatctttgctttagaagtggatgtgtacttcacctcttggctgtggaggaacttagttgccaggaaattttttttttttttttcagacggagtttcgctcttgttgcccaggctgggagggcaatggcaccgtcttggctcactgcaacctccgcctcccgggttccagcgattctcctgcctcagccttccgagtagctgggattacaggctcctgccaccacgcctggctaggaaattttttgttgttaatatgacatttggattaatctccagcttcaacagtacttcttttgtccataaatctcaggaatgttttaggcagaaaactggttttaccctgttgataatcagaaggagtgtgctttaggatttattgcataatactattctttaattgcaatcctaggtatctatagcatgagtggccttagtgagtttgttgaagtgcacatgtttttcaagagtaaaatttaagattaaaaatatatcctatatatagatatctagaaaacttggtttgtggtgcacagttaagtgttggatcactaaataaccattgcaggtaccgtttgtgtaacattactcatttctgtatattccttttatgggaagatattttgccatggtaactaaaacttttcagttctacttttatgatgtgaatgaatgctacgttttattaaatattaccaggtcagtactatttttatactttattaagcaacaggggattttagtttaataggctcaaaataaaaagttcttaatggaacagttaaaaacaaaacactaacaatctttacgtgaaaatccccactaatagtgccacaataatttctatagaaatatctaaggtcattaaatagatttttgaagacggttcttcattgtgtcaggatgacctttcatatcattctcaccaacttgtagtgcccaccgttatttgtaactattaaaccatactaagtatgtttgtaaccagcattgtgatatattctgtacttgtattgctaaaaatgaattattgacctaataaatatagtgttcctgcattcatagtg

SEQ ID NO: 107050 - DNA, 447 bp, Homo sapiens
  Payload ID: 1017
  Gene Symbol: APPBP2
  Gene Name: amyloid beta precursor protein (cytoplasmic tail) binding protein 2
  ENST ID: ENST00000585368
  CDS Start-End: 77-447
gggcctgcgtccgctgccgccgtccctcagtttgcccccggaggaggcggaggaggcggaggaggagggaaggaagatggcggccgtggaactagagtggatcccagagactctctataacaccgccatctccgctgtcgtggacaactacatccgctcccgccgagacatccgctccttgcccgagaacatccagtttgatgtttactacaagctttaccaacagggacgcttatgtcaactgggcagtgaattttgtgaattggaagtttttgctaaagtactgagagctttggataaaagacatttgcttcatcattgttttcaggctttgatggatcatggtgttaaagttgcttcagtcttggcctactcattcagtaggcggtgctcttatatagcagaatcagatgctgcagtaaaggaaaaagccattcaggttggctt

SEQ ID NO: 107051 - DNA, 525 bp, Homo sapiens
  Payload ID: 1017
  Gene Symbol: APPBP2
  Gene Name: amyloid beta precursor protein (cytoplasmic tail) binding protein 2
  ENST ID: ENST00000588668
  CDS Start-End: 8-295
aaggaagatggcggccgtggaactagagtggatcccagagactctctataacaccgccatctccgctgtcgtggacaactacatccgctcccgccgagacatccgctccttgcccgagaacatccagtttgatgtttactacaagctttaccaacagggacgcttatgtcaactgggcagtgaattttgtgaattggaagtttttgctaaagtactgagagctttggataaaaggttatctttcaccaagtccaaatcctttgacatttgcttcatcattgttttcaggctttgatggatcatggtgttaaagttgcttcagtcttggcctactcattcagtaggcggtgctcttatatagcagaatcagatgctgcagtaaaggaaaaagccattcaggttggctttgttttaggtggctttctttcagatgcaggctggtacagtgatgctgagaaagtttttctgtcctgccttcagttgtgtactctacacgatgagatgcttcattggtttcgtgcagta

SEQ ID NO: 107052 - DNA, 1705 bp, Homo sapiens
  Payload ID: 1017
  Gene Symbol: APPBP2
  Gene Name: amyloid beta precursor protein (cytoplasmic tail) binding protein 2
  ENST ID: ENST00000589341
  CDS Start-End: 202-387
tttttactcgggcctgcgtccgctgccgccgtccctcagtttgcccccggaggaggcagggcggccgtgccttctgccgtgcgcccgcgtggctgccaccgcccctccgaatcctccggggccgcagaggggttcgctacggagggaggtgggggccttcgggaggaggaggcggaggaggcggaggaggagggaaggaagatggcggccgtggaactagagtggatcccagagactctctataacaccgccatctccgctgtcgtggacaactacatccgctcccgccgagacatccgctccttgcccgagaacatccagtttgatgtttactacaagacatttgcttcatcattgttttcaggctttgatggatcatggtgttaaagttgcttcagtcttggcctactcattcagtaggcggtgctcttatatagcagaatcagatgctgcagtaaaggaaaaagccattcaggttggctttgttttaggtggctttctttcagatgcaggctggtacagtgatgctgagaaagtttttctgtcctgccttcagttgtgtactctacacgatgagatgcttcattggtttcgtgcagtagaatgttgtgtgaggttgcttcatgtgcgaaatggaaactgcaaatatcatttgggtgaagaaacatttaaattagctcagacatatatggataaactatcaaaacatggccagcaagcaaataaagctgcactctatggagaactgtgtgcactcctatttgcaaaaagtcactatgatgaggcatacaaatggtgcatcgaggcaatgaaagaaattacagcaggcttaccagtgaaagttgtggtggatgtcttaagacaagcttctaaggcttgtgtagtaaaacgtgaatttaagaaggcagaacagttaattaaacatgcagtgtatttggcacgggatcattttggatccaaacacccaaaatattctgatacactgctagattatgggttctacttactcaatgtagataatatctgtcagtctgttgcaatttatcaggcagcccttgacattagacagtcagtgtttggtggcaaaaatatccacgtagcaacagctcatgaagatttggcctactcttcttatgtccaccagtatagctctgggaaatttgacaatgcactatttcatgcagaaagagctattggtatcattacccacatcctacctgaagatcatcttcttttggcttcttcaaagagggtgaaagcacttattttagaggagattgcaattgattgtcataataaggaaactgaacagaggctgcttcaagaagctcatgatttgcacctgtcttcactccaactagctaaaaaagcttttggggaatttaatgtacagactgcaaaacactatggaaaccttggaagactttatcagtcaatgagaaaatttaaggaagctgaagaaatgcacatcaaagcaattcagattaaagaacaacttcttggtcaagaagattatgaagtagccctttcagtgggacatctggcttctttatataattatgacatgaatcagtatgaaaatgctgagaaactttatttgcgatctatagcaattgggaagaaactttttggtgagggctacagtggactagaatatgattatcgaggtctcattaaactttacaactccattggaaattacgag

SEQ ID NO: 107053 - DNA, 926 bp, Homo sapiens
  Payload ID: 1018
  Gene Symbol: APCS
  Gene Name: amyloid P component, serum
  Uniprot ID: P02743
  ENST ID: ENST00000255040
  CDS Start-End: 98-769
agggcatgaatatcagacgctagggggacagccactgtgttgtctgctaccctcatcctggtcactgcttctgctataacagccctaggccaggaatatgaacaagccgctgctttggatctctgtcctcaccagcctcctggaagcctttgctcacacagacctcagtgggaaggtgtttgtatttcctagagaatctgttactgatcatgtaaacttgatcacaccgctggagaagcctctacagaactttaccttgtgttttcgagcctatagtgatctctctcgtgcctacagcctcttctcctacaatacccaaggcagggataatgagctactagtttataaagaaagagttggagagtatagtctatacattggaagacacaaagttacatccaaagttatcgaaaagttcccggctccagtgcacatctgtgtgagctgggagtcctcatcaggtattgctgaattttggatcaatgggacacctttggtgaaaaagggtctgcgacagggttactttgtagaagctcagcccaagattgtcctggggcaggaacaggattcctatgggggcaagtttgataggagccagtcctttgtgggagagattggggatttgtacatgtgggactctgtgctgcccccagaaaatatcctgtctgcctatcagggtacccctctccctgccaatatcctggactggcaggctctgaactatgaaatcagaggatatgtcatcatcaaacccttggtgtgggtctgaggtcttgactcaacgagagcacttgaaaatgaaatgactgtctaagagatctggtcaaagcaactggatactagatcttacatctgcagctctttcttctttgaatttcctatctgtatgtctgcctaattaaaaaaatatatattgtattatgcta

SEQ ID NO: 107054 - DNA, 6644 bp, Homo sapiens
  Payload ID: 1019
  Gene Symbol: ALS2
  Gene Name: amyotrophic lateral sclerosis 2 (juvenile)
  Uniprot ID: Q96Q42
  ENST ID: ENST00000264276
  CDS Start-End: 374-5347
aagcgcatctcaggactgatagctccgccctaaactaagggagagactgtgctcccaagtacgtagcctgcagtgcctaacgcattctcagcaattttgacccccaacagacgccgtcgacagtctcccaagaacaattcccaggagctcggattccaagagccgcccgcgccctcgtttaccttcgctagtcgccctgcagccccgccctgtccggaggccccgccctccatgaatcagctgatcccgcggacccactgggttgccaagctcgcgccggatgcggagcgcggtgctgccggtggagcttcaggtcttgatagactttctgtaaagaaggaatgatttggtgatggagtgttcccactgaccgatggactcaaagaagagaagctcaacagaggcagaaggatccaaggaaagaggcctggtccatatctggcaggcaggatcctttcccataacaccagagagattgccaggctggggaggaaagactgttttgcaggcagccctcggagtgaaacatggagttcttctgactgaagatggtgaggtctacagctttgggactcttccctggagaagtggaccagtggagatttgtccaagtagccccattctagaaaatgccctggttgggcaatatgttattactgtggcaacaggaagcttccatagtggagcagtgacagacaatggtgtcgcgtacatgtggggagagaattctgctggccagtgtgcagtagccaaccagcagtatgtgccggaaccaaatcctgtcagcattgctgattctgaggccagccctttgttagcagtcaggattttacagttggcgtgtggcgaggagcacactctggcattgtcaataagcagagagatttgggcatggggtaccggttgtcagttgggtctcattaccactgccttcccagtgacaaagccgcaaaaggtagaacatcttgctgggcgagtggtgcttcaagttgcctgtggtgctttccacagcttagcccttgtacaatgcctcccttcccaggatctgaagccagtcccagaacgatgcaaccagtgcagccagctcttgattactatgactgacaaagaagaccatgtgattatatcagacagtcattgttgcccattaggtgtgacactgacagaatctcaggcagaaaaccatgccagcactgctctcagcccctccactgaaacccttgacaggcaggaagaagtatttgagaacactcttgtagcaaatgatcagtctgttgctactgaactgaatgcagtaagtgctcagatcacaagcagcgatgccatgtcctctcaacaaaatgtcatgggaacaactgaaatttcctctgccagaaacataccatcataccctgacacccaagcagtcaatgaatacctacggaaactgtcagatcattcagtaagagaggactcagagcatggtgaaaagccagtgccatctcagcctcttttagaagaagcaattcctaatctccacagcccgcctaccacaagcacctcagccctaaacagcctggtggtctcttgtgcatctgctgttggtgtgagagtggctgctacttatgaagctggtgccttgtcactgaagaaagttatgaacttttatagtacaaccccttgtgaaactggagctcaggcaggcagtagtgccattggccccgaaggtttgaaagatagcagggaagaacaggttaaacaggaatcaatgcaaggaaagaaaagttcaagtcttgtggatatcagagaagaagaaacagagggaggcagtcgaagactctccctccctggattgttgtcacaagtttcccccaggctcttaagaaaggctgcacgggtgaaaacgaggacagtggttctgacccccacatacagtggagaagcagatgcgctcctgccttctctgagaacagaagtgtggacctgggggaaagggaaggaagggcagctggggcacggcgatgttctgcctaggcttcaaccgttgtgtgtaaaatgtctggatggcaaagaagtaatccatctggaggcaggtggttaccattctcttgcacttactgcgaaatcccaggtttactcatggggtagcaatacctttggtcaacttgggcattccgattttccaacaacagttcctcgtcttgcaaagataagcagtgaaaatggagtctggagcatagctgcaggcagggattattccctgtttttagtggatacagaagacttccagcctgggttatattacagtggccgacaggaccctacagaaggtgacaaccttccagagaatcacagtggttctaagactccagtacttctctcctgtagtaagcttggatatataagcagagtgacagcaggaaaagatagctatttagccttggtggataaaaacattatggggtatattgccagtctccacgagttagctactacagaaagacgattctattcaaaactaagtgatatcaaatctcagattctcaggcctcttctcagtttagaaaatttgggcactacaactacagtccagctgttgcaggaggtggctagccgattcagcaagctgtgttacctcattggtcagcatggagcctcattgagcagcttccttcatggggtaaaggaagccaggagtttggtcatcctgaagcattcaagtctcttcttggatagttatacagagtattgcacatctattacaaatttcctggttatgggaggattccagcttcttgctaagcctgccattgatttcctaaataaaaaccaagagctgttgcaagatttgtcagaagtgaatgacgaaaacactcagttgatggaaatactgaatactttgtttttcttgccaatcagacgacttcataattacgcaaaagttttgctaaagcttgctacttgttttgaagtggcatctccagaatatcagaaactgcaggattccagttcttgttatgagtgtcttgctctccatctcggcaggaaaaggaaggaagcagaatacacactgggcttctggaagaccttccccggaaaaatgacggattccttgaggaagccagagcgtcgactgctgtgtgagagtagtaaccgagccctgtctctgcagcatgctgggaggttttccgtgaattggttcattctctttaatgatgccctggtccatgcccagttctccacgcaccatgttttccctctggccacgctgtgggcagagccactgtctgaagaagctggtggtgtgaatggcttaaagataactacacctgaggagcagttcactctcatttcatctacaccccaggaaaagacaaagtggctacgagctataagccaagccgtagatcaggctttgagagggatgtctgatctccccccttatggaagtggtagcagtgttcagagacaggaaccacccatttcacgcagtgccaaatatactttctacaaggatcctcgcctaaaggatgccacctatgatggacgctggctttcagggaagcctcatggcagaggggttttgaagtggcctgatggaaagatgtattctggcatgttcaggaatggcttggaagatgggtatggagaatacagaatcccaaacaaggcaatgaacaaagaagaccattatgtgggccattggaaagaaggaaaaatgtgcggtcaaggagtctacagctatgcttctggtgaagtatttgagggctgttttcaagataatatgcgtcatggtcatggtcttctacgaagtgggaaattgacgtcctcttctcctagtatgttcattggccagtgggtaatggataagaaagcaggatatggtgtctttgatgatatcactaggggggaaaagtatatgggaatgtggcaagatgatgtgtgtcaagggaatggtgtggtggttacccagtttggattatactacgagggcaactttcaccttaataaaatgatgggaaatggggttttgctttccgaagatgatactatctatgaaggagaattttcagatgactggactcttagtggaaagggaacactgactatgccaaatggagactacattgaaggttattttagtggagaatggggatctgggataaaaatcactggaacctacttcaaacctagtctatatgagagtgataaagacagacctaaagttttcaggaagctaggaaacctggcagtgccagctgatgagaagtggaaagcggtgtttgacgaatgttggcgccaactgggctgtgagggcccaggccaaggggaagtttggaaagcatgggacaatattgctgtggccttgaccaccagtcggcgccagcacagagacagtccagaaatactgagtcgttcacagactcagacactagagagtttggaattcattccacagcatgttggtgccttctctgtggagaaatatgatgacatcaggaaatatttaataaaggcctgtgacactcctctgcaccccctgggcaggcttgtggagacactggttgcagtgtatagaatgacatacgtgggcgtaggagccaaccgcaggttattgcaggaggctgtaaaggagattaagtcctatcttaagcgaattttccagctggtgaggttcttatttcctgagctgcctgaagaaggcagcacaattcctctctctgctcctctgccaaccgaaaggaagtctttttgcactgggaagtcagattcccgatctgaatcaccagagccaggttatgtagtaacgagttctggattattgcttcctgtgctgctacctcggctctacccaccgctgtttatgctttatgctttggataatgatcgcgaggaagacatttactgggaatgtgtccttcgactaaataagcagccagatattgctctcctgggctttcttggggtgcagaggaaattttggccagcaaccttgtcaatccttggagagagtaaaaaggttttgccaaccacgaaagatgcttgttttgcctcagcagtagaatgtctgcagcagatcagcacaacatttaccccatcagacaaacttaaggtcatccagcagacttttgaggagatctctcagagtgtcctggcgtcactccacgaagacttcttgtggtccatggatgacttgtttcctgttttcttatatgtggtgctacgggccaggattaggaatttaggctctgaggtacacctcattgaggatctaatggacccctatcttcagcatggggaacagggtataatgttcaccaccttgaaggcatgttactaccagattcagcgtgagaagcttaactaggctgcataacagcttgaaaactggattatctactacagagtgttataacaccatctggagtcttcctgtagtggcaaaaaagaacagtgttgaaattggaaaggactttgtgttatttaggttgttagaatgagccttaccaataataagagccctgagcccagaaaaaaggactgtatagtttaaagggaggattgaaagggaggtaaaaaatcagattagaccagttcttggcctatgataagttccaaaaataccatttatctactatttgaaaaaagaagaggatatcccttcctacagtaaagggtatgtcagctacatgaagttgtaagaaaagcttccagtagagcttcttatattaaagaagttgatggatatttttgaatttctggtttgcctgaatccacctgcagttaccccgatccgtttgcaagaaccagatcgtacttgaaactatagtggccacactctgccttcctgagtcccttccagtcatgtgtgcatcatgtctctttgccaagggaggggagaaaggaacttttaaactgcagttttaactttttctaagctgtttcttgatgggagaggttctgtgcaaaactaccacattctgtccccaaaatgtggaatgcatccaaataggagtcttctgcctcttaacttaaaagaacataggaattttgtttttggtttctttatcatgctacagagagtgaatacactggaattcagacaccgactctgagctgctaggaacctcatttgtccatgtgcaaacgctgtattccaaggcctgtgaatggcagcctgaggaagttttgcatgcaggctgtgttttcgagcaggactaacaactgggaaataagcaaaaaactgcatcgatccccagcctggtgttgttcttccctatacttcacactgaactcaggatgggaagaaaaaggaaacaagctttggctttttccatctcaaaagtattgtggcacctcaacatttcagtgttttgctttttaaaaaatgccctattgtaagttgttggtttatactgtataagtaacactagtagctgttttgaataacataggtgctcttcctcatctcatctcctacaccgtggtgagcatacagagtgtcctgatttgtgttaagtgactgagaagatgttaattacttttgaaaaaggatcatggtttttgctctactttataatcaagacaagtgtttattaaaatactgttttggaatgttggctgtaatgtaacagcaattttcataataaaaggcattcatcttt

SEQ ID NO: 107055 - DNA, 571 bp, Homo sapiens
  Payload ID: 1019
  Gene Symbol: ALS2
  Gene Name: amyotrophic lateral sclerosis 2 (juvenile)
  ENST ID: ENST00000409632
  CDS Start-End: 154-571
aagctcgcgccggatgcggagcgcggtgctgccggtggagcttcagcttatgtcttgatgtttgcctgcatgtagctgaactgattgatccaggtcttgatagactttctgtaaagaaggaatgatttggtgatggagtgttcccactgaccgatggactcaaagaagagaagctcaacagaggcagaaggatccaaggaaagaggcctggtccatatctggcaggcaggatcctttcccataacaccagagagattgccaggctggggaggaaagactgttttgcaggcagccctcggagtgaaacatggagttcttctgactgaagatggtgaggtctacagctttgggactcttccctggagaagtggaccagtggagatttgtccaagtagccccattctagaaaatgccctggttgggcaatatgttattactgtggcaacaggaagcttccatagtggagcagtgacagacaatggtgtcgcgtacatgtggggagagaattctgctggccagtgtgcagtagccaaccagcagtatgtgccggaaccaaatcctgtcagcattg

SEQ ID NO: 107056 - DNA, 559 bp, Homo sapiens
  Payload ID: 1019
  Gene Symbol: ALS2
  Gene Name: amyotrophic lateral sclerosis 2 (juvenile)
  ENST ID: ENST00000410052
  CDS Start-End: 241-559
agctgatcccgcggacccactgggttgccaagctcgcgccggatgcggagcgcggtgctgccggtggagcttcaggatggagaaggaactgactgctgtacccaagtgaagatctttactcagttacccttatatttggctatatggaataaaattgtgtgatatgtttattctgagcaggtcttgatagactttctgtaaagaaggaatgatttggtgatggagtgttcccactgaccgatggactcaaagaagagaagctcaacagaggcagaaggatccaaggaaagaggcctggtccatatctggcaggcaggatcctttcccataacaccagagagattgccaggctggggaggaaagactgttttgcaggcagccctcggagtgaaacatggagttcttctgactgaagatggtgaggtctacagctttgggactcttccctggagaagtggaccagtggagatttgtccaagtagccccattctagaaaatgccctggttgggcaatatgttattactgtggcaacaggaagcttccatagtggagcagtga

SEQ ID NO: 107057 - DNA, 3242 bp, Homo sapiens
  Payload ID: 1019
  Gene Symbol: ALS2
  Gene Name: amyotrophic lateral sclerosis 2 (juvenile)
  ENST ID: ENST00000439495
  CDS Start-End: 1-1756
tttagccttggtggataaaaacattatggggtatattgccagtctccacgagttagctactacagaaagacgattctattcaaaactaagtgatatcaaatctcagattctcaggcctcttctcagtttagaaaatttgggcactacaactacagtccagctgttgcaggaggtggctagccgattcagcaagctgtgttacctcattggtcagcatggagcctcattgagcagcttccttcatggggtaaaggaagccaggagtttggtcatcctgaagcattcaagtctcttcttggatagttatacagagtattgcacatctattacaaatttcctggttatgggaggattccagcttcttgctaagcctgccattgatttcctaaataaaaaccaagagctgttgcaagatttgtcagaagtgaatgacgaaaacactcagttgatggaaatactgaatactttgtttttcttgccaatcagacgacttcataattacgcaaaagttttgctaaagcttgctacttgttttgaagtggcatctccagaatatcagaaactgcaggattccagttcttgttatgagtgtcttgctctccatctcggcaggaaaaggaaggaagcagaatacacactgggcttctggaagaccttccccggaaaaatgacggattccttgaggaagccagagcgtcgactgctgtgtgagagtagtaaccgagccctgtctctgcagcatgctgggaggttttccgtgaattggttcattctctttaatgatgccctggtccatgcccagttctccacgcaccatgttttccctctggccacgctgtgggcagagccactgtctgaagaagctggtggtgtgaatggcttaaagataactacacctgaggagcagttcactctcatttcatctacaccccaggaaaagacaaagtggctacgagctataagccaagccgtagatcaggctttgagagggatgtctgatctccccccttatggaagtggtagcagtgttcagagacaggaaccacccatttcacgcagtgccaaatatactttctacaaggatcctcgcctaaaggatgccacctatgatggacgctggctttcagggaagcctcatggcagaggggttttgaagtggcctgatggaaagatgtattctggcatgttcaggaatggcttggaagatgggtatggagaatacagaatcccaaacaaggcaatgaacaaagaagaccattatgtgggccattggaaagaaggaaaaatgtgcggtcaaggagtctacagctatgcttctggtgaagtatttgagggctgttttcaagataatatgcgtcatggtcatggtcttctacgaagtgggaaattgacgtcctcttctcctagtatgttcattggccagtgggtaatggataagaaagcaggatatggtgtctttgatgatatcactaggggggaaaagtatatgggaatgtggcaagatgatgtgtgtcaagggaatggtgtggtggttacccagtttggattatactacgagggcaactttcaccttaataaaatgatgggaaatggggttttgctttccgaagatgatactatctatgaaggagaattttcagatgactggactcttagtggaaaggataattctggcctcatagaacaagttgggaagtgttccctcctcccctattttctgaaagtttgcgaagctttggtattatttcttctttgaatgtttgggagaattcaccaatgaagtcttctgggcctaagcattactttggaacactgactatgccaaatggagactacattgaaggttattttagtggagaatggggatctgggataaaaatcactggaacctacttcaaacctagtctatatgagagtgataaagacagacctaaagttttcaggaagctaggaaacctggcagtgccagctgatgagaagtggaaagcggtgtttgacgaatgttggcgccaactgggctgtgagggcccaggccaaggggaagtttggaaagcatgggacaatattgctgtggccttgaccaccagtcggcgccagcacagagacagtccagaaatactgagtcgttcacagactcagacactagagagtttggaattcattccacagcatgttggtgccttctctgtggagaaatatgatgacatcaggaaatatttaataaaggcctgtgacactcctctgcaccccctgggcaggcttgtggagacactggttgcagtgtatagaatgacatacgtgggcgtaggagccaaccgcaggttattgcaggaggctgtaaaggagattaagtcctatcttaagcgaattttccagctggtgaggttcttatttcctgagctgcctgaagaaggcagcacaattcctctctctgctcctctgccaaccgaaaggaagtctttttgcactgggaagtcagattcccgatctgaatcaccagagccaggttatgtagtaacgagttctggattattgcttcctgtgctgctacctcggctctacccaccgctgtttatgctttatgctttggataatgatcgcgaggaagacatttactgggaatgtgtccttcgactaaataagcagccagatattgctctcctgggctttcttggggtgcagaggaaattttggccagcaaccttgtcaatccttggagagagtaaaaaggttttgccaaccacgaaagatgcttgttttgcctcagcagtagaatgtctgcagcagatcagcacaacatttaccccatcagacaaacttaaggtcatccagcagacttttgaggagatctctcagagtgtcctggcgtcactccacgaagacttcttgtggtccatggatgacttgtttcctgttttcttatatgtggtgctacgggccaggattaggaatttaggctctgaggtacacctcattgaggatctaatggacccctatcttcagcatggggaacagggtataatgttcaccaccttgaaggcatgttactaccagattcagcgtgagaagcttaactaggctgcataacagcttgaaaactggattatctactacagagtgttataacaccatctggagtcttcctgtagtggcaaaaaagaacagtgttgaaattggaaaggactttgtgttatttaggttgttagaatgagccttaccaataataagagccctgagcccag

SEQ ID NO: 107058 - DNA, 2677 bp, Homo sapiens
  Payload ID: 1019
  Gene Symbol: ALS2
  Gene Name: amyotrophic lateral sclerosis 2 (juvenile)
  Uniprot ID: Q96Q42
  ENST ID: ENST00000467448
  CDS Start-End: 141-1331
gaatcagctgatcccgcggacccactgggttgccaagctcgcgccggatgcggagcgcggtgctgccggtggagcttcaggtcttgatagactttctgtaaagaaggaatgatttggtgatggagtgttcccactgaccgatggactcaaagaagagaagctcaacagaggcagaaggatccaaggaaagaggcctggtccatatctggcaggcaggatcctttcccataacaccagagagattgccaggctggggaggaaagactgttttgcaggcagccctcggagtgaaacatggagttcttctgactgaagatggtgaggtctacagctttgggactcttccctggagaagtggaccagtggagatttgtccaagtagccccattctagaaaatgccctggttgggcaatatgttattactgtggcaacaggaagcttccatagtggagcagtgacagacaatggtgtcgcgtacatgtggggagagaattctgctggccagtgtgcagtagccaaccagcagtatgtgccggaaccaaatcctgtcagcattgctgattctgaggccagccctttgttagcagtcaggattttacagttggcgtgtggcgaggagcacactctggcattgtcaataagcagagagatttgggcatggggtaccggttgtcagttgggtctcattaccactgccttcccagtgacaaagccgcaaaaggtagaacatcttgctgggcgagtggtgcttcaagttgcctgtggtgctttccacagcttagcccttgtacaatgcctcccttcccaggatctgaagccagtcccagaacgatgcaaccagtgcagccagctcttgattactatgactgacaaagaagaccatgtgattatatcagacagtcattgttgcccattaggtgtgacactgacagaatctcaggcagaaaaccatgccagcactgctctcagcccctccactgaaacccttgacaggcaggaagaagtatttgagaacactcttgtagcaaatgatcagtctgttgctactgaactgaatgcagtaagtgctcagatcacaagcagcgatgccatgtcctctcaacaaaatgtcatgggaacaactgaaatttcctctgccagaaacataccatcataccctgacacccaagcagtcaatgaatacctacggaaactgtcagatcattcagtaagagaggactcagagcatggtgaaaagccagtgccatctcaggtacctgctcaattttataaaataaaagtgtgtctagagttgaactgtatgggcttttctttagaaactttaaaatgagtaaggcttggtagcattttttattttttgagtttgattataattttgttttatcaggcaagcctagataaaggaaagaacctggattaattcaaaatcactctttatgtttgttctggccctttatgatattgaaaggtgtcatgttgggcttgttttataagtaggagcatttcatttttttttcttgctagtactttttttctatggctaaagtactgaattttggtgggccctgaatagtttaatataactagagattcacaaagattcttcttacttgtgtttgtaacactcttcagaattctgtagagaaaagtcttttccttctttaacagggaagattgttttgtggcagatccttcaattgtaggcagatttaaaacttacaggcaattacatgtttcagtttttttcaattatagctgtggtccttactgggcttaatttgaagaggtggctaatattttatctttttgtttgtttgtttttgagatggggtcttgctctgtcacccaggctggagtgcagtaatgcgattgtggctcactgcagcctcgatctcccaggttcaagcgatcctcccatttcagccttccaagtagctgggactatacacatgccaccacacctgctgattttatttttaagtagagtagagcctgttgcccaggctcatctcaaactcctgagctcaagcaatcctcccacctcagcctcccaaagtgttgagattacaggcatgagccatcatgcccagcctattttatatatcttattaaaactattttcattttgaagatttgtggtagaatgaacaaaagttgtttatcagtagcacatggtaaagtttgagttcccgcttaaactaaattgttttaaaaggattatttctgtgttttactcttagtgtggccttttgattttgctttaccaaaactgtaagaaaacaaaacaaaagatcatactcataaaagatctgtcctgcagtgtttctttttaggtttttgaaaccacatagcctcttgattctcaattcttattgtttactctgtcagaatgtgaacatgaaggtatttttagaaatagtctttatttcacaatctattcactgaaacttgtgggtatttgaatttttaaaaaaatcaaggataagctgtttggagaaaggtattataaagtctgaacaaagcaaaagtagtagtttaacaagaatgcatgtagaaaattcttagactgtacatgcttatcacattttacttactttgttaaacattggaagtttttgttacttatgctagtaacaatgtgtgtgtttctattgaattaaatttaatttatttaaa

SEQ ID NO: 107059 - DNA, 2104 bp, Homo sapiens
  Payload ID: 1020
  Gene Symbol: ALS2CR11
  Gene Name: amyotrophic lateral sclerosis 2 (juvenile) chromosome region, candidate 11
  Uniprot ID: Q53TS8
  ENST ID: ENST00000286195
  CDS Start-End: 46-1917
agcgggccgtcggttgggcgcagacaggccgcagaagatggagagatggagccaccccaagagacaaataggcctttcagcacacttgataaccgcagcgggcaggtccaagtcctgtccgccaccccgctattgcagaggaatccctacagcagcccggatatcatgcacattaaagggtcggaggcttcttcggtcccttacgccctgaaccagggcacgacggccctgcctaagaacaagaaccaggagggcaccgggcaccggctgctgaacatgctgagaaaaactcttaaagagtctgatagtgaagaactggaaataacacaggagacgccaaatttggtgccatttggggatgtggttggctgcctgggcattcatataaagaactgcagacattttatgcctaagatcagtttacaacattatgctaatttattcattcgcatctctataaacaaagctgtgaaatgtacaaaaatgtgtagcttgctatccaaaaacgatgagaagaacactgtaattaagttcgatgaagtgaagtatttttctgtacaggttcccagacgttatgatgataagcggaataatattttattggaactcatacaatatgacaatagagaaaaacgtgctttcttgttagggagtgttcagatacatctttatgaggtaattcagaaagggtgcttcattgaagaggtccaagtgttgcatggaaacatatttgtctgcaggctggaggtggaatttatgttctcctatggaaactttggttatggattttcacatcagttaaaacctcttcagaaaattactgagccatccatgtttatgaatcttgcaccacctccagaaagaacagatcccgtgacaaaagttattacaccacagacagtagaatatccagcattcttatccccagacctgaatgttactgttgggactccagctgtgcaatcctccaaccagccatctgtagtgcgacttgaaaaacttcagcaacaaccccgggaaaggctggaaaagatgaaaaaagaatatagaaatctgaatacatggatagataaagctaactatttagaaagcattctaatgccaaaattggaacataaggattctgaggaaactaatatagatgaggcatctgaaaacacgaaaagtaatcatcctgaagaggagcttgaaaatattgtaggagtagatatccctcttgtaaatgaggaagctgaaactactgcaaatgagttactggataatgattctgagaaaggcctgactataccaactttgaaccaatcggaccaagataattcaactgctgatgcttctaaaaatgatgaatcaacaccttcacccacagaagtgcactcattgtgcactatttctaaccaggaaacaataaaagcaggcagaataccacctttaggtgaacgtcaatcagaaagcatgccagacagaaaaatgaaaaatgtattttttccattagaagtaaaattaaaagataactatccaagcattttaaaagcagactcatctctatcagaggtggctttttcaccaaaagaatataattcaccatctttcagaccagaatatatagaattcaaaccaaaatttcaggattgttcagataaatttgaggatttacatgacatgacctcatttacacaccttaaaaaagtaaaatcaagatcaaggcttttaggaaaaagctcagatgatatccataaccatgccagacactctgcaagaccatatactgctccggaggttaacaagcaacgagaaagctacagtggaaagtttacaagtcgtcgaatggtttcatcaggcttagttcatataaatgataaaacatcagattatgaaatgcataaaatgcggccaaaaaaaattaaaagaggatattgaaaaatgttcgctcatttgtgatattataaaacatgtttaactcagaatgatatgtgaggccagcagtcagaatatcacttctccattaacaaaatggtttggagatctcttcttttgtgtgacagaagtcagcaaccaaatttcatcttgttagaaccattttgttttgattaaaatgaaaaacaaa

SEQ ID NO: 107060 - DNA, 2571 bp, Homo sapiens
  Payload ID: 1020
  Gene Symbol: ALS2CR11
  Gene Name: amyotrophic lateral sclerosis 2 (juvenile) chromosome region, candidate 11
  Uniprot ID: Q53TS8
  ENST ID: ENST00000450242
  CDS Start-End: 49-1701
agtagcgggccgtcggttgggcgcagacaggccgcagaagatggagagatggagccaccccaagagacaaataggcctttcagcacacttgataaccgcagcgggcaggtccaagtcctgtccgccaccccgctattgcagaggaatccctacagcagcccggatatcatgcacattaaagggtcggaggcttcttcggtcccttacgccctgaaccagggcacgacggccctgcctaagaacaagaaccaggagggcaccgggcaccggctgctgaacatgctgagaaaaactcttaaagagtctgatagtgaagaactggaaataacacaggagacgccaaatttggtgccatttggggatgtggttggctgcctgggcattcatataaagaactgcagacattttatgcctaagatcagtttacaacattatgctaatttattcattcgcatctctataaacaaagctgtgaaatgtacaaaaatgtgtagcttgctatccaaaaacgatgagaagaacactgtaattaagttcgatgaagtgaagtatttttctgtacaggttcccagacgttatgatgataagcggaataatattttattggaactcatacaatatgacaatagagaaaaacgtgctttcttgttagggagtgttcagatacatctttatgaggtaattcagaaagggtgcttcattgaagaggtccaagtgttgcatggaaacatatttgtctgcaggctggaggtggaatttatgttctcctatggaaactttggttatggattttcacatcagttaaaacctcttcagaaaattactgagccatccatgtttatgaatcttgcaccacctccagaaagaacagatcccgtgacaaaagttattacaccacagacagtagaatatccagcattcttatccccagacctgaatgttactgttgggactccagctgtgcaatcctccaaccagccatctgtagtgcgacttgaaaaacttcagcaacaaccccgggaaaggctggaaaagatgaaaaaagaatatagaaatctgaatacatggatagataaagctaactatttagaaagcattctaatgccaaaattggaacataaggattctgaggaaactaatatagatgaggcatctgaaaacacgaaaagtaatcatcctgaagaggagcttgaaaatattgtaggagtagatatccctcttgtaaatgaggaagctgaaactactgcaaatgagttactggataatgattctgagaaaggcctgactataccaactttgaaccaatcggaccaagataattcaactgctgatgcttctaaaaatgatgaatcaacaccttcacccacagaagtgcactcattgtgcactatttctaaccaggaaacaataaaagcaggcagaataccacctttaggtgaacgtcaatcagaaagcatgccagacagaaaaatgaaaaatgtattttttccattagaagtaaaattaaaagataactatccaagcattttaaaagcagactcatctctatcagaggtaaatttgaggagtatctgtataaatccaaagagcaggaacttagattcatctccaacagaaattagctggcaaaacaacaatctaaacttagctgaaagggagaacacaggcttagtttccaccagattaaaaattaaaaggtagctttcaaagccaagacccaaaagaaggccttgagctcaaggtgtctgcccttatattagaagtataagactagggagacaaaataatctattttaaaaaattaaatacaaataaatcgaaaatgcattcaaatgtctccaagtggaaatgtgtctaagtatattaaatattcctgctttacttatatcaatcaagaaatgaggataaaaaactttcaagaaaagcaaagtgatttgagatgccagtaatacaaattaatctcttgggttagtaattcagctgaaagtgtaacgacaataacaaaatgtaaattcaaaggaaatttaaaagcctgaggagttatttcagtggaaattcttaataaaactattatattataggaaataacatgttctccttattacaaataattttatagtttaaaatgagaataagagtgtgaatttaaaggtacaccaaataatagactttctcaaaatgacagccattctacttatatctttatatcttattggaataactattacaggtagttcatcaaatggtataaaaagatatataggtcagaagataaagaatttgagttctaagtgagattctgcttctaaatactagcttgggcatctaagtctctagacctatttttctcattatttgaatggtagatcagactaggtcatttctaaattctctcccaaatttcaaaagacataattttaactgggaattactctcagttacctatgtcaaataacattcttgttttttctgaatgtgaaagtaatgcacagtcacagaaaatttagaaaatggagagaaatgtaaaagaaaaaataaaagcagttataattctactgctagatttaacaa

SEQ ID NO: 107061 - DNA, 1639 bp, Homo sapiens
  Payload ID: 1020
  Gene Symbol: ALS2CR11
  Gene Name: amyotrophic lateral sclerosis 2 (juvenile) chromosome region, candidate 11
  Uniprot ID: Q53TS8
  ENST ID: ENST00000439802
  CDS Start-End: 25-1212
agacaggccgcagaagatggagagatggagccaccccaagagacaaataggcctttcagcacacttgataaccgcagcgggcaggtccaagtcctgtccgccaccccgctattgcagaggaatccctacagcagcccggatatcatgcacattaaagggtcggaggcttcttcggtcccttacgccctgaaccagggcacgacggccctgcctaagaacaagaaccaggagggcaccgggcaccggctgctgaacatgctgagaaaaactcttaaagagtctgatagtgaagaactggaaataacacaggagacgccaaatttggtgccatttggggatgtggttggctgcctgggcattcatataaagaactgcagacattttatgcctaagatcagtttacaacattatgctaatttattcattcgcatctctataaacaaagctgtgaaatgtacaaaaatgtgtagcttgctatccaaaaacgatgagaagaacactgtaattaagttcgatgaagtgaagtatttttctgtacaggttcccagacgttatgatgataagcggaataatattttattggaactcatacaatatgacaatagagaaaaacgtgctttcttgttagggagtgttcagatacatctttatgaggtaattcagaaagggtgcttcattgaagaggtccaagtgttgcatggaaacatatttgtctgcaggctggaggtggaatttatgttctcctatggaaactttggttatggattttcacatcagttaaaacctcttcagaaaattactgagccatccatgtttatgaatcttgcaccacctccagaaagaacagatcccgtgacaaaagttattacaccacagacagtagaatatccagcattcttatccccagacctgaatgttactgttgggactccagctgtgcaatcctccaaccagccatctgtagtgcgacttgaaaaacttcagcaacaaccccgggaaaggctggaaaagatgaaaaaagaatatagaaatctgaatacatggatagataaagctaactatttagaaagcattctaatgccaaaattggaacataaggattctgaggaaactaatatagatgaggcatctgaaaacacgaaaagtaatcatcctgaagaggagcttgaaaatattgtaggagtaggtggctttttcaccaaaagaatataattcaccatctttcagaccagaatatatagaattcaaaccaaaatttcaggattgttcagataaatttgaggatttacatgacatgacctcatttacacaccttaaaaaagtaaaatcaagatcaaggcttttaggaaaaagctcagatgatatccataaccatgccagacactctgcaagaccatatactgctccggaggttaacaagcaacgagaaagctacagtggaaagtttacaagtcgtcgaatggtttcatcaggcttagttcatataaatgataaaacatcagattatgaaatgcataaaatgcggccaaaaaaaattaaaagaggatattgaaaaatgttcgctcatttgtgatattataaaacatgtttaactcagaatgatatgtgaggccagcagtcagaatatcacttctccatt

SEQ ID NO: 107062 - DNA, 5512 bp, Homo sapiens
  Payload ID: 1020
  Gene Symbol: ALS2CR11
  Gene Name: amyotrophic lateral sclerosis 2 (juvenile) chromosome region, candidate 11
  Uniprot ID: Q53TS8
  ENST ID: ENST00000439140
  CDS Start-End: 46-5508
agcgggccgtcggttgggcgcagacaggccgcagaagatggagagatggagccaccccaagagacaaataggcctttcagcacacttgataaccgcagcgggcaggtccaagtcctgtccgccaccccgctattgcagaggaatccctacagcagcccggatatcatgcacattaaagggtcggaggcttcttcggtcccttacgccctgaaccagggcacgacggccctgcctaagaacaagaaccaggagggcaccgggcaccggctgctgaacatgctgagaaaaactcttaaagagtctgatagtgaagaactggaaataacacaggagacgccaaatttggtgccatttggggatgtggttggctgcctgggcattcatataaagaactgcagacattttatgcctaagatcagtttacaacattatgctaatttattcattcgcatctctataaacaaagctgtgaaatgtacaaaaatgtgtagcttgctatccaaaaacgatgagaagaacactgtaattaagttcgatgaagtgaagtatttttctgtacaggttcccagacgttatgatgataagcggaataatattttattggaactcatacaatatgacaatagagaaaaacgtgctttcttgttagggagtgttcagatacatctttatgaggtaattcagaaagggtgcttcattgaagaggtccaagtgttgcatggaaacatatttgtctgcaggctggaggtggaatttatgttctcctatggaaactttggttatggattttcacatcagttaaaacctcttcagaaaattactgagccatccatgtttatgaatcttgcaccacctccagaaagaacagatcccgtgacaaaagttattacaccacagacagtagaatatccagcattcttatccccagacctgaatgttactgttgggactccagctgtgcaatcctccaaccagccatctgtagtgcgacttgaaaaacttcagcaacaaccccgggaaaggctggaaaagatgaaaaaagaatatagaaatctgaatacatggatagataaagctaactatttagaaagcattctaatgccaaaattggaacataaggattctgaggaaactaatatagatgaggcatctgaaaacacgaaaagtaatcatcctgaagaggagcttgaaaatattgtaggagtagatatccctcttgtaaatgaggaagctgaaactactgcaaatgagttactggataatgattctgagaaaggcctgactataccaactttgaaccaatcggaccaagataattcaactgctgatgcttctaaaaatgatgaatcaacaccttcacccacagaagtgcactcattgtgcactatttctaaccaggaaacaataaaagcaggcagaataccacctttaggtgaacgtcaatcagaaagcatgccagacagaaaaatgaaaaatgtattttttccattagaagtaaaattaaaagataactatccaagcattttaaaagcagactcatctctatcagaggtggctttttcaccaaaagaatataattcaccatctttcagaccagaatatatagaattcaaaccaaaatttcagtttcagaaattcaacaagaacggttttgatccttttctaaggaatataaacaaaatgtcagtcagaaaaagaaaagatcaagatatatacaaatatagaaatatcttaggtgcagaggtcatagagcatgaagaccaggatcctccttatccagcacaatcaaaaactgcaggacctgctaatacaacctgggcccatgaccctaatatcttcacaacaaagatgttagaaactgagaataagttagcccctgatcctactatcaatacaataaagggtttagatacaaagaatagtttaaaagaaaatctaccaaatgtatctttaccaagcatcaaaggagaatcatcaagggctggaaatgtacaggcaaacacatgtcacctctcgaagtctttaaattttaccccccatatagaatatttaaaacaatcaatgatactcaagtcaattttaagtgaaaatctgcaagacctttcagacaaattattttctaaaccagaagttagtatgaacagtgaagcaagagagaaaagtagttctccacttctaagcattcatgataaatcatcaagtagtatggaagacaacgtattggaaaaaaaacaagatttaaacaactggctttcagaaaaagacattttaaattcaaagactactttaagtcaaataattaaaaatattcctgcagattcattttcagaaggtagtcaaataattgaaaatattcctgcagattcacttttagaaggtggtcaagtaattaaaaatattcctgaatattcactttcagaagggggtcagataattaaaaatattcctgcagattcatttttagaaagtggaccaggacaatctccagaggtagaagaacatgtctctaaaaaacacttcgaagctgatgagagagattttccaattaaaaaaaatagtagtaccaaaaagaaacatttaataagcgaagtacctaactccaaatcaggttcaagtggcactgtacatgactacattatgaggcaaatattcactgcaccaatattctcagaattggagatagaagtgaaagagccaagtgaaacaccaatgaacttggaaaatcaattacctacaccttggaagagaagtttgtcatcacatattctatttcatgaagaaaatgctgatgaaatagaattgccacagcccagatctgctacaagccagataatacaagcatttcctatagatacacttttagaatctgggataatcaaagtgatagaattagataaagaacaccataagagttctttgctgggtacggggatcacttctcctaaaggaaacctaaaggattcccaagagtattattcagaaatcagaagcgagacagaacctctttctgagcagagtatacccatcattcccaaagacactacttctgttagtagagctgaatttatacaggaagaccaaaatatgttcccacaagattcaagttattattcaatagcaaataaagaactgtatttgccaagaaatggtcagaggctttgtaaagacaaaaatgatctcagttctactttagaaagtttaactaactcattaatggataaacttagtgaatcagatgaaataatgttaaaatcctttttaaaaaacatcttcaatgtttttttcaaatataatcattctgaaagaagaggacaaccagaaaaagaattagaaagactaattcaaccttcttttacaagtgacacagaacaccttgaagaactccaagaggattttgataaagcagacaaattagacagaaaacctattttgagtccaaagttgcgtgtgtttctagaagaactctcagagtcagaagtaaaacatttaaaatctgaattaagtaaacaaatccagcattaccttgtagaaagactttcagaatcaggacatatcaccaaggaggacttaccaaaaatctatcaaaatctgtatctgatgaatgagaaagcagagcagaaagggccaaacagttttcaggggaaatattctgaaactgtgaaagaaatcatgtcttttgtcaacaatttcaatcatcatttcatagataaacatttggaaataaagctgagatcttttttaaaagagattctccaaaactatttcctaaaaaacatttcagaaagcagtttatttaatgagacagcatctgagactatatacccaaacatatcttctctaaggactaaaagtgtctcaatatcttttcatgaactagaacaagatatttcaaaggggagttttggtagaaggtttgaaataaacatgaaatatcctttaagtaaatctctacaaaactatctgatagctttatcagaaaatgaattattacatctaaaagctgatttaagcaaacacctccagagtctttttatagaaaaactttcaaaatcaggactaatgacaaaaaagcaattagaagggatcaaccagcatataaatttgcttaattctagttctataccattaaaatatataaaaacacatttaccttttagagatgactgtcactttgtggagaagcattcagaaaagcaaaataaatattcaagaattgttcaacaaaccactttacaaacggtttctgaggataaacttagagaagcagaattgattcgagagaaagaaaagaaatattttcccttacagaatttaaagggaaattcatctttaattaaggaacagaaaagttattacactaaggaagaagctaaaacaccaagtttaatcaaagtacaaccttcttccaatgaaaatatccaggcaagtccattaagtaagtcatcagaaatacttacagatatactgcttaagaaactaaggaaagaacatgtattcacgcagcttcctcaagcagaaaattctgttcataaaacagagattcaagacccatatagttggggtggtaaatcaaaaataactcaatcaaaagcttggtgtgaaaagacactgaaaatgaagtcccttgatagaaaggagcatgtaaacatctataaatggactgttcaggaaaaacctgaagcagtattaacatcgtatccaagaattcctaatgccagaatgccaagggaagatgagtacttaaacagaatcactttcccttcctggcaaagtagcactttaactcatttcaatacagagactggggaaaaatcaaaattagaagaccagtattgtcagacattgaaaggaaataataacaataataaaaagcatttagtaacatttgcacaatacaaaaaagaaatacaaactctttatataaaaccagatgaaatttgcagtgaaaaatgtgccaagttccctgaaatacagtcattccaatataaggttgtagaagatgagaaaaacttgaaaccacacctcttcccagaattatttaagatagaagatctaaaacccaaggtccgaaaagaaagagaccgtgtcgcccaaccaaaaaagtcatttaacaagatagtcaggatactaccaaccacactgcccaccacaagaattcacctaaagaagtctgttccaaggacactgcttcactggactgcaagaagaactatacatgattgttcagataaatttgaggatttacatgacatgacctcatttacacaccttaaaaaagtaaaatcaagatcaaggcttttaggaaaaagctcagatgatatccataaccatgccagacactctgcaagaccatatactgctccggaggttaacaagcaacgagaaagctacagtggaaagtttacaagtcgtcgaatggtttcatcaggcttagttcatataaatgataaaacatcagattatgaaatgcataaaatgcggccaaaaaaaattaaaagaggatattgaaaaa

SEQ ID NO: 107063 - DNA, 1769 bp, Homo sapiens
  Payload ID: 1021
  Gene Symbol: ALS2CR12
  Gene Name: amyotrophic lateral sclerosis 2 (juvenile) chromosome region, candidate 12
  Uniprot ID: Q96Q35
  ENST ID: ENST00000286190
  CDS Start-End: 48-1385
caagagcctcctgatctagcagccaagactccccctgacctttggccatgtaccccaaccctctcatctactgcacctgctgggacccctggaacttgggaccacggaagctaatcaagacccctcaactaccacgcaagaactccacagggagttccaagctaactcctcttgtaccagctccaaaaaatcacaattacctccaaccaacaaaacctgttgtttccccaaaaatgaaaatccattcagcaaggcaagaagagactaataaatcattttatgaagtgatcaacgtgtcacctggctatcaacttgttcggaatcgggaacagatttctgtcaccttaggggatgagatgtttgataggaaaaagcggtgggaatcggagatcccggacaaaggcagattttccaggaccaacatcatttctgacctagaagagcaaatctcagagctgacagcaataattgaacaaatgaacagagaccaccagtctgcccagaaattgctctccagtgaaatggatctccgctgtgctgagatgaaacagaactttgaaaacaagaacagggagctcaaagaggcccatgaagcagaactcagtgagttggagaacaactacaaagcagccttgaaggcagagaagttggctgcccaagagaagctagaggagatgggaaaagaatacaagtatttgaagaatatgtttcgtacgtatcaggacagtatttatgatgaaatggaagagaagtggtcaaaacagaaggcgaaatggaagaaggatgagaagttcgagcgagaaaatatcctgctacagcaaaaaaaaaagatgaccaaaaaattcgaaatggagtcaggagaagaagataagaaaataaatgaatcctgcagtgctgtctttgagaacttcattcaagagaaggaggagctcttgaaacaacatcaaagtgacaccttgcaattagaagagctgagaaaaaccaaagaggtgccctggagaagagaccaaataaatagacattggcatgatgtcctgcaacagcttcttcttatgcaggtcatgcaggaagaattgcatgcacaagcccttatcctagagtcactgaacacaaacctctactatacccagttggaactccagaaagagaaagctatagtgggaaatctggagaaaatgcttcaaaccaagtttgctgaaactgaagaaaagtataagcacaccatacagatcctgacggaagagaacattcatctgaagcaaaagataatttctaagaatgaagaaatttgtgaaggatgttctgggagattggcctctattactgtttctaaggatgattctgacactgtgcaagatggtagcaagaaaggacaagaatcataaacaaaaagttgctctgcattgttgaagatggttggcacaccatttctgtaggcccaggaaactcctgggagggttttcttgagaaaatgcatataatgagtttagttcttgggttgctctgactctctgaatgtctgaaaatgtttgaattcgcatctgaatttcacagcttatcacggactcttcactgaaaaatgatgctctccatactgggagctgagctttctctgagttttgtactatttttcttctaccttgacgtatttcgttagaaagaaactgatttgaaggccttcttcatattgaacttttactatatttgggaggtgtacctttgtcccctggggcatttaggtagcaaaaaaagatgatgtgttgatttta

SEQ ID NO: 107064 - DNA, 1943 bp, Homo sapiens
  Payload ID: 1021
  Gene Symbol: ALS2CR12
  Gene Name: amyotrophic lateral sclerosis 2 (juvenile) chromosome region, candidate 12
  Uniprot ID: Q96Q35
  ENST ID: ENST00000392257
  CDS Start-End: 445-1713
ctttggcctgccatctcccaagggcaaacctcacaactcaggcccaagtcacaggaatctgaatggtggggtgaccttctcctctagtttaatttcattgcaatactgagaaacttcaactgttttgtctttagaagggaaattcatgtttgtgccaggccagcctttgtaaaagcctttgattggattcactagaagtctgtcttcccgcagtacatatactgtgaattttctccttcggcatttcaaccacttggaatggccactaaagtggcttttgatctaaagtaaactctgattctgtgttgatggggaaccatttctctctaacatggtggtttctttaagatgtttgacttgggccacatgagaataacagatctttgggcagtccaagcaagagcctcctgatctagcagccaagactccccctgacctttggccatgtaccccaaccctctcatctactgcacctgctgggacccctggaacttgggaccacggaagctaatcaagacccctcaactaccacgcaagaactccacagggagttccaagctaactcctcttgtaccagctccaaaaaatcacaattacctccaaccaacaaaacctgttgtttccccaaaaatgaaaatccattcagcaaggcaagaagagactaataaatcattttatgaagtgatcaacgtgtcacctggctatcaacttgttcggaatcgggaacagatttctgtcaccttaggggatgagatgtttgataggaaaaagcggtgggaatcggagatcccggacaaaggcagattttccaggaccaacatcatttctgacctagaagagcaaatctcagagctgacagcaataattgaacaaatgaacagagaccaccagtctgcccagaaattgctctccagtgaaatggatctccgctgtgctgagatgaaacagaactttgaaaacaagaacagggagctcaaagaggcccatgaagcagaactcagtgagttggagaacaactacaaagcagccttgaaggcagagaagttggctgcccaagagaagctagaggagatgggaaaagaatacaagtatttgaagaatatgtttcgtacgtatcaggacagtatttatgatgaaatggaagagaagtggtcaaaacagaaggcgaaatggaagaaggatgagaagttcgagcgagaaaatatcctgctacagcaaaaaaaaaagatgaccaaaaaattcgaaatggagtcaggagaagaagataagaaaataaatgaatcctgcagtgctgtctttgagaacttcattcaagagaaggaggagctcttgaaacaacatcaaagtgacaccttgcaattagaagagctgagaaaaaccaaagaggtcatgcaggaagaattgcatgcacaagcccttatcctagagtcactgaacacaaacctctactatacccagttggaactccagaaagagaaagctatagtgggaaatctggagaaaatgcttcaaaccaagtttgctgaaactgaagaaaagtataagcacaccatacagatcctgacggaagagaacattcatctgaagcaaaagataatttctaagaatgaagaaatttgtgaaggatgttctgggagattggcctctattactgtttctaaggatgattctgacactgtgcaagatggtagcaagaaaggacaagaatcataaacaaaaagttgctctgcattgttgaagatggttggcacaccatttctgtaggcccaggaaactcctgggagggttttcttgagaaaatgcatataatgagtttagttcttgggttgctctgactctctgaatgtctgaaaatgtttgaattcgcatctgaatttcacagcttatcacggactcttcactgaaaaatgatgctctccatactgggagctgagctttctctg

SEQ ID NO: 107065 - DNA, 2013 bp, Homo sapiens
  Payload ID: 1021
  Gene Symbol: ALS2CR12
  Gene Name: amyotrophic lateral sclerosis 2 (juvenile) chromosome region, candidate 12
  Uniprot ID: Q96Q35
  ENST ID: ENST00000405148
  CDS Start-End: 445-1782
ctttggcctgccatctcccaagggcaaacctcacaactcaggcccaagtcacaggaatctgaatggtggggtgaccttctcctctagtttaatttcattgcaatactgagaaacttcaactgttttgtctttagaagggaaattcatgtttgtgccaggccagcctttgtaaaagcctttgattggattcactagaagtctgtcttcccgcagtacatatactgtgaattttctccttcggcatttcaaccacttggaatggccactaaagtggcttttgatctaaagtaaactctgattctgtgttgatggggaaccatttctctctaacatggtggtttctttaagatgtttgacttgggccacatgagaataacagatctttgggcagtccaagcaagagcctcctgatctagcagccaagactccccctgacctttggccatgtaccccaaccctctcatctactgcacctgctgggacccctggaacttgggaccacggaagctaatcaagacccctcaactaccacgcaagaactccacagggagttccaagctaactcctcttgtaccagctccaaaaaatcacaattacctccaaccaacaaaacctgttgtttccccaaaaatgaaaatccattcagcaaggcaagaagagactaataaatcattttatgaagtgatcaacgtgtcacctggctatcaacttgttcggaatcgggaacagatttctgtcaccttaggggatgagatgtttgataggaaaaagcggtgggaatcggagatcccggacaaaggcagattttccaggaccaacatcatttctgacctagaagagcaaatctcagagctgacagcaataattgaacaaatgaacagagaccaccagtctgcccagaaattgctctccagtgaaatggatctccgctgtgctgagatgaaacagaactttgaaaacaagaacagggagctcaaagaggcccatgaagcagaactcagtgagttggagaacaactacaaagcagccttgaaggcagagaagttggctgcccaagagaagctagaggagatgggaaaagaatacaagtatttgaagaatatgtttcgtacgtatcaggacagtatttatgatgaaatggaagagaagtggtcaaaacagaaggcgaaatggaagaaggatgagaagttcgagcgagaaaatatcctgctacagcaaaaaaaaaagatgaccaaaaaattcgaaatggagtcaggagaagaagataagaaaataaatgaatcctgcagtgctgtctttgagaacttcattcaagagaaggaggagctcttgaaacaacatcaaagtgacaccttgcaattagaagagctgagaaaaaccaaagaggtgccctggagaagagaccaaataaatagacattggcatgatgtcctgcaacagcttcttcttatgcaggtcatgcaggaagaattgcatgcacaagcccttatcctagagtcactgaacacaaacctctactatacccagttggaactccagaaagagaaagctatagtgggaaatctggagaaaatgcttcaaaccaagtttgctgaaactgaagaaaagtataagcacaccatacagatcctgacggaagagaacattcatctgaagcaaaagataatttctaagaatgaagaaatttgtgaaggatgttctgggagattggcctctattactgtttctaaggatgattctgacactgtgcaagatggtagcaagaaaggacaagaatcataaacaaaaagttgctctgcattgttgaagatggttggcacaccatttctgtaggcccaggaaactcctgggagggttttcttgagaaaatgcatataatgagtttagttcttgggttgctctgactctctgaatgtctgaaaatgtttgaattcgcatctgaatttcacagcttatcacggactcttcactgaaaaatgatgctctccatactgggagctgagctttctctga

SEQ ID NO: 107066 - DNA, 430 bp, Homo sapiens
  Payload ID: 1021
  Gene Symbol: ALS2CR12
  Gene Name: amyotrophic lateral sclerosis 2 (juvenile) chromosome region, candidate 12
  ENST ID: ENST00000425488
  CDS Start-End: 1-430
atgaaaatccattcagcaaggcaagaagagactaataaatcattttatgaagtgatcaacgtgtcacctggctatcaacttgttcggaatcgggaacagatttctgtcaccttaggggatgagatgtttgataggaaaaagcggtgggaatcggagatcccggacaaaggcagattttccagggagctcaaagaggcccatgaagcagaactcagtgagttggagaacaactacaaagcagccttgaaggcagagaagttggctgcccaagagaagctagaggagatgggaaaagaatacaagtatttgaagaatatgtttcgtacgtatcaggacagtatttatgatgaaatggaagagaagtggtcaaaacagaaggcgaaatggaagaaggatgagaagttcgagcgagaaaatatcctgctacagc

SEQ ID NO: 107067 - DNA, 782 bp, Homo sapiens
  Payload ID: 1021
  Gene Symbol: ALS2CR12
  Gene Name: amyotrophic lateral sclerosis 2 (juvenile) chromosome region, candidate 12
  ENST ID: ENST00000415745
  CDS Start-End: 1-374
acagtatttatgatgaaatggaagagaagtggtcaaaacagaaggcgaaatggaagaaggatgagaagttcgagcgagaaaatatcctgctacagcaaaaaaaaaagatgaccaaaaaattcgaaatggagtcaggagaagaagataagaaaataaatgaatcctgcagtgctgtctttgagaacttcattcaagagaaggaggagctcttgaaacaacatcaaagtgacaccttgcaattagaagagctgagaaaaaccaaagaggtcatgcaggaagaattgcatgcacaagcccttatcctagagtcactgaacacaaacctctactatacccagttggaactccagaaagaggcaaaagataatttctaagaatgaagaaatttgtgaaggatgttctgggagattggcctctattactgtttctaaggatgattctgacactgtgcaagatggtagcaagaaaggacaagaatcataaacaaaaagttgctctgcattgttgaagatggttggcacaccatttctgtaggcccaggaaactcctgggagggttttcttgagaaaatgcatataatgagtttagttcttgggttgctctgactctctgaatgtctgaaaatgtttgaattcgcatctgaatttcacagcttatcacggactcttcactgaaaaatgatgctctccatactgggagctgagctttctctgagttttgtactatttttcttctaccttgacgtatttcgttagaaagaaactgatttgaaggccttcttc

SEQ ID NO: 107068 - DNA, 458 bp, Homo sapiens
  Payload ID: 1021
  Gene Symbol: ALS2CR12
  Gene Name: amyotrophic lateral sclerosis 2 (juvenile) chromosome region, candidate 12
  ENST ID: ENST00000418364
  CDS Start-End: 312-458
ctcagtagcttcatctatagtatcagcataacaataattgagcagttttacctggctcacagcaaggactcggctatggcaaattttattttattttaattattttgttttatttttatttgtatcttattttattttttgagacgaagtctcactcttcacccaggctggagtgcagtggcacaatctcagctcactgcaacctctgcctcccaggttcaagcaatcctcccacctcagcctcctgagtagctgggactatagcaagagcctcctgatctagcagccaagactccccctgacctttggccatgtaccccaaccctctcatctactgcacctgctgggacccctggaacttgggaccacggaagctaatcaagacccctcaactaccacgcaagaactccacagggagttccaagctaactcctcttgtaccagctccaaaaaatcac

SEQ ID NO: 107069 - DNA, 1626 bp, Homo sapiens
  Payload ID: 1021
  Gene Symbol: ALS2CR12
  Gene Name: amyotrophic lateral sclerosis 2 (juvenile) chromosome region, candidate 12
  Uniprot ID: Q96Q35
  ENST ID: ENST00000439709
  CDS Start-End: 133-1401
atagcaacaaaataaacaaactttggcctgccatctcccaagggcaaacctcacaactcaggcccaagtcacaggaatctgaatgcaagagcctcctgatctagcagccaagactccccctgacctttggccatgtaccccaaccctctcatctactgcacctgctgggacccctggaacttgggaccacggaagctaatcaagacccctcaactaccacgcaagaactccacagggagttccaagctaactcctcttgtaccagctccaaaaaatcacaattacctccaaccaacaaaacctgttgtttccccaaaaatgaaaatccattcagcaaggcaagaagagactaataaatcattttatgaagtgatcaacgtgtcacctggctatcaacttgttcggaatcgggaacagatttctgtcaccttaggggatgagatgtttgataggaaaaagcggtgggaatcggagatcccggacaaaggcagattttccaggaccaacatcatttctgacctagaagagcaaatctcagagctgacagcaataattgaacaaatgaacagagaccaccagtctgcccagaaattgctctccagtgaaatggatctccgctgtgctgagatgaaacagaactttgaaaacaagaacagggagctcaaagaggcccatgaagcagaactcagtgagttggagaacaactacaaagcagccttgaaggcagagaagttggctgcccaagagaagctagaggagatgggaaaagaatacaagtatttgaagaatatgtttcgtacgtatcaggacagtatttatgatgaaatggaagagaagtggtcaaaacagaaggcgaaatggaagaaggatgagaagttcgagcgagaaaatatcctgctacagcaaaaaaaaaagatgaccaaaaaattcgaaatggagtcaggagaagaagataagaaaataaatgaatcctgcagtgctgtctttgagaacttcattcaagagaaggaggagctcttgaaacaacatcaaagtgacaccttgcaattagaagagctgagaaaaaccaaagaggtcatgcaggaagaattgcatgcacaagcccttatcctagagtcactgaacacaaacctctactatacccagttggaactccagaaagagaaagctatagtgggaaatctggagaaaatgcttcaaaccaagtttgctgaaactgaagaaaagtataagcacaccatacagatcctgacggaagagaacattcatctgaagcaaaagataatttctaagaatgaagaaatttgtgaaggatgttctgggagattggcctctattactgtttctaaggatgattctgacactgtgcaagatggtagcaagaaaggacaagaatcataaacaaaaagttgctctgcattgttgaagatggttggcacaccatttctgtaggcccaggaaactcctgggagggttttcttgagaaaatgcatataatgagtttagttcttgggttgctctgactctctgaatgtctgaaaatgtttgaattcgcatctgaatttcacagcttatcacggactcttcactgaaaaatgatgctctccatactgggagctgagcttt

SEQ ID NO: 107070 - DNA, 8262 bp, Homo sapiens
  Payload ID: 1022
  Gene Symbol: ANAPC1
  Gene Name: anaphase promoting complex subunit 1
  Uniprot ID: Q9H1A4
  ENST ID: ENST00000341068
  CDS Start-End: 774-6608
tcccaaagtgctgggattacaggcgcgagtggccgctggggttcttaacttgggtctttgaatcgccttaagaagtgtctctgaatctgggaattgcaagcaacgtttctgtgaggaccttcacacagttcatccactcttcgaagagtatggaccgaaaaaggcatagagcattcactgcacgtagagaaaatcagcaacccctgctccccaccctcagcctgaggtgcctacctccacgtggggtcaggaggcggaagcgaaaccagaagaaaaaaccctgagatctataaggcagttcaggtccctagtgacatgagctaaagagaacttggacgccaggactgtagcagacagagtccggcttcggggttcgcatcagtcgcacggaaggtggaaatagcccccaagttgtaacccgccgcggtcttccctcaacagcgcaggcgccaggactgctaggacgccgcgcacctcccgcgatgccccgccccggcgcgaggcaagacgggaaagtcaagatggacgcgtccatttgaacgtctcgcacgccttcctgccattagcactcgagcccgctgctgttgcccgttcttcctccagaataggggagggagagggaatgagaagctgctgcggcccaagagtcactgtgaaggaccccgccgctgccctcgggcctcctcggcccctgcgcctccggggagcagccggggctcgccgcgcctgacgcgtcccgagttatacagaaataatgttgatatttggaacccatgtcgaacttctatgaagaaaggacaacgatgattgcagcaagggatttgcaggaatttgttccttttggtcgagaccactgcaagcaccaccctaatgctttgaaccttcaacttcgccagctgcagccagcttctgaattatggtcttctgatggtgctgctggcttggtgggatcccttcaggaggttacaatccacgagaaacagaaggaaagctggcagttaaggaaaggagtaagtgaaattggagaagatgtggactatgatgaggaactctatgttgctggaaatatggtgatatggagcaaaggaagtaaaagccaggcattggcagtttataaagcatttacagttgacagtcctgttcagcaggcattgtggtgtgacttcattatatcacaggataagtctgaaaaggcctacagtagcaatgaagtagaaaaatgcatatgtatattgcaaagctcatgtattaacatgcatagcatagaaggaaaggattacatagcttcattaccatttcaggttgcaaatgtttggcccactaaatatggattgctgtttgaacgaagcgcttcttcacatgaagtacctccaggttcacccagagaacctttacctactatgttcagcatgctgcacccactagatgaaataactccacttgtttgtaaatctggaagtctttttggttcatcacgggtgcaatatgttgtagatcatgcaatgaaaattgttttcctcaatactgacccctctattgtaatgacttatgatgctgttcaaaatgtgcattctgtgtggactctccggagagtcaaatcagaggaagagaatgttgttttaaagttctctgaacaggggggaaccccacagaatgtggccactagcagctccctcacagcacatctcagaagcctctccaaaggagattcccctgtgacttcacctttccagaattactcctccattcacagccagagtcgctcaacctcatcacccagtctacattctcgctcaccttctatttccaacatggcagctctaagtcgtgctcattctcctgcgttaggagtgcactctttttcaggggtgcaaaggttcaacatttcaagccataatcagtctccaaagagacatagtatttctcattctccaaatagtaattctaatggctcctttcttgcaccagaaacggagccaattgttcctgaactgtgtattgaccatttgtggacagaaacgattactaatataagagagaaaaattcacaagcctcaaaagtgtttattacatctgacctatgtgggcaaaagttcctgtgctttttagtagagtcccagctccagttacgctgtgtaaagtttcaagagagtaatgataaaacccagctcatctttggttcagtgaccaacataccagcaaaggatgcagcaccagtggagaaaatagacaccatgctggtcttggaaggcagtggaaacctggtgctatacacaggagtggttcgggtgggaaaggtttttattcctggactgccagctccctctctgacgatgtccaacacaatgcctcggcccagtactccactagatggcgttagtactccaaagcctcttagtaaactccttggatcattggacgaggttgttctgttgtccccagttccagaactgagggattcttcaaaacttcatgattctctctataatgaggattgtactttccaacagcttggaacttacattcattctatcagagatcctgtccataacagagtcaccctggaactgagtaatggctccatggttaggatcactattcctgaaattgccacctctgagttagtacaaacgtgtttgcaagcaattaagtttatcctgccaaaagaaatagcagttcagatgcttgtcaagtggtacaatgtccacagtgctccaggaggacccagttatcactcagagtggaatttatttgtgacttgtctcatgaacatgatgggttataacacagaccgcttagcatggactagaaattttgactttgaaggatcactttctcctgtcattgcgcccaaaaaagcaaggccttccgagactggatctgatgatgactgggaatatttactaaattcagactaccaccagaatgttgagtctcatcttttgaacagatctttatgtctgagtccttcagaagcttcacagatgaaggatgaggatttttcacagaatctcagtctggattcttctacacttctctttactcacatacctgcaatttttttcgttcttcaccttgtgtatgaggagcttaagttgaatactctaatgggagaaggaatttgttcacttgttgaacttctcgttcagttggcaagggacttaaaattggggccttatgtagatcattactatagagactacccaacgcttgtcagaactactggacaagtgtgcacaattgatccaggtcaaacaggatttatgcatcatccatcattttttacgtctgagccaccaagtatttatcagtgggtgagttcttgtctgaagggtgaaggaatgccaccttatccttacctccctggaatctgtgaaagaagcagacttgtagtcttgagtattgcactgtacatacttggtgatgagagcttggtttctgatgaatcctcacagtatttaaccagaataactatagccccccagaagttgcaagtagaacaagaggaaaacaggtttagtttcaggcattctacatctgtttctagtctagctgaaagattggttgtctggatgactaatgtaggattcactttaagagatttggaaactcttccctttggaattgctcttcccatcagagatgcaatttatcactgtcgtgagcagcctgcctcagactggccagaagctgtctgtctcttgattggacgtcaggatctttccaagcaggcctgcgaaggaaacttacccaaagggaagtctgtgctctcatcagatgttccttcaggaacagaaactgaggaggaagatgacggcatgaatgacatgaatcacgaggtcatgtcattaatatggagtgaagatttaagggtgcaggatgtgcgaaggcttcttcagagtgcgcatcctgtccgtgtcaacgtagtgcagtacccagagctcagtgaccacgagttcatcgaggaaaaggaaaacagattgctccaattgtgtcagcgaactatggctcttcctgtaggacgaggaatgtttaccttgttttcgtaccatcctgttccaacagagccattgcctattcctaaattgaatctgactgggcgtgcccctcctcggaacacaacagtagaccttaatagtggaaacatcgatgtgcctcccaacatgacaagctgggccagctttcataatggtgtggctgctggcctgaagatagctcctgcctcccagatcgactcagcttggattgtttacaataagcccaagcatgctgagttggccaatgagtatgctggctttctcatggctctgggtttgaatgggcaccttaccaagctggcgactctcaatatccatgactacttgaccaagggccatgaaatgacaagcattggactgctacttggtgtttctgctgcaaaactaggcaccatggatatgtctattactcggcttcttagcattcacattcctgctctcttacccccaacgtccacagagctggatgttcctcacaatgtccaagtggctgcagtggttggcattggccttgtatatcaagggacagctcacagacatactgcagaagtcctgttggctgagataggacggcctcctggtcctgaaatggaatactgcactgacagagagtcatactccttagctgctggcttggccctgggcatggtctgcttggggcatggcagcaatttgataggtatgtctgatctcaatgtgcctgagcagctctatcagtacatggttggaggacataggcgctttcaaacaggaatgcatagggagaaacataaatcaccaagttatcaaatcaaagaaggagataccataaatgtggatgtgacttgtccaggtgctactctagctttggctatgatctacttaaaaaccaataacagatctattgcagattggctccgagcccctgacaccatgtatttgttggactttgtgaagccagaatttctcttgcttaggacacttgctcgatgcctgattttgtgggatgatattttaccaaattccaagtgggttgacagcaatgttcctcaaattataagagaaaatagtatctctctcagtgaaatcgaattgccgtgctcagaggatttgaatttggaaactttgtcccaagcacatgtctacataattgcaggagcctgcttgtctctgggttttcgatttgctggctcagaaaacttatcagcatttaactgtttgcataaatttgccaaagattttatgacttatttgtccgcacctaatgcttctgttacaggtcctcataacctagaaacttgtctgagcgtggtgctgctgtctctcgccatggtcatggctggctcaggaaacctaaaggttttgcagctttgtcgcttcttacacatgaaaacgggtggtgaaatgaactatggttttcacttagcccaccacatggcccttggacttctatttttgggaggaggaaggtactctttgagcacatcaaattcttccattgccgctcttctctgtgccctttatccgcacttcccagctcacagcactgacaaccggtatcatctccaggctctccggcacctctatgtgctggccgcggagcccaggcttctagtgcctgtggatgtggacacaaacacgccctgctatgccctcttagaagttacctacaagggcactcagtggtatgaacaaaccaaagaagaattgatggctcctacccttcttccagaactccatcttttaaagcagattaaagtaaaaggcccaagatactgggaactgctcatagatttaagcaaaggaacacaacacttgaagtccatcctttccaaggatggggttttatatgttaaactccgggcgggtcagctctcctacaaagaagatccaatgggatggcaaagtttgttggctcagactgttgctaacaggaactctgaagcccgggctttcaagccagaaacaatctcagcattcacttctgatccagcacttctgtcatttgctgaatatttctgcaagccaactgtgaacatgggtcagaaacaggaaattctggatctcttttcttcagtactctatgaatgtgttacccaggagaccccagagatgttgcctgcatacatcgcaatggatcaggctataagaagacttgggagaagagaaatgtctgagacttctgaactttggcagataaagttggtgttagagtttttcagctcccgaagccatcaggagcggctgcagaaccaccctaagcgggggctctttatgaactcggaattcctccctgttgtgaagtgcaccattgataataccctggaccagtggctacaagtcgggggtgatatgtgtgtgcacgcctacctcagcgggcagcccttggaggaatcacagctgagcatgctggcctgcttcctcgtctaccactctgtgccagctccacagcacctgccacctataggactagaagggagcacaagctttgctgaactgctcttcaaatttaagcagctaaaaatgccagtgcgagctttgctgagattggctcctttgcttcttggaaatccacagccaatggtgatgtgaccgtgtctggcggtgaacctaccctgaaacgtgacttctgcacaacaaacgtgaccaaacatcaaagctaaagcaatgtttataaagttttatggtataactagggggaaatgagctgcacaaacctcaatgtattttaaatctgttgctgtcatcattaacggtatatgacatataaaagcaagttaaaatttacttttgtaaataaagtttttggtttgtttccaaaactcttgatgattgctttagttttggacttagagaatagagcaggggttgctggagtgaatattgatttttaaagtctttgaactgtggtggtataggtgaagtgactatgcccaaaaatgccaagttttaaaagaagctatgtcataaagttttactttctgtggcaaaagagcgctttagcatttcctcagatgtcacagttgtcctgtctaaaataagtttgtacttctggtgacaatgccagacactcttatgatgtgatcaccttaaacaggagaaggagatttttgccctcagttgctcaacatgaagtactgtggactgaattgtgtcctcccagaattatatattgaggccctaatccctgtgtgactgtattaggcaatagggcatataggagattactaaggttaagtgaggtcatcataagggtggggccttaattcagtagaattggtggcctcctaagcagaggaagagagatttttctttctctctctgccatgtgaagacagtgaggagtcggccgtctgcaagccaagaagagcccttatcaggaacagacttggctagcaccttcatcgtggacctccagcctccagaattgcaagaaaatacatttccgtcgttgaaaccacccagtctgtggtattttgttatggcagcccaggcagactaatacgtgaagcctgctctaaatagataaaataagaaattactacagagggctctttagaaattgtatttaaaaacaagacaatccatatttacctaagatttacagaatgtatgtctataaaaggagggatttctggactagatgatgatgaaaaatgttcatataaaggcacctccagcttcgagttgccaacacaggaggaagaatgctccctgctgttcagatgctgatatgtgtcctgtgcttcctggatggccagtgggatcataagctggtagaagcaagaccttcatccactgacttcatatttcttccacatcctgaactgtggtgtttgactttaaaaataaattaaagcaaatagaaatgtttccattgagattttggcaaaaacccacatgacatttgcgtctgcagagtagacttggaaggcatgcacctggaggccaagtggtattctctggactctctgtccttgcatttgcgtggctgccccgaggactcgcttcttcctggatgtgaagcagaggcacgatggggctgactgagaggctgaaatgtgcttctcttcacagttacatagttttcttctaattaaaaataaattttaagtggtagattatgaaaattccatttgaatcaagattttaaaaattcaatatcaaaccagttgttactgtcttcactctccgttgtttacgattgtgtgcttttcctgaataaagaatgactggagagacatta

SEQ ID NO: 107071 - DNA, 5047 bp, Homo sapiens
  Payload ID: 1022
  Gene Symbol: ANAPC1
  Gene Name: anaphase promoting complex subunit 1
  ENST ID: ENST00000427997
  CDS Start-End: 1-4357
catctttggttcagtgaccaacataccagcaaaggatgcagcaccagtggagaaaatagacaccatgctggtcttggaaggcagtggaaacctggtgctatacacaggagtggttcgggtgggaaaggtttttattcctggactgccagctccctctctgacgatgtccaacacaatgcctcggcccagtactccactagatggcgttagtactccaaagcctcttagtaaactccttggatcattggacgaggttgttctgttgtccccagttccagaactgagggattcttcaaaacttcatgattctctctataatgaggattgtactttccaacagcttggaacttacattcattctatcagagatcctgtccataacagagtcaccctggaactgagtaatggctccatggttaggatcactattcctgaaattgccacctctgagttagtacaaacgtgtttgcaagcaattaagtttatcctgccaaaagaaatagcagttcagatgcttgtcaagtggtacaatgtccacagtgctccaggaggacccagttatcactcagagtggaatttatttgtgacttgtctcatgaacatgatgggttataacacagaccgcttagcatggactagaaattttgactttgaaggatcactttctcctgtcattgcgcccaaaaaagcaaggccttccgagactggatctgatgatgactgggaatatttactaaattcagactaccaccagaatgttgagtctcatcttttgaacagatctttatgtctgagtccttcagaagcttcacagatgaaggatgaggatttttcacagaatctcagtctggattcttctacacttctctttactcacatacctgcaatttttttcgttcttcaccttgtgtatgaggagcttaagttgaatactctaatgggagaaggaatttgttcacttgttgaacttctcgttcagttggcaagggacttaaaattggggccttatgtagatcattactatagagactacccaacgcttgtcagaactactggacaagtgtgcacaattgatccaggtcaaacaggatttatgcatcatccatcattttttacgtctgagccaccaagtatttatcagtgggtgagttcttgtctgaagggtgaaggaatgccaccttatccttacctccctggaatctgtgaaagaagcagacttgtagtcttgagtattgcactgtacatacttggtgatgagagcttggtttctgatgaatcctcacagtatttaaccagaataactatagccccccagaagttgcaagtagaacaagaggaaaacaggtttagtttcaggcattctacatctgtttctagtctagctgaaagattggttgtctggatgactaatgtaggattcactttaagagatttggaaactcttccctttggaattgctcttcccatcagagatgcaatttatcactgtcgtgagcagcctgcctcagactggccagaagctgtctgtctcttgattggacgtcaggatctttccaagcaggcctgcgaaggaaacttacccaaagggaagtctgtgctctcatcagatgttccttcaggaacagaaactgaggaggaagatgacggcatgaatgacatgaatcacgaggtcatgtcattaatatggagtgaagatttaagggtgcaggatgtgcgaaggcttcttcagagtgcgcatcctgtccgtgtcaacgtagtgcagtacccagagctcagtgaccacgagttcatcgaggaaaaggaaaacagattgctccaattgtgtcagcgaactatggctcttcctgtaggacgaggaatgtttaccttgttttcgtaccatcctgttccaacagagccattgcctattcctaaattgaatctgactgggcgtgcccctcctcggaacacaacagtagaccttaatagtggaaacatcgatgtgcctcccaacatgacaagctgggccagctttcataatggtgtggctgctggcctgaagatagctcctgcctcccagatcgactcagcttggattgtttacaataagcccaagcatgctgagttggccaatgagtatgctggctttctcatggctctgggtttgaatgggcaccttaccaagctggcgactctcaatatccatgactacttgaccaagggccatgaaatgacaagcattggactgctacttggtgtttctgctgcaaaactaggcaccatggatatgtctattactcggcttcttagcattcacattcctgctctcttacccccaacgtccacagagctggatgttcctcacaatgtccaagtggctgcagtggttggcattggccttgtatatcaagggacagctcacagacatactgcagaagtcctgttggctgagataggacggcctcctggtcctgaaatggaatactgcactgacagagagtcatactccttagctgctggcttggccctgggcatggtctgcttggggcatggcagcaatttgataggtatgtctgatctcaatgtgcctgagcagctctatcagtacatggttggaggacataggcgctttcaaacaggaatgcatagggagaaacataaatcaccaagttatcaaatcaaagaaggagataccataaatgtggatgtgacttgtccaggtgctactctagctttggctatgatctacttaaaaaccaataacagatctattgcagattggctccgagcccctgacaccatgtatttgttggactttgtgaagccagaatttctcttgcttaggacacttgctcgatgcctgattttgtgggatgatattttaccaaattccaagtgggttgacagcaatgttcctcaaattataagagaaaatagtatctctctcagtgaaatcgaattgccgtgctcagaggatttgaatttggaaactttgtcccaagcacatgtctacataattgcaggagcctgcttgtctctgggttttcgatttgctggctcagaaaacttatcagcatttaactgtttgcataaatttgccaaagattttatgacttatttgtccgcacctaatgcttctgttacaggtcctcataacctagaaacttgtctgagcgtggtgctgctgtctctcgccatggtcatggctggctcaggaaacctaaaggttttgcagctttgtcgcttcttacacatgaaaacgggtggtgaaatgaactatggttttcacttagcccaccacatggcccttggacttctatttttgggaggaggaaggtactctttgagcacatcaaattcttccattgccgctcttctctgtgccctttatccgcacttcccagctcacagcactgacaaccggtatcatctccaggctctccggcacctctatgtgctggccgcggagcccaggcttctagtgcctgtggatgtggacacaaacacgccctgctatgccctcttagaagttacctacaagggcactcagtggtatgaacaaaccaaagaagaattgatggctcctacccttcttccagaactccatcttttaaagcagattaaagtaaaaggcccaagatactgggaactgctcatagatttaagcaaaggaacacaacacttgaagtccatcctttccaaggatggggttttatatgttaaactccgggcgggtcagctctcctacaaagaagatccaatgggatggcaaagtttgttggctcagactgttgctaacaggaactctgaagcccgggctttcaagccagaaacaatctcagcattcacttctgatccagcacttctgtcatttgctgaatatttctgcaagccaactgtgaacatgggtcagaaacaggaaattctggatctcttttcttcagtactctatgaatgtgttacccaggagaccccagagatgttgcctgcatacatcgcaatggatcaggctataagaagacttgggagaagagaaatgtctgagacttctgaactttggcagataaagttggtgttagagtttttcagctcccgaagccatcaggagcggctgcagaaccaccctaagcgggggctctttatgaactcggaattcctccctgttgtgaagtgcaccattgataataccctggaccagtggctacaagtcgggggtgatatgtgtgtgcacgcctacctcagcgggcagcccttggaggaatcacagctgagcatgctggcctgcttcctcgtctaccactctgtgccagctccacagcacctgccacctataggactagaaggtcttctgaaggacctagcaggagactcaggttgaaaccctacagaacctcgccgtgtgccgcccagtcttccttgaataaggccattttctcaccctttgtctagtaactagctgactccacagctcatggtaaggggcatgtctcagctcagggggtctcctgacatcccagaggaagcaataaggtgggggtctttcatctctcagcctgatgatctgtgcacacccacttgatgggaggccagggtgcctgtgggcagatgggtcagagtgtgggccaggatttggagtagaagccagagcatgtgaaaatccaaaccaggaagacttcgttgcctcccgcatgtggggttgaaggcctctcttctgtggtctcccatcctcatgctgatcaaattgggggggaatgtctcactgtgtgaggatcaccccaattaagctgtgggggaggacacagaatctgatcccctctgtatccttagcgcatgctacctccagccaccaggggaaagaagcagaggtgaggtgggagaggtggccactctggacggtgtaactgggctggctgcctctcagcgcccacgagcaccccacagatatccacgctagtgtacaaaggttcccaagtggtggccttttcctgcttccaagggctgcccgggttcccccctctctgaaatagattggttgcttctcattacgtcacaagctgcagaaaaaaaa

SEQ ID NO: 107072 - DNA, 662 bp, Homo sapiens
  Payload ID: 1022
  Gene Symbol: ANAPC1
  Gene Name: anaphase promoting complex subunit 1
  ENST ID: ENST00000451367
  CDS Start-End: 54-503
ctgaccagaatgtgtttgaattcatacagaaataatgttgatatttggaacccatgtcgaacttctatgaagaaaggacaacgatgattgcagcaagggatttgcaggaatttgttccttttggtcgagaccactgcaagcaccaccctaatgctttgaaccttcaacttcgccagctgcagccagcttctgaattatggtcttctgatggtgctgctggcttggtgggatcccttcaggaggttacaatccacgagaaacagaaggaaagctggcagttaaggaaaggagtaagtgaaattggagaagatgtggactatgatgaggaactctatgttgctggaaatatggtgatatggagcaaaggaagtaaaagccaggcattggcagtttataaagcatttacagttgacagtcctgttcagcaggcattgtggtgtgacttcattatatcacaggataagtctgaaaaggcctacagttgcaaatgtttggcccactaaatatggattgctgtttgaacgaagcgcttcttcacatgaagtacctccaggttcacccagagaacctttacctactatgttcagcatgctgcacccactagatgaaataactccacttgtttgtaaatctggaagtaagtgtatttctatattctttta

SEQ ID NO: 107073 - DNA, 450 bp, Homo sapiens
  Payload ID: 1022
  Gene Symbol: ANAPC1
  Gene Name: anaphase promoting complex subunit 1
  ENST ID: ENST00000628342
  CDS Start-End: 1-450
atgtcgaacttctatgaagaaaggacaacgatgattgcagcaagggatttgcaggaatttgttccttttggtcgagaccactgcaagcaccaccctaatgctttgaaccttcaacttcgccagctgcagccagcttctgaattatggtcttctgatggtgctgctggcttggtgggatcccttcaggaggttacaatccacgagaaacagaaggaaagctggcagttaaggaaaggagtaagtgaaattggagaagatgtggactatgatgaggaactctatgttgctggaaatatggtgatatggagcaaaggaagtaaaagccaggcattggcagtttataaagcatttacagttgacagtcctgttcagcaggcattgtggtgtgacttcattatatcacaggataagtctgaaaaggcctacagttgcaaatgtttggcccactaa

SEQ ID NO: 107074 - DNA, 868 bp, Homo sapiens
  Payload ID: 1023
  Gene Symbol: ANAPC10
  Gene Name: anaphase promoting complex subunit 10
  Uniprot ID: Q9UM13
  ENST ID: ENST00000309439
  CDS Start-End: 96-653
attgagctgcgacccttgttcaacgccgttggcgaagccagctgctggaggtgccgagaatctgagtttcggcaagcagccagaatattttaaaaatgactacaccaaacaagacacctcctggtgctgaccccaagcagttggaaaggactggaacagtacgggaaattgggtcacaagctgtttggtcactctcatcttgcaaaccaggatttggagtggatcagttacgagatgacaatctagaaacttattggcaatcagatggttcccagcctcatttagtgaacatccaattcagaagaaaaacaacagtgaagacattatgtatttatgcagactacaaatctgatgaaagctatactccaagcaagatctcagtcagagtaggaaataattttcacaaccttcaagaaattcggcaacttgagttggtggaaccaagtggctggattcatgttcccttaactgacaatcataagaagccaactcgtacattcatgatacagattgctgttctagccaatcaccagaatggaagagacacccatatgagacaaattaaaatatacacaccagtagaagagagctccattggtaaatttcctagatgtacaactatagatttcatgatgtatcgttcaataaggtgactttaaaatgagacgaaaatcattaaacgtatctttgttttatcctgtatttaaataatatatcatgtacctttattgaacaaggcatccgttatatctaattttgtatatgtttaaaaatattttattgtaactttgacaaataaatttggggtcatattatctttattttctttaacatgtaataaagctcacatattttacattactaaaaa

SEQ ID NO: 107075 - DNA, 928 bp, Homo sapiens
  Payload ID: 1023
  Gene Symbol: ANAPC10
  Gene Name: anaphase promoting complex subunit 10
  Uniprot ID: Q9UM13
  ENST ID: ENST00000451299
  CDS Start-End: 156-713
gccgttggcgaagccagctgctggaggtgccgagaatctgagtttcggcaagcagccaggtctggaaactgtaacaggacattcagttagtaatgatggttgcaggttgaatagtctcgccctagatctcacctaacttgcagaatattttaaaaatgactacaccaaacaagacacctcctggtgctgaccccaagcagttggaaaggactggaacagtacgggaaattgggtcacaagctgtttggtcactctcatcttgcaaaccaggatttggagtggatcagttacgagatgacaatctagaaacttattggcaatcagatggttcccagcctcatttagtgaacatccaattcagaagaaaaacaacagtgaagacattatgtatttatgcagactacaaatctgatgaaagctatactccaagcaagatctcagtcagagtaggaaataattttcacaaccttcaagaaattcggcaacttgagttggtggaaccaagtggctggattcatgttcccttaactgacaatcataagaagccaactcgtacattcatgatacagattgctgttctagccaatcaccagaatggaagagacacccatatgagacaaattaaaatatacacaccagtagaagagagctccattggtaaatttcctagatgtacaactatagatttcatgatgtatcgttcaataaggtgactttaaaatgagacgaaaatcattaaacgtatctttgttttatcctgtatttaaataatatatcatgtacctttattgaacaaggcatccgttatatctaattttgtatatgtttaaaaatattttattgtaactttgacaaataaatttggggtcatattatctttattttctttaacatgtaataaagctcacatattttacattactaaaaa

SEQ ID NO: 107076 - DNA, 689 bp, Homo sapiens
  Payload ID: 1023
  Gene Symbol: ANAPC10
  Gene Name: anaphase promoting complex subunit 10
  ENST ID: ENST00000513054
  CDS Start-End: 215-689
gaagccagctgctggaggtgccgagaatctgagtttcggcaagcagccaggtctggaaactgtaacaggacattcagttagtaatgatggttgcaggttgaatagtctcgccctagatctcacctaacttgcagtaagtatcaagtgcttgtgtgccgattaaagaacaacttcggatacaatgggaggtgtcaaggaaacgaatattttaaaaatgactacaccaaacaagacacctcctggtgctgaccccaagcagttggaaaggactggaacagtacgggaaattgggtcacaagctgtttggtcactctcatcttgcaaaccaggatttggagtggatcagttacgagatgacaatctagaaacttattggcaatcagatggttcccagcctcatttagtgaacatccaattcagaagaaaaacaacagtgaagacattatgtatttatgcagactacaaatctgatgaaagctatactccaagcaagatctcagtcagagtaggaaataattttcacaaccttcaagaaattcggcaacttgagttggtggaaccaagtggctggattcatgttcccttaactgacaatcataagaagccaactcgtacattcatgatacagattgctgttctagccaatcaccagaatggaagagacacccatatgagacaaattaaaatat

SEQ ID NO: 107077 - DNA, 794 bp, Homo sapiens
  Payload ID: 1023
  Gene Symbol: ANAPC10
  Gene Name: anaphase promoting complex subunit 10
  ENST ID: ENST00000514390
  CDS Start-End: 319-794
acgcgctgctgctgtctccgccacctaaggcctaaccaaaggctctcggagaacgtccctacattctttccaacctggcagatggcagctaacggccaaacctctccgggctattcacgtacctggagaaaacgatccccttgcggaggggagcacagaggccaaatcagctcttgccttcacttttcagccacacagcgtgttctcacggccaccggccaaaatggcggtgcccagccgccgcacgcgcaagccataggacgtagtgcgcgcgcgcgacatagagcgtgaggcggaaccctggagaatattttaaaaatgactacaccaaacaagacacctcctggtgctgaccccaagcagttggaaaggactggaacagtacgggaaattgggtcacaagctgtttggtcactctcatcttgcaaaccaggatttggagtggatcagttacgagatgacaatctagaaacttattggcaatcagatggttcccagcctcatttagtgaacatccaattcagaagaaaaacaacagtgaagacattatgtatttatgcagactacaaatctgatgaaagctatactccaagcaagatctcagtcagagtaggaaataattttcacaaccttcaagaaattcggcaacttgagttggtggaaccaagtggctggattcatgttcccttaactgacaatcataagaagccaactcgtacattcatgatacagattgctgttctagccaatcaccagaatggaagagacacccatatgagacaaattaaaatata

SEQ ID NO: 107078 - DNA, 477 bp, Homo sapiens
  Payload ID: 1023
  Gene Symbol: ANAPC10
  Gene Name: anaphase promoting complex subunit 10
  ENST ID: ENST00000504721
  CDS Start-End: 151-477
tttttcacatatgaatagacttagtaaaattaacaaaagatgtgaaagatgaggtcaacctttttagaatgggccagttattcacttcaaaatcttgaagccattttcctgaccttatcttctatggtaagagcatataatattttaaaaatgactacaccaaacaagacacctcctggtgctgaccccaagcagttggaaaggactggaacagtacgggaaattgggtcacaagctgtttggtcactctcatcttgcaaaccaggatttggagtggatcagttacgagatgacaatctagaaacttattggcaatcagatggttcccagcctcatttagtgaacatccaattcagaagaaaaacaacagtgaagacattatgtatttatgcagactacaaatctgatgaaagctatactccaagcaagatctcagtcagagtaggaaataattttcacaaccttcaagaaattcgg

SEQ ID NO: 107079 - DNA, 1025 bp, Homo sapiens
  Payload ID: 1023
  Gene Symbol: ANAPC10
  Gene Name: anaphase promoting complex subunit 10
  Uniprot ID: Q9UM13
  ENST ID: ENST00000507656
  CDS Start-End: 95-652
cccttgttcaacgccgttggcgaagccagctgctggaggtgccgagaatctgagtttcggcaagcagccaggtctggaaactaatattttaaaaatgactacaccaaacaagacacctcctggtgctgaccccaagcagttggaaaggactggaacagtacgggaaattgggtcacaagctgtttggtcactctcatcttgcaaaccaggatttggagtggatcagttacgagatgacaatctagaaacttattggcaatcagatggttcccagcctcatttagtgaacatccaattcagaagaaaaacaacagtgaagacattatgtatttatgcagactacaaatctgatgaaagctatactccaagcaagatctcagtcagagtaggaaataattttcacaaccttcaagaaattcggcaacttgagttggtggaaccaagtggctggattcatgttcccttaactgacaatcataagaagccaactcgtacattcatgatacagattgctgttctagccaatcaccagaatggaagagacacccatatgagacaaattaaaatatacacaccagtagaagagagctccattggtaaatttcctagatgtacaactatagatttcatgatgtatcgttcaataaggtgactttaaaatgagacgaaaatcattaaacgtatctttgttttatcctgtatttaaataatatatcatgtacctttattgaacaaggcatccgttatatctaattttgtatatgtttaaaaatattttattgtaactttgacaaataaatttggggtcatattatctttattttctttaacatgtaataaagctcacatattttacattactaaaaatggatttgaagccaatcattttattttcccttgtatcaaaagaaaagagttccttgtatcaaaagaaaagagttgaactgaaaatttcagtatatacacaattataatagctaggtgattatttcattagtgttcatacattagagtaatggtttatt

SEQ ID NO: 107080 - DNA, 608 bp, Homo sapiens
  Payload ID: 1023
  Gene Symbol: ANAPC10
  Gene Name: anaphase promoting complex subunit 10
  ENST ID: ENST00000502847
  CDS Start-End: 403-608
gccaggtctggaaactgtgagtgtgtgggcttttctccgacgtcgagcgtggtcctagcgtaaacagatgcattcgcctctccggtttcaatctttttttacgtttgcgctttcctcaaggccggtgggtcaggagtggagccttagtcattctaacgctggaggtgtcagtaggaccaacagagtctggtgccgacacggcttactgttgcgcgctcttctaggcctcaacttcctctcaactgtgtggtaacaggacattcagttagtaatgatggttgcaggttgaatagtctcgccctagatctcacctaacttgcagtaagtatcaagtgcttgtgtgccgattaaagaacaacttcggatacaatgggaggtgtcaaggaaacgaatattttaaaaatgactacaccaaacaagacacctcctggtgctgaccccaagcagttggaaaggactggaacagtacgggaaattgggtcacaagctgtttggtcactctcatcttgcaaaccaggatttggagtggatcagttacgagatgacaatctagaaacttattggcaatcagatggttcccagcctcatttagtgaacatccaattcag

SEQ ID NO: 107081 - DNA, 505 bp, Homo sapiens
  Payload ID: 1023
  Gene Symbol: ANAPC10
  Gene Name: anaphase promoting complex subunit 10
  ENST ID: ENST00000512680
  CDS Start-End: 77-457
cattcagttagtaatgatggttgcaggttgaatagtctcgccctagatctcacctaacttgcagaatattttaaaaatgactacaccaaacaagacacctcctggtgctgaccccaagcagttggaaaggactggaacagtacgggaaattgggtcacaagctgtttggtcactctcatcttgcaaaccaggatttggagtggatcagttacgagatgacaatctagaaacttattggcaatcagatggttcccagcctcatttagtgaacatccaattcagaagaaaaacaacagtgaagacattatgtatttatgcagactacaaatctgatgaaagctatactccaagcaagatctcagtcagagtaggaaataattttcacaaccttcaagaaattcggcctcatgttttacatgtgaatgaagaatcaatgaatcttcaagtctcaggataaaggaatgagaatattgaagcagaaactgcaaataaaagacaatgcata

SEQ ID NO: 107082 - DNA, 1674 bp, Homo sapiens
  Payload ID: 1023
  Gene Symbol: ANAPC10
  Gene Name: anaphase promoting complex subunit 10
  Uniprot ID: Q9UM13
  ENST ID: ENST00000613466
  CDS Start-End: 319-876
acgcgctgctgctgtctccgccacctaaggcctaaccaaaggctctcggagaacgtccctacattctttccaacctggcagatggcagctaacggccaaacctctccgggctattcacgtacctggagaaaacgatccccttgcggaggggagcacagaggccaaatcagctcttgccttcacttttcagccacacagcgtgttctcacggccaccggccaaaatggcggtgcccagccgccgcacgcgcaagccataggacgtagtgcgcgcgcgcgacatagagcgtgaggcggaaccctggagaatattttaaaaatgactacaccaaacaagacacctcctggtgctgaccccaagcagttggaaaggactggaacagtacgggaaattgggtcacaagctgtttggtcactctcatcttgcaaaccaggatttggagtggatcagttacgagatgacaatctagaaacttattggcaatcagatggttcccagcctcatttagtgaacatccaattcagaagaaaaacaacagtgaagacattatgtatttatgcagactacaaatctgatgaaagctatactccaagcaagatctcagtcagagtaggaaataattttcacaaccttcaagaaattcggcaacttgagttggtggaaccaagtggctggattcatgttcccttaactgacaatcataagaagccaactcgtacattcatgatacagattgctgttctagccaatcaccagaatggaagagacacccatatgagacaaattaaaatatacacaccagtagaagagagctccattggtaaatttcctagatgtacaactatagatttcatgatgtatcgttcaataaggtgactttaaaatgagacgaaaatcattaaacgtatctttgttttatcctgtatttaaataatatatcatgtacctttattgaacaaggcatccgttatatctaattttgtatatgtttaaaaatattttattgtaactttgacaaataaatttggggtcatattatctttattttctttaacatgtaataaagctcacatattttacattactaaaaatggatttgaagccaatcattttattttcccttgtatcaaaagaaaagagttccttgtatcaaaagaaaagagttgaactgaaaatttcagtatatacacaattataatagctaggtgattatttcattagtgttcatacattagagtaatggtttattgcatatttgagaacaagactgtgttttatcaatatatatcatctttaataggtcaaaattactattttttctacccagaggaaggttattcttttaatactggatcttttaaaaaacagtgtcaaataagcttagtgttaggttgtctgatgagaaccaatctaatatggggagtataattaattgtctcatattcaccttcacggaatacttacagccctagggttgtctgtatcctaatgatattatgtaaagattgcctgtataatctagcagtacttatggaagagttctagcagtacttatggaagagttattttcaaatttgtgtctgacattgtagcattccctgggcagtcatatatcccataaaatcgtaaaagtatgtgaaattttttatatatattaaaagattttaaagaaat

SEQ ID NO: 107083 - DNA, 918 bp, Homo sapiens
  Payload ID: 1024
  Gene Symbol: ANAPC11
  Gene Name: anaphase promoting complex subunit 11
  Uniprot ID: Q9NYG5
  ENST ID: ENST00000344877
  CDS Start-End: 196-450
gcgtgcgcactggcgtgcgagactcggcgggcgctgttgagggagtcgggccgcgactgtggtcgtttttataccttcccgcgcggacgccggcgctgccaacggaagggcgggtagggcgagacggagtttcgtcatgttggccaggcccatttgagatctttgaagatatcctcaacgtgaggctctgctgccatgaaggtgaagattaagtgctggaacggcgtggccacttggctctgggtggccaacgatgagaactgtggcatctgcaggatggcatttaacggatgctgccctgactgcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatcttgctggaggcctctgggtgcctgtgttctcggcatatagatgtggtctcggtgtgttttgatatgaaaactctcatgaataaacatctccgtgaaacgccaaggccctcgtcaaaccctgagtcatgactgggaggagaaggagcaggatcagacggtagagcctggggcatgctcttcaggcatgctcttgcctgctggattgccggcggcggccctgggaccctccctcaggctggctctgagggaccctggctgtgcaaagctggcggccactgctt

SEQ ID NO: 107084 - DNA, 881 bp, Homo sapiens
  Payload ID: 1024
  Gene Symbol: ANAPC11
  Gene Name: anaphase promoting complex subunit 11
  Uniprot ID: Q9NYG5
  ENST ID: ENST00000357385
  CDS Start-End: 137-727
gagactcggcgggcgctgttgagggagtcgggccgcgactgtggtcgtttttataccttcccgcgcggacgccggcgctgccaacggaagggcgggtagggcggtgcgtgattaggttggcgaaggctctgctgccatgaaggtgaagattaagtgctggaacggcgtggccacttggctctgggtggccaacgatgagaactgtggcatctgcaggatggcatttaacggatgctgccctgactgtcctctccatggagaaagcatttctaggtgtttgggctggtgcccgcagcctgtgcctgtcctgggaggcagggcccatccacaggtgcccatcaacacagcttccccaacgcctgggcagcacaccggatccctgatgtctagggaagagtcttctaggtccccagaccccacccctcctgcccttgatcaagagaccagttcactactcagatgcacgtctccttggtgccttgaccattcatgtgacctttttggcatcacagatcaagtgtctgcagatgggcccagggcctgtaggcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatctt

SEQ ID NO: 107085 - DNA, 687 bp, Homo sapiens
  Payload ID: 1024
  Gene Symbol: ANAPC11
  Gene Name: anaphase promoting complex subunit 11
  Uniprot ID: Q9NYG5
  ENST ID: ENST00000392376
  CDS Start-End: 244-498
gcccgatcggccagggctgggggcgctgggggcgctacgggcgcggcgggtgcctgggagctgctgggagtccttgtttccgctcccgcccaggactgtgcgctcggctcgcggtggggtccggcgggcgcggcttcggcgggcggcagccgctgcagacgagctgcggagacggagtttcgtcatgttggccaggcccatttgagatctttgaagatatcctcaacgtgaggctctgctgccatgaaggtgaagattaagtgctggaacggcgtggccacttggctctgggtggccaacgatgagaactgtggcatctgcaggatggcatttaacggatgctgccctgactgcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatctt

SEQ ID NO: 107086 - DNA, 581 bp, Homo sapiens
  Payload ID: 1024
  Gene Symbol: ANAPC11
  Gene Name: anaphase promoting complex subunit 11
  Uniprot ID: Q9NYG5
  ENST ID: ENST00000571570
  CDS Start-End: 137-391
cgtgctgccacttgtcgggaagttgttttggctgaaaaaaaaaccgcaacaagagcagatctagacggagtttcgtcatgttggccaggcccatttgagatctttgaagatatcctcaacgtgaggctctgctgccatgaaggtgaagattaagtgctggaacggcgtggccacttggctctgggtggccaacgatgagaactgtggcatctgcaggatggcatttaacggatgctgccctgactgcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatcttg

SEQ ID NO: 107087 - DNA, 686 bp, Homo sapiens
  Payload ID: 1024
  Gene Symbol: ANAPC11
  Gene Name: anaphase promoting complex subunit 11
  Uniprot ID: Q9NYG5
  ENST ID: ENST00000572851
  CDS Start-End: 141-395
gtgcgagactcggcgggcgctgttgagggagtcgggccgcgactgtggtcgtttttataccttcccgcgcggacgccggcgctgccaacggaagggcgggtagggcggtgcgtgattaggttggcgaaggctctgctgccatgaaggtgaagattaagtgctggaacggcgtggccacttggctctgggtggccaacgatgagaactgtggcatctgcaggatggcatttaacggatgctgccctgactgcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatcttgctggaggcctctgggtgcctgtgttctcggcatatagatgtggtctcggtgtgttttgatatgaaaactctcatgaataaacatctccgtgaaacgccaag

SEQ ID NO: 107088 - DNA, 1361 bp, Homo sapiens
  Payload ID: 1024
  Gene Symbol: ANAPC11
  Gene Name: anaphase promoting complex subunit 11
  Uniprot ID: Q9NYG5
  ENST ID: ENST00000575195
  CDS Start-End: 181-435
cacgatgtttcccaggctgggttcggactcctgggccggtatgatcttcctgccttggccccctgagtagctgggactgcactgtggcaggcttatacctgtgttggtgcctaaacgttctagctctgcagactcaatttagccagtcgtcctgttccctccgccgcaggctctgctgccatgaaggtgaagattaagtgctggaacggcgtggccacttggctctgggtggccaacgatgagaactgtggcatctgcaggatggcatttaacggatgctgccctgactgcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatcttgctggaggcctctgggtgcctgtgttctcggcatatagatgtggtctcggtgtgttttgatatgaaaactctcatgaataaacatctccgtgaaacgccaaggccctcgtcaaaccctgagtcatgactgggaggagaaggagcaggatcagacggtagagcctggggcatgctcttcaggcatgctcttgcctgctggattgccggcggcggccctgggaccctccctcaggctggctctgagggaccctggctgtgcaaagctggcggccactgcttgtggcgcctccagactgaaggccaccatctctgagtgggcgtccattgttctcactgggactgtctgcagcggggctgggcctcccacagtgtagggatcagtgtcctgacactgggaagtgtgtccacacgtctgaggcttcccttcctagggaaaggtggccctgggaggctcctttgtgtgcctctgctccccacaatcgtggtgggaaggggccgctgggggagtggcagccccggcatctcaggctgcttctggacagagcacaggctgtgtctccagtaacctagggagcccttggcattcatggggccagtgacccgtgcccagtgtctcttgacccttcctcacagcaacctgaggagtagaccaggcctcacctgaaatctgtgtcagggttctctagagagacaggactctatatgaagagtatatatgaagagtttattgggagtat

SEQ ID NO: 107089 - DNA, 636 bp, Homo sapiens
  Payload ID: 1024
  Gene Symbol: ANAPC11
  Gene Name: anaphase promoting complex subunit 11
  Uniprot ID: Q9NYG5
  ENST ID: ENST00000571874
  CDS Start-End: 193-447
ggcgggcgctgttgagggagtcgggccgcgactgtggtcgtttttataccttcccgcgcggacgccggcgctgccaacggaagggcgggtagggcggtgcgtgattaggttggcgaagagacggagtttcgtcatgttggccaggcccatttgagatctttgaagatatcctcaacgtgaggctctgctgccatgaaggtgaagattaagtgctggaacggcgtggccacttggctctgggtggccaacgatgagaactgtggcatctgcaggatggcatttaacggatgctgccctgactgcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatctt

SEQ ID NO: 107090 - DNA, 722 bp, Homo sapiens
  Payload ID: 1024
  Gene Symbol: ANAPC11
  Gene Name: anaphase promoting complex subunit 11
  Uniprot ID: Q9NYG5
  ENST ID: ENST00000574924
  CDS Start-End: 177-431
ggcgtgcgagactcggcgggcgctgttgagggagtcgggccgcgactgtggtcgtttttataccttcccgcgcggacgccggcgctgccaacggaagggcggagacggagtttcgtcatgttggccaggcccatttgagatctttgaagatatcctcaacgtgaggctctgctgccatgaaggtgaagattaagtgctggaacggcgtggccacttggctctgggtggccaacgatgagaactgtggcatctgcaggatggcatttaacggatgctgccctgactgcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatcttgctggaggcctctgggtgcctgtgttctcggcatatagatgtggtctcggtgtgttttgatatgaaaactctcatgaataaacatctccgtgaaacgccaag

SEQ ID NO: 107091 - DNA, 578 bp, Homo sapiens
  Payload ID: 1024
  Gene Symbol: ANAPC11
  Gene Name: anaphase promoting complex subunit 11
  Uniprot ID: Q9NYG5
  ENST ID: ENST00000572639
  CDS Start-End: 134-388
cacggcctcggagcggctgctgattggccgctggcggacggctgcgcgcgcgggacgggagacggagtttcgtcatgttggccaggcccatttgagatctttgaagatatcctcaacgtgaggctctgctgccatgaaggtgaagattaagtgctggaacggcgtggccacttggctctgggtggccaacgatgagaactgtggcatctgcaggatggcatttaacggatgctgccctgactgcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatcttg

SEQ ID NO: 107092 - DNA, 668 bp, Homo sapiens
  Payload ID: 1024
  Gene Symbol: ANAPC11
  Gene Name: anaphase promoting complex subunit 11
  Uniprot ID: Q9NYG5
  ENST ID: ENST00000571024
  CDS Start-End: 123-377
gtgcgcactggcgtgcgagactcggcgggcgctgttgagggagtcgggccgcgactgtggtcgtttttataccttcccgcgcggacgccggcgctgccaacggaagggcgggctctgctgccatgaaggtgaagattaagtgctggaacggcgtggccacttggctctgggtggccaacgatgagaactgtggcatctgcaggatggcatttaacggatgctgccctgactgcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatcttgctggaggcctctgggtgcctgtgttctcggcatatagatgtggtctcggtgtgttttgatatgaaaactctcatgaataaacatctccgtgaaacgccaag

SEQ ID NO: 107093 - DNA, 559 bp, Homo sapiens
  Payload ID: 1024
  Gene Symbol: ANAPC11
  Gene Name: anaphase promoting complex subunit 11
  ENST ID: ENST00000584314
  CDS Start-End: 198-332
gactcggcgggcgctgttgagggagtcgggccgcgactgtggtcgtttttataccttcccgcgcggacgccggcgctgccaacggaagggcgggtagggcggtgcgtgattaggttggcgaagagacggagtttcgtcatgttggccaggcccatttgagatctttgaagatatcctcaacgtgaggctctgctgccatgaaggtgaagattaagtgctggaacggcgtggccacttggctctgggtggccaacgatgagaactgtggcatctgcaggatggcatttaacggatgctgccctgactgtgagtgtcccctccatgctgtctgagcggccccgactgtgagtgtcccctctgtgctgtctgctgcctgctggactagcctcagtagctcctgttaaatacctgcacgaaatacccagtttcattttctttttttttttttttttttgagaccgagtttcgatcttgtttcccaggctggagtgcaatggcgcgatctcggcttgccgcaacctctgcctcccgggttcaaacggttctcctgcctcagcct

SEQ ID NO: 107094 - DNA, 345 bp, Homo sapiens
  Payload ID: 1024
  Gene Symbol: ANAPC11
  Gene Name: anaphase promoting complex subunit 11
  ENST ID: ENST00000585259
  CDS Start-End: 13-345
ggctctgctgccatgaaggtgaagattaagtgctggaacggcgtggccacttggctctgggtggccaacgatgagaactgtggcatctgcaggatggcatttaacggatgctgccctgactgctggagtgcaatggcgcgatctcggcttgccgcaacctctgcctcccgggttcaaacggttctcctgcctcagccttccaagcagctgggattacaggcatgtgcccggcgacgactgcccgctggtgtggggccagtgctcccactgcttccacatgcattgcatcctcaagtggctgcacgcacagcaggtgcagcagcactgccccatgtgccgccagga

SEQ ID NO: 107095 - DNA, 603 bp, Homo sapiens
  Payload ID: 1024
  Gene Symbol: ANAPC11
  Gene Name: anaphase promoting complex subunit 11
  ENST ID: ENST00000577425
  CDS Start-End: 123-257
gtgcgcactggcgtgcgagactcggcgggcgctgttgagggagtcgggccgcgactgtggtcgtttttataccttcccgcgcggacgccggcgctgccaacggaagggcgggctctgctgccatgaaggtgaagattaagtgctggaacggcgtggccacttggctctgggtggccaacgatgagaactgtggcatctgcaggatggcatttaacggatgctgccctgactgtgagtgtcccctccatgctgtctgagcggccccgactgcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatct

SEQ ID NO: 107096 - DNA, 403 bp, Homo sapiens
  Payload ID: 1024
  Gene Symbol: ANAPC11
  Gene Name: anaphase promoting complex subunit 11
  ENST ID: ENST00000578544
  CDS Start-End: 72-206
cggagtttcgtcatgttggccaggcccatttgagatctttgaagatatcctcaacgtgaggctctgctgccatgaaggtgaagattaagtgctggaacggcgtggccacttggctctgggtggccaacgatgagaactgtggcatctgcaggatggcatttaacggatgctgccctgactgtgagtgtcccctccatgctgtctgagcggccccgactgcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagact

SEQ ID NO: 107097 - DNA, 672 bp, Homo sapiens
  Payload ID: 1024
  Gene Symbol: ANAPC11
  Gene Name: anaphase promoting complex subunit 11
  Uniprot ID: Q9NYG5
  ENST ID: ENST00000577747
  CDS Start-End: 229-483
agggagtcgggccgcgactgtggtcgtttttataccttcccgcgcggacgccggcgctgccaacggaagggtccaagtgattcctgtggctcagcttcccgaatagagctgggagctggcgtgatctcagctcgctgcaacctccgcctcccagagacggagtttcgtcatgttggccaggcccatttgagatctttgaagatatcctcaacgtgaggctctgctgccatgaaggtgaagattaagtgctggaacggcgtggccacttggctctgggtggccaacgatgagaactgtggcatctgcaggatggcatttaacggatgctgccctgactgcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatctt

SEQ ID NO: 107098 - DNA, 499 bp, Homo sapiens
  Payload ID: 1024
  Gene Symbol: ANAPC11
  Gene Name: anaphase promoting complex subunit 11
  Uniprot ID: Q9NYG5
  ENST ID: ENST00000583839
  CDS Start-End: 56-310
gggcgcggcttcggcgggcggcagccgctgcagacgagctgcgggctctgctgccatgaaggtgaagattaagtgctggaacggcgtggccacttggctctgggtggccaacgatgagaactgtggcatctgcaggatggcatttaacggatgctgccctgactgcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatctt

SEQ ID NO: 107099 - DNA, 575 bp, Homo sapiens
  Payload ID: 1024
  Gene Symbol: ANAPC11
  Gene Name: anaphase promoting complex subunit 11
  Uniprot ID: Q9NYG5
  ENST ID: ENST00000579978
  CDS Start-End: 134-388
cgcgtgcgcactggcgtgcgagactcggcgggcgctgttgagggagtcgggccgcgactgtggtcgtttttataccttcccgcgcggacgccggcgctgccaacggaagggcgggtagggcggctctgctgccatgaaggtgaagattaagtgctggaacggcgtggccacttggctctgggtggccaacgatgagaactgtggcatctgcaggatggcatttaacggatgctgccctgactgcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatc

SEQ ID NO: 107100 - DNA, 563 bp, Homo sapiens
  Payload ID: 1024
  Gene Symbol: ANAPC11
  Gene Name: anaphase promoting complex subunit 11
  ENST ID: ENST00000579133
  CDS Start-End: 82-216
cgcgactgtggtcgtttttataccttcccgcgcggacgccggcgctgccaacggaagggcgggtagggcggctctgctgccatgaaggtgaagattaagtgctggaacggcgtggccacttggctctgggtggccaacgatgagaactgtggcatctgcaggatggcatttaacggatgctgccctgactgtgagtgtcccctccatgctgtctgagcggccccgactgcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatctt

SEQ ID NO: 107101 - DNA, 523 bp, Homo sapiens
  Payload ID: 1024
  Gene Symbol: ANAPC11
  Gene Name: anaphase promoting complex subunit 11
  ENST ID: ENST00000582222
  CDS Start-End: 194-328
gtgcgcactggcgtgcgagactcggcgggcgctgttgagggagtcgggccgcgactgtggtcgtttttataccttcccgcgcggacgccggcgctgccaacggaagggcgggtagggcgagacggagtttcgtcatgttggccaggcccatttgagatctttgaagatatcctcaacgtgaggctctgctgccatgaaggtgaagattaagtgctggaacggcgtggccacttggctctgggtggccaacgatgagaactgtggcatctgcaggatggcatttaacggatgctgccctgactgtgagtgtcccctccatgctgtctgagcggccccgactgtgagtgtcccctctgtgctgtctgctgcctgctggactagcctcagtagctcctgttaaatacctgcacgaaatacccagtttcattttctttttttttttttttttttgagaccgagtttcgatcttgtttcccaggctggagtgcaatggcgcgatctcggcttgccgcaacctctgcct

SEQ ID NO: 107102 - DNA, 386 bp, Homo sapiens
  Payload ID: 1024
  Gene Symbol: ANAPC11
  Gene Name: anaphase promoting complex subunit 11
  ENST ID: ENST00000584197
  CDS Start-End: 171-386
ttgtttccgctcccgcccaggactgtgcgctcggctcgcggtggggtccggcgggcgcggcttcggcgggcggcagccgctgcagacgagctgcggagacggagtttcgtcatgttggccaggcccatttgagatctttgaagatatcctcaacgtgaggctctgctgccatgaaggtgaagattaagtgctggaacggcgtggccacttggctctgggtggccaacgatgagaactgtggcatctgcaggatggcatttaacggatgctgccctgactgtcctctccatggagaaagcatttctaggtgtttgggctggtgcccgcagcctgtgcctgtcctgggaggcagggcccatccacaggcaaggtgcccggcgacgact

SEQ ID NO: 107103 - DNA, 599 bp, Homo sapiens
  Payload ID: 1024
  Gene Symbol: ANAPC11
  Gene Name: anaphase promoting complex subunit 11
  Uniprot ID: Q9NYG5
  ENST ID: ENST00000578550
  CDS Start-End: 251-505
ggcgctgttgagggagtcgggccgcgactgtggtcgtttttataccttcccgcgcggacgccggcgctgccaacggaagggcgggtagggcggtccaagtgattcctgtggctcagcttcccgaatagagctgggagctggcgtgatctcagctcgctgcaacctccgcctcccagagacggagtttcgtcatgttggccaggcccatttgagatctttgaagatatcctcaacgtgaggctctgctgccatgaaggtgaagattaagtgctggaacggcgtggccacttggctctgggtggccaacgatgagaactgtggcatctgcaggatggcatttaacggatgctgccctgactgcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaaca

SEQ ID NO: 107104 - DNA, 964 bp, Homo sapiens
  Payload ID: 1024
  Gene Symbol: ANAPC11
  Gene Name: anaphase promoting complex subunit 11
  ENST ID: ENST00000612413
  CDS Start-End: 262-531
ggggaggcgcgtgcgcactggcgtgcgagactcggcgggcgctgttgagggagtcgggccgcgactgtggtcgtttttataccttcccgcgcggacgccggcgctgccaacggaagggcgggtagggcgagacggagtttcgtcatgttggccaggcccatttgagatctttgaagatatcctcaacgtgaggctctgctgccatgaaggtgaagattaagtgctggaacggcgtggccacttggctctgggtggccaacgatgagaactgtggcatctgcaggatggcatttaacggatgctgccctgactgtgagtgtcccctccatgctgtctgagcggccccgactgcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatcttgctggaggcctctgggtgcctgtgttctcggcatatagatgtggtctcggtgtgttttgatatgaaaactctcatgaataaacatctccgtgaaacgccaaggccctcgtcaaaccctgagtcatgactgggaggagaaggagcaggatcagacggtagagcctggggcatgctcttcaggcatgctcttgcctgctggattgccggcggcggccctgggaccctccctcaggctggctctgagggaccctggctgtgcaaagctggcggccactgctt

SEQ ID NO: 107105 - DNA, 1209 bp, Homo sapiens
  Payload ID: 1025
  Gene Symbol: ANAPC13
  Gene Name: anaphase promoting complex subunit 13
  Uniprot ID: Q9BS18
  ENST ID: ENST00000354910
  CDS Start-End: 103-327
agtgcagacacgtgatgcgggggagggggggggggcgtggcaggagcaagcgtctgccgcggtggccgggtgccgatttgacaagatcaaagctgcaggaaaatggacagtgaggttcagagagatggaaggatcttggatttgattgatgatgcttggcgagaagacaagctgccttatgaggatgtcgcaataccactgaatgagcttcctgaacctgaacaagacaatggtggcaccacagaatctgtcaaagaacaagaaatgaagtggacagacttagccttacagtacctccatgagaatgttccccccattggaaactgacgcttggctcctttcttgtggatggattttctcaaagtacacagataaagcatggtttgtttcagtctccaaattcaaacctttgagtaataaatcagcactcaaaaatgtacacccatttagtttgtggtagcaaagtgcaatgcgaaattgaatgagaaactgagatttctcagtaatggtgaatatttcgctctttaaacctaaaactcttcattgagtagcttatatttgaacatgattggttaaacatttgcctctacctctgattttgctttgctgtcaaagtttaacaccttccaactacttatgtgtgtcctgtaacacaggtgattgaacgtatgagagggaaaggcaaagaaaaaggaagccagacactaggagaattattaacttctcatacttccccacattgagaagcattcggagtgtatttagcctgtagatgttgtgatatgcaaatatcccattccctggttactggcattcctaagattcttcatggtattttcaaactttggataaatttacagattagaaagatatctgacagttaatctctgttctccttacaaattccttttgtgctgctggaaaggatctttggctaggtggatgactagttttattcaaagccttttctcaaagccctttcagttacaaccaccccactatggaatcagtatttagttatacatttgtataagaacctgtattttgaaaaacacattcatgtatatttattcctggaattatttgcctgttaaacagtgtctttcatgttctctccccagattgtaaactctgtaagaagctgcttgtatctgtatcccttgttgaaactctgaaaacactgaataactaaaatctcttctcatcctt

SEQ ID NO: 107106 - DNA, 896 bp, Homo sapiens
  Payload ID: 1025
  Gene Symbol: ANAPC13
  Gene Name: anaphase promoting complex subunit 13
  Uniprot ID: Q9BS18
  ENST ID: ENST00000511751
  CDS Start-End: 158-382
acactaaatgagcgggtccccttgtgccgtgaatgaagtagtcccaacagcgctagctagacagcagccctggcagggaggccgcactggggtctctccgctgaaaaggaaggtgggtccgccggggaagatttgacaagatcaaagctgcaggaaaatggacagtgaggttcagagagatggaaggatcttggatttgattgatgatgcttggcgagaagacaagctgccttatgaggatgtcgcaataccactgaatgagcttcctgaacctgaacaagacaatggtggcaccacagaatctgtcaaagaacaagaaatgaagtggacagacttagccttacagtacctccatgagaatgttccccccattggaaactgacgcttggctcctttcttgtggatggattttctcaaagtacacagataaagcatggtttgtttcagtctccaaattcaaacctttgagtaataaatcagcactcaaaaatgtacacccatttagtttgtggtagcaaagtgcaatgcgaaattgaatgagaaactgagatttctcagtaatggtgaatatttcgctctttaaacctaaaactcttcattgagtagcttatatttgaacatgattggttaaacatttgcctctacctctgattttgctttgctgtcaaagtttaacaccttccaactacttatgtgtgtcctgtaacacaggtgattgaacgtatgagagggaaaggcaaagaaaaaggaagccagacactaggagaattattaacttctcatacttccccacattgagaagcattcggagtgtatttagcctgtagatgttgtgatatgcaaatatcccattccctggttactggcattcctaagattcttcatggtattttcaa

SEQ ID NO: 107107 - DNA, 1840 bp, Homo sapiens
  Payload ID: 1025
  Gene Symbol: ANAPC13
  Gene Name: anaphase promoting complex subunit 13
  Uniprot ID: Q9BS18
  ENST ID: ENST00000510994
  CDS Start-End: 732-956
gcagacacgtgatgcgggggagggggggggggcgtggcaggagcaagcgtctgccgcggtggccgggtgccggtaagggtttccagcgcccccggcctaggttttggaggcgcgggaatgcgttcgttgctcagtgtcggacttccccctattcccatcggccgaggctgtcactttacgctcataaccgtttttctttactgcactcgtgtcgggaggaaagggacttgcgtggcacccccagacctccccgtctccgcttccacgtttggtacatcctgcctgaggcaggaagccgcagctgagggacggcctgtcgtacggtgcggatggtggtggcctgcgaggctcatttctagcaaggaacaaggctttcccgctttgattttataaatattatgtttacaaagctgtaatatatagaaattgataagacgtgtccctgtccctggaaacgcaggcaccgcgtgtttggaaagacattcatctgggctgtttgacagactccccagttggtgccatgctctgtgcttagggaactgtgagacccctggaggggtgggtaccgggaccgcactcagcctggggtttggaggcggcctcctataggaagcgacctgggacctaagatttttagactgactgtgggttcactggaataaaaaggaagaaacaaagagcattgcaggcatcgggactgtcacatttgacaagatcaaagctgcaggaaaatggacagtgaggttcagagagatggaaggatcttggatttgattgatgatgcttggcgagaagacaagctgccttatgaggatgtcgcaataccactgaatgagcttcctgaacctgaacaagacaatggtggcaccacagaatctgtcaaagaacaagaaatgaagtggacagacttagccttacagtacctccatgagaatgttccccccattggaaactgacgcttggctcctttcttgtggatggattttctcaaagtacacagataaagcatggtttgtttcagtctccaaattcaaacctttgagtaataaatcagcactcaaaaatgtacacccatttagtttgtggtagcaaagtgcaatgcgaaattgaatgagaaactgagatttctcagtaatggtgaatatttcgctctttaaacctaaaactcttcattgagtagcttatatttgaacatgattggttaaacatttgcctctacctctgattttgctttgctgtcaaagtttaacaccttccaactacttatgtgtgtcctgtaacacaggtgattgaacgtatgagagggaaaggcaaagaaaaaggaagccagacactaggagaattattaacttctcatacttccccacattgagaagcattcggagtgtatttagcctgtagatgttgtgatatgcaaatatcccattccctggttactggcattcctaagattcttcatggtattttcaaactttggataaatttacagattagaaagatatctgacagttaatctctgttctccttacaaattccttttgtgctgctggaaaggatctttggctaggtggatgactagttttattcaaagccttttctcaaagccctttcagttacaaccaccccactatggaatcagtatttagttatacatttgtataagaacctgtattttgaaaaacacattcatgtatatttattcctggaattatttgcctgttaaacagtgtctttcatgttctctccccagattgtaaactctgtaagaagctgcttgtatctgtatcccttgttgaaactctgaaaacactgaataactaaaatctcttctcatcctttt

SEQ ID NO: 107108 - DNA, 1420 bp, Homo sapiens
  Payload ID: 1025
  Gene Symbol: ANAPC13
  Gene Name: anaphase promoting complex subunit 13
  Uniprot ID: Q9BS18
  ENST ID: ENST00000514612
  CDS Start-End: 317-541
tggcaggagcaagcgtctgccgcggtggccgggtgccggtaagggtttccagcgcccccggcctaggttttggaggcgcgggaatgcgttcgttgctcagtgtcggacttccccctattcccatcggccgaggctgtcactttacgctcataaccgtttttctttactgcactcgtgtcgggaggaaagggacttgcgtggcacccccagacctccccgtctccgcttccacgtttggtacatcctgcctgaggcaggaagccgcagctgagggacggcctgtcgtacgatttgacaagatcaaagctgcaggaaaatggacagtgaggttcagagagatggaaggatcttggatttgattgatgatgcttggcgagaagacaagctgccttatgaggatgtcgcaataccactgaatgagcttcctgaacctgaacaagacaatggtggcaccacagaatctgtcaaagaacaagaaatgaagtggacagacttagccttacagtacctccatgagaatgttccccccattggaaactgacgcttggctcctttcttgtggatggattttctcaaagtacacagataaagcatggtttgtttcagtctccaaattcaaacctttgagtaataaatcagcactcaaaaatgtacacccatttagtttgtggtagcaaagtgcaatgcgaaattgaatgagaaactgagatttctcagtaatggtgaatatttcgctctttaaacctaaaactcttcattgagtagcttatatttgaacatgattggttaaacatttgcctctacctctgattttgctttgctgtcaaagtttaacaccttccaactacttatgtgtgtcctgtaacacaggtgattgaacgtatgagagggaaaggcaaagaaaaaggaagccagacactaggagaattattaacttctcatacttccccacattgagaagcattcggagtgtatttagcctgtagatgttgtgatatgcaaatatcccattccctggttactggcattcctaagattcttcatggtattttcaaactttggataaatttacagattagaaagatatctgacagttaatctctgttctccttacaaattccttttgtgctgctggaaaggatctttggctaggtggatgactagttttattcaaagccttttctcaaagccctttcagttacaaccaccccactatggaatcagtatttagttatacatttgtataagaacctgtattttgaaaaacacattcatgtatatttattcctggaattatttgcctgttaaacagtgtctttcatgttctctccccagattgtaaactctgtaagaagctgcttgtatctgtatcccttgttgaaactctgaaaacactgaataactaaaatctcttctcatc

SEQ ID NO: 107109 - DNA, 886 bp, Homo sapiens
  Payload ID: 1026
  Gene Symbol: ANAPC15
  Gene Name: anaphase promoting complex subunit 15
  Uniprot ID: P60006
  ENST ID: ENST00000227618
  CDS Start-End: 227-592
gggcgggagcggggaaaacaaaaggagacgaaggacgcatgcgtttggtgagtcccggattctggtgggttcttccgctcaggctgggtgaagcgcttccgggtcgccgccggcagcagcctcccggcgcgatgaagacactgaggctcagagaggttaagtgactcagccaaggtcaaacagctagtaagtggtggagccaggactcaaagccagtctaggagccatgtccactttgttcccctcactcttccctcgtgtgactgagactctgtggtttaatctggatcgaccctgtgtggaagagacagagctgcagcagcaggaacagcagcatcaggcctggctccaaagcatcgcggagaaagacaacaacctggttcctattggcaagccagcctcagagcactatgatgacgaggaagaagaggatgatgaagatgatgaggatagtgaagaggactcagaggatgatgaggatatgcaggacatggacgagatgaatgactacaatgagtcaccggatgatggagaggtcaatgaggtggacatggaaggcaacgaacaggatcaggaccagtggatgatctaggtagacaaggcagggtggcctcagggagattccaggccagcccaaactaccctgcatcccaacccccaacccctgcccacagaaccagctgatggccccagtgcctgaaagtgcccttgggcacctcctcagctgctgccaggatctggtctctttggcccctcccaggccatcagtctgcacttgaaatccccagggcctgaaacctactccaccttcctggccagtacctcaccccttgattgccaggtctggtctaagtttctttaataaagacaaaggagtgattttcca

SEQ ID NO: 107110 - DNA, 330 bp, Homo sapiens
  Payload ID: 1026
  Gene Symbol: ANAPC15
  Gene Name: anaphase promoting complex subunit 15
  ENST ID: ENST00000438939
  CDS Start-End: 53-330
ggctcagagaggttaagtgactcagccaaggtcaaacagctatctaggagccatgtccactttgttcccctcactcttccctcgtgtgactgagactctgtggtttaatctggatcgaccctgtgtggaagagacagagctgcagcagcaggaacagcagcatcaggcctggctccaaagcatcgcggagaaagacaacaacctggttcctattggcaagccagcctcagaggcctgtagggcttacaggctctgtcctgcccaccagcactatgatgacgaggaagaagaggatgatgaagatgatgaggatagtgaagaggactcaga

SEQ ID NO: 107111 - DNA, 807 bp, Homo sapiens
  Payload ID: 1026
  Gene Symbol: ANAPC15
  Gene Name: anaphase promoting complex subunit 15
  ENST ID: ENST00000543050
  CDS Start-End: 43-615
tagtaagtggtggagccaggactcaaagccagtctaggagccatgtccactttgttcccctcactcttccctcgtgtgactgagactctgtggtttaatctggatcgaccctgtgtggaagagacagagctgcagcagcaggaacagcagcatcaggcctggctccaaagcatcgcggagaaagacaacaacctggttcctattggcaagccagcctcagagcactatgatgacgaggaagaagaggatgatgaagatgatgaggatagtgaagaggactcagaggatgatgaggatatgcaggacatggacgagatgaatgactacaatgagtcaccggatgatggagaggtcaatgaggttcatctctcagtacttcccacctgtggcctgtatcacagccatcccaaacaactgtgcccagaatccatcaagctgtctcattccttcatgccacatgtgtatatgtggctggctttgcccttcccacccccatcgccatctgcctggccaactcagaacttccagattcagttcaaatgttgctctttctccatgaagtcccaggcagaaacaaccaccctatctttcagatttatgaaaggtctctgttagaatttgtagtttcattccccttttattgctcatcaaatgtatttctgatcttggaattggatgaacttttatttatttatttttgagaccaagtcttgctgtgttgcccaggctggagtgcagtagcatgatcacggctcactgcagccttgaccacccaggctcaggcaatcctcccacctcagcatttcc

SEQ ID NO: 107112 - DNA, 606 bp, Homo sapiens
  Payload ID: 1026
  Gene Symbol: ANAPC15
  Gene Name: anaphase promoting complex subunit 15
  ENST ID: ENST00000537644
  CDS Start-End: 236-606
ttctaagccccgacacactgtatgacctaaagccagtctctgcctgtcgctgggcctcagttcgcctgtcctaagtttaattcagattatctggcactcctggtcggctccctcagccgctcaaagctgattgtacccttataatatgaagacactgaggctcagagaggttaagtgactcagccaaggtcaaacagctagtaagtggtggagccaggactcaaagccaggagccatgtccactttgttcccctcactcttccctcgtgtgactgagactctgtggtttaatctggatcgaccctgtgtggaagagacagagctgcagcagcaggaacagcagcatcaggcctggctccaaagcatcgcggagaaagacaacaacctggttcctattggcaagccagcctcagaggcctgtagggcttacaggctctgtcctgcccaccagcactatgatgacgaggaagaagaggatgatgaagatgatgaggatagtgaagaggactcagaggatgatgaggatatgcaggacatggacgagatgaatgactacaatgagtcaccggatgatggagaggtcaatgaggtaggcaaggggtatgg

SEQ ID NO: 107113 - DNA, 468 bp, Homo sapiens
  Payload ID: 1026
  Gene Symbol: ANAPC15
  Gene Name: anaphase promoting complex subunit 15
  ENST ID: ENST00000545333
  CDS Start-End: 274-468
acttcctgtcacccagcatttctttcagttaattggtcctacccaggccccgcttttttcgcgtttagcaaccctataaggccaaatttctgtctgagacccgccctgctttctttctgttggtcaactgcatggtcattatcgtaatgagcaaagaaagggcggtggctttgcgacgatgaagacactgaggctcagagaggttaagtgactcagccaaggtcaaacagctagtaagtggtggagccaggactcaaagccagtctaggagccatgtccactttgttcccctcactcttccctcgtgtgactgagactctgtggtttaatctggatcgaccctgtgtggaagagacagagctgcagcagcaggaacagcagcatcaggcctggctccaaagcatcgcggagaaagacaacaacctggttcctattggcaagccagcctcagagcactatgatgacgag

SEQ ID NO: 107114 - DNA, 883 bp, Homo sapiens
  Payload ID: 1026
  Gene Symbol: ANAPC15
  Gene Name: anaphase promoting complex subunit 15
  Uniprot ID: P60006
  ENST ID: ENST00000543587
  CDS Start-End: 208-585
aaaacaaaaggagacgaaggacgcatgcgtttggtgagtcccggattctggtgggttcttccgctcaggctgggtgaagcgcttccgggtcgccgccggcagcagcctcccggcgcgatgaagacactgaggctcagagaggttaagtgactcagccaaggtcaaacagctagtaagtggtggagccaggactcaaagccaggagccatgtccactttgttcccctcactcttccctcgtgtgactgagactctgtggtttaatctggatcgaccctgtgtggaagagacagagctgcagcagcaggaacagcagcatcaggcctggctccaaagcatcgcggagaaagacaacaacctggttcctattggcaagccagcctcagagcactatgatgacgaggaagaagaggatgatgaagatgatgaggatagtgaagaggactcagaggatgatgaggatatgcaggacatggacgagatgaatgactacaatgagtcaccggatgatggagaggtcaatgagcctcctctccaggtggacatggaaggcaacgaacaggatcaggaccagtggatgatctaggtagacaaggcagggtggcctcagggagattccaggccagcccaaactaccctgcatcccaacccccaacccctgcccacagaaccagctgatggccccagtgcctgaaagtgcccttgggcacctcctcagctgctgccaggatctggtctctttggcccctcccaggccatcagtctgcacttgaaatccccagggcctgaaacctactccaccttcctggccagtacctcaccccttgattgccaggtctggtctaagtttctttaataaagacaaaggagtgattttccaccca

SEQ ID NO: 107115 - DNA, 867 bp, Homo sapiens
  Payload ID: 1026
  Gene Symbol: ANAPC15
  Gene Name: anaphase promoting complex subunit 15
  Uniprot ID: P60006
  ENST ID: ENST00000538393
  CDS Start-End: 211-576
gggaaaacaaaaggagacgaaggacgcatgcgtttggtgagtcccggattctggtgggttcttccgctcaggctgggtgaagcgcttccgggtcgccgccggcagcagcctcccggcgcgatgaagacactgaggctcagagaggttaagtgactcagccaaggtcaaacagctagtaagtggtggagccaggactcaaagccaggagccatgtccactttgttcccctcactcttccctcgtgtgactgagactctgtggtttaatctggatcgaccctgtgtggaagagacagagctgcagcagcaggaacagcagcatcaggcctggctccaaagcatcgcggagaaagacaacaacctggttcctattggcaagccagcctcagagcactatgatgacgaggaagaagaggatgatgaagatgatgaggatagtgaagaggactcagaggatgatgaggatatgcaggacatggacgagatgaatgactacaatgagtcaccggatgatggagaggtcaatgaggtggacatggaaggcaacgaacaggatcaggaccagtggatgatctaggtagacaaggcagggtggcctcagggagattccaggccagcccaaactaccctgcatcccaacccccaacccctgcccacagaaccagctgatggccccagtgcctgaaagtgcccttgggcacctcctcagctgctgccaggatctggtctctttggcccctcccaggccatcagtctgcacttgaaatccccagggcctgaaacctactccaccttcctggccagtacctcaccccttgattgccaggtctggtctaagtttctttaataaagacaaaggagtgatttt

SEQ ID NO: 107116 - DNA, 563 bp, Homo sapiens
  Payload ID: 1026
  Gene Symbol: ANAPC15
  Gene Name: anaphase promoting complex subunit 15
  ENST ID: ENST00000539395
  CDS Start-End: 430-563
tttcggagccgagatcgctggtctgtcagtacttcttggacatgagggtgtttaccgtcgtgcctaattacgcgggttgggaatctgagatacagggaagggcagcggctggccctgggtcggtcagataaattaagacaaaagcaggaccaggcatcgattattttctcctgctcatccctttcacggaggaattctaagccccgacacactgtatgacctaaagccagtctctgcctgtcgctgggcctcagttcgcctgtcctaagtttaattcagattatctggcactcctggtcggctccctcagccgctcaaagctgattgtacccttataatatgaagacactgaggctcagagaggttaagtgactcagccaaggtcaaacagctagtaagtggtggagccaggactcaaagccaggagccatgtccactttgttcccctcactcttccctcgtgtgactgagactctgtggtttaatctggatcgaccctgtgtggaagagacagagctgcagcagcaggaacagcagcatcaggcctggctccaaagcatcgc

SEQ ID NO: 107117 - DNA, 849 bp, Homo sapiens
  Payload ID: 1026
  Gene Symbol: ANAPC15
  Gene Name: anaphase promoting complex subunit 15
  Uniprot ID: P60006
  ENST ID: ENST00000538919
  CDS Start-End: 405-770
acttcttggacatgagggtgtttaccgtcgtgcctaattacgcgggttgggaatctgagatacagggaagggcagcggctggccctgggtcggtcagataaattaagacaaaagcaggaccaggcatcgattattttctcctgctcatccctttcacggaggaattctaagccccgacacactgtatgacctaaagccagtctctgcctgtcgctgggcctcagttcgcctgtcctaagtttaattcagattatctggcactcctggtcggctccctcagccgctcaaagctgattgtacccttataatatgaagacactgaggctcagagaggttaagtgactcagccaaggtcaaacagctagtaagtggtggagccaggactcaaagccagtctaggagccatgtccactttgttcccctcactcttccctcgtgtgactgagactctgtggtttaatctggatcgaccctgtgtggaagagacagagctgcagcagcaggaacagcagcatcaggcctggctccaaagcatcgcggagaaagacaacaacctggttcctattggcaagccagcctcagagcactatgatgacgaggaagaagaggatgatgaagatgatgaggatagtgaagaggactcagaggatgatgaggatatgcaggacatggacgagatgaatgactacaatgagtcaccggatgatggagaggtcaatgaggtggacatggaaggcaacgaacaggatcaggaccagtggatgatctaggtagacaaggcagggtggcctcagggagattccaggccagcccaaactaccctgcatcccaacccccaacccctgccca

SEQ ID NO: 107118 - DNA, 1481 bp, Homo sapiens
  Payload ID: 1026
  Gene Symbol: ANAPC15
  Gene Name: anaphase promoting complex subunit 15
  ENST ID: ENST00000502597
  CDS Start-End: 191-508
gctcaggctgggtgaagcgcttccgggtcgccgccggcagcagcctcccggcgcgctccaaagcatcgcggagaaagacaacaacctggttcctattggcaagccagcctcagagcactatgatgacgaggaagaagaggatgatgaagatgatgaggatagtgaagaggactcagaggatgatgaggatatgcaggacatggacgagatgaatgactacaatgagtcaccggatgatggagaggtcaatgaggttcatctctcagtacttcccacctgtggcctgtatcacagccatcccaaacaactgtgcccagaatccatcaagctgtctcattccttcatgccacatgtgtatatgtggctggctttgcccttcccacccccatcgccatctgcctggccaactcagaacttccagattcagttcaaatgttgctctttctccatgaagtcccaggcagaaacaaccaccctatctttcagatttatgaaaggtctctgttagaatttgtagtttcattccccttttattgctcatcaaatgtatttctgatcttggaattggatgaacttttatttatttatttttgagaccaagtcttgctgtgttgcccaggctggagtgcagtagcatgatcacggctcactgcagccttgaccacccaggctcaggcaatcctcccacctcagcatttccagtagctggaaccacagttactcaccaccacacccggctaatttttaaattttttgtagaaacgggggtcttgctttgttacccaggctagtctcgaactcctgggctcaagtgatcctcctgctttggcctcccaaagtgctgggattacaggcatgagccaccatgcccagccagtgaatttcttttcttttctttttctttttttttttttttttgagacaggttcttgctctgtcacccatgctggagtgcagtggcacaatcacagctcactgcagcctcagcctcctgggctcaagcaatcctcccacctcagcctcccaagtagctgggaccacaggcatgtgccaccatgcctgggtaatttttgtattttttgtagagatgggtttttgccatgttgcccaagccggtctcaaactcctgagctcaagcaatctgcccacctcggcctctcaaagtgctgggattacaggcaccagccaccacacagccgaatttcttaaataagaccctaaaagcacttatgctgggattgagataaatccaggcagacagctaccctaaatggtatgtggaagcctccatggtggagaggaaagatgtggagacagataattacaaagctatgggttatctgctgagatggttattccactgtgtattatggttcctttgaggccagcatttgtggctcattcatctctgtggcctctacccctctccctggcacctagcacattcctaatacaaaagaggtggcaataaatgtttgctg

SEQ ID NO: 107119 - DNA, 734 bp, Homo sapiens
  Payload ID: 1026
  Gene Symbol: ANAPC15
  Gene Name: anaphase promoting complex subunit 15
  Uniprot ID: P60006
  ENST ID: ENST00000535503
  CDS Start-End: 138-503
gggcgggagcggggaaaacaaaaggagacgaaggacgcatgcgtttgatgaagacactgaggctcagagaggttaagtgactcagccaaggtcaaacagctagtaagtggtggagccaggactcaaagccaggagccatgtccactttgttcccctcactcttccctcgtgtgactgagactctgtggtttaatctggatcgaccctgtgtggaagagacagagctgcagcagcaggaacagcagcatcaggcctggctccaaagcatcgcggagaaagacaacaacctggttcctattggcaagccagcctcagagcactatgatgacgaggaagaagaggatgatgaagatgatgaggatagtgaagaggactcagaggatgatgaggatatgcaggacatggacgagatgaatgactacaatgagtcaccggatgatggagaggtcaatgaggtggacatggaaggcaacgaacaggatcaggaccagtggatgatctaggtagacaaggcagggtggcctcagggagattccaggccagcccaaactaccctgcatcccaacccccaacccctgcccacagaaccagctgatggccccagtgcctgaaagtgcccttgggcacctcctcagctgctgccaggatctggtctctttggcccctcccaggccatcagtctgcacttgaaatccccagggcctgaaacctactccaccttcctggccagtacc

SEQ ID NO: 107120 - DNA, 872 bp, Homo sapiens
  Payload ID: 1026
  Gene Symbol: ANAPC15
  Gene Name: anaphase promoting complex subunit 15
  Uniprot ID: P60006
  ENST ID: ENST00000545680
  CDS Start-End: 201-578
gacgaaggacgcatgcgtttggtgagtcccggattctggtgggttcttccgctcaggctgggtgaagcgcttccgggtcgccgccggcagcagcctcccggcgcgatgaagacactgaggctcagagaggttaagtgactcagccaaggtcaaacagctagtaagtggtggagccaggactcaaagccagtctaggagccatgtccactttgttcccctcactcttccctcgtgtgactgagactctgtggtttaatctggatcgaccctgtgtggaagagacagagctgcagcagcaggaacagcagcatcaggcctggctccaaagcatcgcggagaaagacaacaacctggttcctattggcaagccagcctcagagcactatgatgacgaggaagaagaggatgatgaagatgatgaggatagtgaagaggactcagaggatgatgaggatatgcaggacatggacgagatgaatgactacaatgagtcaccggatgatggagaggtcaatgagcctcctctccaggtggacatggaaggcaacgaacaggatcaggaccagtggatgatctaggtagacaaggcagggtggcctcagggagattccaggccagcccaaactaccctgcatcccaacccccaacccctgcccacagaaccagctgatggccccagtgcctgaaagtgcccttgggcacctcctcagctgctgccaggatctggtctctttggcccctcccaggccatcagtctgcacttgaaatccccagggcctgaaacctactccaccttcctggccagtacctcaccccttgattgccaggtctggtctaagtttctttaataaagacaaaggagtgattttcca

SEQ ID NO: 107121 - DNA, 812 bp, Homo sapiens
  Payload ID: 1026
  Gene Symbol: ANAPC15
  Gene Name: anaphase promoting complex subunit 15
  Uniprot ID: P60006
  ENST ID: ENST00000542531
  CDS Start-End: 155-520
gcgacggtgggttgggctttcggagccgagatcgctggtctgtcagtacttcttggacatgaggatgaagacactgaggctcagagaggttaagtgactcagccaaggtcaaacagctagtaagtggtggagccaggactcaaagccaggagccatgtccactttgttcccctcactcttccctcgtgtgactgagactctgtggtttaatctggatcgaccctgtgtggaagagacagagctgcagcagcaggaacagcagcatcaggcctggctccaaagcatcgcggagaaagacaacaacctggttcctattggcaagccagcctcagagcactatgatgacgaggaagaagaggatgatgaagatgatgaggatagtgaagaggactcagaggatgatgaggatatgcaggacatggacgagatgaatgactacaatgagtcaccggatgatggagaggtcaatgaggtggacatggaaggcaacgaacaggatcaggaccagtggatgatctaggtagacaaggcagggtggcctcagggagattccaggccagcccaaactaccctgcatcccaacccccaacccctgcccacagaaccagctgatggccccagtgcctgaaagtgcccttgggcacctcctcagctgctgccaggatctggtctctttggcccctcccaggccatcagtctgcacttgaaatccccagggcctgaaacctactccaccttcctggccagtacctcaccccttgattgccaggtctggtctaagtttctttaataaagacaaaggagtgattttc

SEQ ID NO: 107122 - DNA, 580 bp, Homo sapiens
  Payload ID: 1026
  Gene Symbol: ANAPC15
  Gene Name: anaphase promoting complex subunit 15
  ENST ID: ENST00000538117
  CDS Start-End: 92-424
gatgaagacactgaggctcagagaggttaagtgactcagccaaggtcaaacagctagtaagtggtggagccaggactcaaagccaggagccatgtccactttgttcccctcactcttccctcgtgtgactgagactctgtggtttaatctggatcgaccctgtgtggaagagacagagctgcagcagcaggaacagcagcatcaggcctggctccaaagcatcgcggagaaagacaacaacctggttcctattggcaagccagcctcagagcactatgatgacgaggaagaagaggatgatgaagatgatgaggatagtgaagaggactcagaggatgatgaggatatgcaggacatggacgagatgaatgactacaatgagtcaccggatgatggagaggtcaatgagaatggcatgggctgaggatgggaggctttctgaggccgagaactgggaggcccctggagctctcccatccagcttccttcgtgttaagagagaagattaaatctcagagcaagggaagtctggaaggccagtgtggtggaggcggcagcggtagcggccacagctcttagc

SEQ ID NO: 107123 - DNA, 704 bp, Homo sapiens
  Payload ID: 1026
  Gene Symbol: ANAPC15
  Gene Name: anaphase promoting complex subunit 15
  Uniprot ID: P60006
  ENST ID: ENST00000545944
  CDS Start-End: 48-413
gcttccgggtcgccgccggcagcagcctcccggcgcgtctaggagccatgtccactttgttcccctcactcttccctcgtgtgactgagactctgtggtttaatctggatcgaccctgtgtggaagagacagagctgcagcagcaggaacagcagcatcaggcctggctccaaagcatcgcggagaaagacaacaacctggttcctattggcaagccagcctcagagcactatgatgacgaggaagaagaggatgatgaagatgatgaggatagtgaagaggactcagaggatgatgaggatatgcaggacatggacgagatgaatgactacaatgagtcaccggatgatggagaggtcaatgaggtggacatggaaggcaacgaacaggatcaggaccagtggatgatctaggtagacaaggcagggtggcctcagggagattccaggccagcccaaactaccctgcatcccaacccccaacccctgcccacagaaccagctgatggccccagtgcctgaaagtgcccttgggcacctcctcagctgctgccaggatctggtctctttggcccctcccaggccatcagtctgcacttgaaatccccagggcctgaaacctactccaccttcctggccagtacctcaccccttgattgccaggtctggtctaagtttctttaataaagacaaaggagtgatttt

SEQ ID NO: 107124 - DNA, 848 bp, Homo sapiens
  Payload ID: 1026
  Gene Symbol: ANAPC15
  Gene Name: anaphase promoting complex subunit 15
  Uniprot ID: P60006
  ENST ID: ENST00000535234
  CDS Start-End: 191-556
gagcggggaaaacaaaaggagacgaaggacgcatgcgtttggtgagtcccggattctggtgggttcttccgctcaggctgggtgaagcgcttccgggtcgccgccggcagcagcctcccggcgcgatgaagacactgaggctcagagaggttaagtgactcagccaaggtcaaacagctatctaggagccatgtccactttgttcccctcactcttccctcgtgtgactgagactctgtggtttaatctggatcgaccctgtgtggaagagacagagctgcagcagcaggaacagcagcatcaggcctggctccaaagcatcgcggagaaagacaacaacctggttcctattggcaagccagcctcagagcactatgatgacgaggaagaagaggatgatgaagatgatgaggatagtgaagaggactcagaggatgatgaggatatgcaggacatggacgagatgaatgactacaatgagtcaccggatgatggagaggtcaatgaggtggacatggaaggcaacgaacaggatcaggaccagtggatgatctaggtagacaaggcagggtggcctcagggagattccaggccagcccaaactaccctgcatcccaacccccaacccctgcccacagaaccagctgatggccccagtgcctgaaagtgcccttgggcacctcctcagctgctgccaggatctggtctctttggcccctcccaggccatcagtctgcacttgaaatccccagggcctgaaacctactccaccttcctggccagtacctcaccccttgattgccaggtctggtctaagtttctttaataaagacaaaggagtgattttc

SEQ ID NO: 107125 - DNA, 3195 bp, Homo sapiens
  Payload ID: 1027
  Gene Symbol: ANAPC16
  Gene Name: anaphase promoting complex subunit 16
  Uniprot ID: Q96DE5
  ENST ID: ENST00000299381
  CDS Start-End: 119-451
cgaacacgccgcggtcctcgtcgtggtgagcgcagccactcaggctggtcctgggggtggggctgtaggggaaagtgctaaagccgctgagtgaagtaagaactctgctagagaggaaatggctgcttcatcatcatcctcctcagctggtggggtcagtggaagttctgtcactggatctggtttcagtgtctcagaccttgccccaccacggaaagcccttttcacctaccccaaaggagctggagagatgttagaagatggctctgagagattcctctgcgaatctgtttttagctatcaagtggcatccacgcttaaacaggtgaaacatgatcagcaagttgctcggatggaaaaactagctggtttggtagaagagctggaggctgacgagtggcggtttaagcccatcgagcagctgctgggattcaccccctcttcaggttgatactgcctggatggtcacctctggtgcgcagcaagtgcaaagccagtgggggactttctcacagcttacatagccatccagagatccacagctacgtcactgaattgttaatgcacatttgtacttggtttctctgtatctattcacaggcaacaaatacttatatgtgtgatctttcagggaatgttttgtttatttgtttttaaaagtattgggaatcagattaagacaatcagtttcagagaaccaggaggtttggggttaagagatactcaaaaattttcacaagccaagtagggcatatatcagatttggccaactgaatggcgtctgtcctgtcatccatatggtgcctggaaatatttaccagtcaaggtcaaggtcagcatctgtggttaaaaatatagcattctgacctaaaaaagttattttgcagatgaatgtgttttcaactcaggacctatccaaatgaggaatttttaaatattcttttttttttcctatttttagacatcaattctatagattctgactttttctaacctcttatagacatgccaaatgctggcaaaaagaagtgctttttggatatggcagcacttgtaaaaataaagcagtaagcaaaatccttttaaacacagaaatcctgagttcttctcattggtggactcaagcaattctgtagcaaataaatcctttgaaagagctccaaattggtggcattatcctttcaaaatctcagggatttgggatgaagtgaagaggtcaaattactttttagaagaagggaatctaaaaaccatctctcctaaacaaatggtagactggctttacttaagggatatttgtctttataggagtacataaatttatcttaatgatatttaagtagtttttttttttttttgagacgaagttttgctcttgttgcccaggctgtatcgcaatggcgcgatctctgctcactgcaacatccacctcccaggttcaagcaattctcctgcctcagcctcccaagtagctgggattacaggcacccgccaccacacccagctaattttttgtatatttagtagagacggggtttcaccatgttgaccaggctagtctcgaacttctgacctcaggtgatccacctgcctcagcctcccaaattgctgggattacaggcgtgagccaccttgcccagccaatttttttttaaagagacatggtcttgctatgttgcccaggttggtcttgaactcctggcctcaagagatccccccaaccttggcctccaaagtgctgggattacaggcatgagccaccgcgcctggcctcaagtaagtttttataccatgataggggaaaacctggaaggctaagagatgtgctgttttccttcatgggaccccactttccacagtaaacaactggtataatcatttattacgttgtatgcaaattttgccttagacaacatttgtctggttccttattaataacttgcatctgatctgcttagagttgcttaattataagtaaatataatcccagtagcatttagccttaatctcaagagttcaaaatgtttaacacattctacctgacgggaggtggtgacctcattcagtcggttaagagcctgagccctgtgaagttaaacacctgctcatggtcacatagcccaggcagaagaaaatctcggacttggaatagatcccagttgcctgataattcatctcattattgcctctaaagcaaattggagactgggcacagtggctcccacctttaatcccagcacctggggaggctgaggtgagtggatcactagaggtcaggagttcaagaccagtctggccgacatggtgaaactcagtctctattgaaaatacaaaaattagctcagtgtggtggcacacacttgtaatcccagctactcaggaggctgaggcatgagaatcgcttaaacccaggaggcggaggttgcagtgagctgagatcacaccattgcactctagtctgggtgacagagcgagactctgtctcaaaaaaaaaaaaataaagccgggcgtggtggctcacgcctgtaatcccggcactttgggaggctgaggcaggcggattgcctgagatcgggagttcgagaccagcctggccaacatggtgaaaccttgtctctactaaaactacaaaaaaaattagccaggcgtggtggcgggcgcctgtaatcccagctactcaggaggctgaggcagcagaatcgtttgaacccgggaggcggaggttgcagtgagtggagatcgtgcctgtgtgctccagcctgagcaacaagagcgaaactgtctcaaaaaaaagaagaaaataaataaataaaaatcagagcacaagaagtaccagtccaccaactcacattttctatattaataattcttaactaaaagaagttccatattcgacagcattttagttttttaatagtacttattagcatcaaccatcttgataatcaccaagggaaaaattaaaaatacctagactgcaataaacctttaaattggattttcagtgagaatttagaagcaatcactacctttctcgtttcatttgtgtaaccatgcagcataggcactgtgttacatcatctttacgctttggtatttgaacttattacagaattttttctctaaattggatgtttctttatatgaccttggaaactgaagtgatcttagcattaaacaaaaatgctttttgaa

SEQ ID NO: 107126 - DNA, 3567 bp, Homo sapiens
  Payload ID: 1027
  Gene Symbol: ANAPC16
  Gene Name: anaphase promoting complex subunit 16
  Uniprot ID: Q96DE5
  ENST ID: ENST00000621663
  CDS Start-End: 493-825
acgggcgcgcgcacgccgccttcgccgctggctccgtctgttggggggcgaacacgccgcggtcctcgtcgtggtgagcgcagccactcaggctggtcctgggggtggggctgtaggggaaagtgctaaagccgctgaggtgcagtggctcacgcctgtaatcccagcactttgggaggccaaggcaggtggatcacctgaggtcgggagttcaagaccagcctgaccaacatggagaaaccccatctctactagaaatacaaaattagccaggcatggtggtgcatgcctgtaatcccagctactcgggaggctgaagcaggagaatcgcttaaatccgggaggcagaggttgctgtgagccgagatcgcgccatttccagcctgggcaacaagagggaaactccgtctcaaaaaaaaaaaaaaaaaagaagagaaaagaaaacataagtttcagccaggcatgtgaagtaagaactctgctagagaggaaatggctgcttcatcatcatcctcctcagctggtggggtcagtggaagttctgtcactggatctggtttcagtgtctcagaccttgccccaccacggaaagcccttttcacctaccccaaaggagctggagagatgttagaagatggctctgagagattcctctgcgaatctgtttttagctatcaagtggcatccacgcttaaacaggtgaaacatgatcagcaagttgctcggatggaaaaactagctggtttggtagaagagctggaggctgacgagtggcggtttaagcccatcgagcagctgctgggattcaccccctcttcaggttgatactgcctggatggtcacctctggtgcgcagcaagtgcaaagccagtgggggactttctcacagcttacatagccatccagagatccacagctacgtcactgaattgttaatgcacatttgtacttggtttctctgtatctattcacaggcaacaaatacttatatgtgtgatctttcagggaatgttttgtttatttgtttttaaaagtattgggaatcagattaagacaatcagtttcagagaaccaggaggtttggggttaagagatactcaaaaattttcacaagccaagtagggcatatatcagatttggccaactgaatggcgtctgtcctgtcatccatatggtgcctggaaatatttaccagtcaaggtcaaggtcagcatctgtggttaaaaatatagcattctgacctaaaaaagttattttgcagatgaatgtgttttcaactcaggacctatccaaatgaggaatttttaaatattcttttttttttcctatttttagacatcaattctatagattctgactttttctaacctcttatagacatgccaaatgctggcaaaaagaagtgctttttggatatggcagcacttgtaaaaataaagcagtaagcaaaatccttttaaacacagaaatcctgagttcttctcattggtggactcaagcaattctgtagcaaataaatcctttgaaagagctccaaattggtggcattatcctttcaaaatctcagggatttgggatgaagtgaagaggtcaaattactttttagaagaagggaatctaaaaaccatctctcctaaacaaatggtagactggctttacttaagggatatttgtctttataggagtacataaatttatcttaatgatatttaagtagtttttttttttttttgagacgaagttttgctcttgttgcccaggctgtatcgcaatggcgcgatctctgctcactgcaacatccacctcccaggttcaagcaattctcctgcctcagcctcccaagtagctgggattacaggcacccgccaccacacccagctaattttttgtatatttagtagagacggggtttcaccatgttgaccaggctagtctcgaacttctgacctcaggtgatccacctgcctcagcctcccaaattgctgggattacaggcgtgagccaccttgcccagccaatttttttttaaagagacatggtcttgctatgttgcccaggttggtcttgaactcctggcctcaagagatccccccaaccttggcctccaaagtgctgggattacaggcatgagccaccgcgcctggcctcaagtaagtttttataccatgataggggaaaacctggaaggctaagagatgtgctgttttccttcatgggaccccactttccacagtaaacaactggtataatcatttattacgttgtatgcaaattttgccttagacaacatttgtctggttccttattaataacttgcatctgatctgcttagagttgcttaattataagtaaatataatcccagtagcatttagccttaatctcaagagttcaaaatgtttaacacattctacctgacgggaggtggtgacctcattcagtcggttaagagcctgagccctgtgaagttaaacacctgctcatggtcacatagcccaggcagaagaaaatctcggacttggaatagatcccagttgcctgataattcatctcattattgcctctaaagcaaattggagactgggcacagtggctcccacctttaatcccagcacctggggaggctgaggtgagtggatcactagaggtcaggagttcaagaccagtctggccgacatggtgaaactcagtctctattgaaaatacaaaaattagctcagtgtggtggcacacacttgtaatcccagctactcaggaggctgaggcatgagaatcgcttaaacccaggaggcggaggttgcagtgagctgagatcacaccattgcactctagtctgggtgacagagcgagactctgtctcaaaaaaaaaaaaataaagccgggcgtggtggctcacgcctgtaatcccggcactttgggaggctgaggcaggcggattgcctgagatcgggagttcgagaccagcctggccaacatggtgaaaccttgtctctactaaaactacaaaaaaaattagccaggcgtggtggcgggcgcctgtaatcccagctactcaggaggctgaggcagcagaatcgtttgaacccgggaggcggaggttgcagtgagtggagatcgtgcctgtgtgctccagcctgagcaacaagagcgaaactgtctcaaaaaaaagaagaaaataaataaataaaaatcagagcacaagaagtaccagtccaccaactcacattttctatattaataattcttaactaaaagaagttccatattcgacagcattttagttttttaatagtacttattagcatcaaccatcttgataatcaccaagggaaaaattaaaaatacctagactgcaataaacctttaaattggattttcagtgagaatttagaagcaatcactacctttctcgtttcatttgtgtaaccatgcagcataggcactgtgttacatcatctttacgctttggtatttgaacttattacagaattttttctctaaattggatgtttctttatatgaccttggaaactgaagtgatcttagcattaaacaaaaatgctttttg

SEQ ID NO: 107127 - DNA, 3100 bp, Homo sapiens
  Payload ID: 1027
  Gene Symbol: ANAPC16
  Gene Name: anaphase promoting complex subunit 16
  ENST ID: ENST00000615507
  CDS Start-End: 101-358
acgggcgcgcgcacgccgccttcgccgctggctccgtctgttggggggcgaacacgccgcggtcctcgtcgtgtgaagtaagaactctgctagagaggaaatggctgcttcatcatcatcctcctcagctggtggggtcagtggaagttctgtcactggatctggtttcagtgtctcagaccttgccccaccacggaaagcccttttcacctaccccaaaggagctggagagatgttagaagatcagcaagttgctcggatggaaaaactagctggtttggtagaagagctggaggctgacgagtggcggtttaagcccatcgagcagctgctgggattcaccccctcttcaggttgatactgcctggatggtcacctctggtgcgcagcaagtgcaaagccagtgggggactttctcacagcttacatagccatccagagatccacagctacgtcactgaattgttaatgcacatttgtacttggtttctctgtatctattcacaggcaacaaatacttatatgtgtgatctttcagggaatgttttgtttatttgtttttaaaagtattgggaatcagattaagacaatcagtttcagagaaccaggaggtttggggttaagagatactcaaaaattttcacaagccaagtagggcatatatcagatttggccaactgaatggcgtctgtcctgtcatccatatggtgcctggaaatatttaccagtcaaggtcaaggtcagcatctgtggttaaaaatatagcattctgacctaaaaaagttattttgcagatgaatgtgttttcaactcaggacctatccaaatgaggaatttttaaatattcttttttttttcctatttttagacatcaattctatagattctgactttttctaacctcttatagacatgccaaatgctggcaaaaagaagtgctttttggatatggcagcacttgtaaaaataaagcagtaagcaaaatccttttaaacacagaaatcctgagttcttctcattggtggactcaagcaattctgtagcaaataaatcctttgaaagagctccaaattggtggcattatcctttcaaaatctcagggatttgggatgaagtgaagaggtcaaattactttttagaagaagggaatctaaaaaccatctctcctaaacaaatggtagactggctttacttaagggatatttgtctttataggagtacataaatttatcttaatgatatttaagtagtttttttttttttttgagacgaagttttgctcttgttgcccaggctgtatcgcaatggcgcgatctctgctcactgcaacatccacctcccaggttcaagcaattctcctgcctcagcctcccaagtagctgggattacaggcacccgccaccacacccagctaattttttgtatatttagtagagacggggtttcaccatgttgaccaggctagtctcgaacttctgacctcaggtgatccacctgcctcagcctcccaaattgctgggattacaggcgtgagccaccttgcccagccaatttttttttaaagagacatggtcttgctatgttgcccaggttggtcttgaactcctggcctcaagagatccccccaaccttggcctccaaagtgctgggattacaggcatgagccaccgcgcctggcctcaagtaagtttttataccatgataggggaaaacctggaaggctaagagatgtgctgttttccttcatgggaccccactttccacagtaaacaactggtataatcatttattacgttgtatgcaaattttgccttagacaacatttgtctggttccttattaataacttgcatctgatctgcttagagttgcttaattataagtaaatataatcccagtagcatttagccttaatctcaagagttcaaaatgtttaacacattctacctgacgggaggtggtgacctcattcagtcggttaagagcctgagccctgtgaagttaaacacctgctcatggtcacatagcccaggcagaagaaaatctcggacttggaatagatcccagttgcctgataattcatctcattattgcctctaaagcaaattggagactgggcacagtggctcccacctttaatcccagcacctggggaggctgaggtgagtggatcactagaggtcaggagttcaagaccagtctggccgacatggtgaaactcagtctctattgaaaatacaaaaattagctcagtgtggtggcacacacttgtaatcccagctactcaggaggctgaggcatgagaatcgcttaaacccaggaggcggaggttgcagtgagctgagatcacaccattgcactctagtctgggtgacagagcgagactctgtctcaaaaaaaaaaaaataaagccgggcgtggtggctcacgcctgtaatcccggcactttgggaggctgaggcaggcggattgcctgagatcgggagttcgagaccagcctggccaacatggtgaaaccttgtctctactaaaactacaaaaaaaattagccaggcgtggtggcgggcgcctgtaatcccagctactcaggaggctgaggcagcagaatcgtttgaacccgggaggcggaggttgcagtgagtggagatcgtgcctgtgtgctccagcctgagcaacaagagcgaaactgtctcaaaaaaaagaagaaaataaataaataaaaatcagagcacaagaagtaccagtccaccaactcacattttctatattaataattcttaactaaaagaagttccatattcgacagcattttagttttttaatagtacttattagcatcaaccatcttgataatcaccaagggaaaaattaaaaatacctagactgcaataaacctttaaattggattttcagtgagaatttagaagcaatcactacctttctcgtttcatttgtgtaaccatgcagcataggcactgtgttacatcatctttacgctttggtatttgaacttattacagaattttttctctaaattggatgtttctttatatgaccttggaaactgaagtgatcttagcattaaacaaaaatgctttttg

SEQ ID NO: 107128 - DNA, 2632 bp, Homo sapiens
  Payload ID: 1028
  Gene Symbol: ANAPC2
  Gene Name: anaphase promoting complex subunit 2
  Uniprot ID: Q9UJX6
  ENST ID: ENST00000323927
  CDS Start-End: 6-2474
tgcagatggcggcggcagttgtggtggcggagggggacagcgactcccggcccggacaggagttgttagtggcctggaacaccgtgagcaccggcctggtgccgccggctgcgctggggctggtgtcttcccggaccagcggtgcagtcccgccaaaggaagaggagctccgggcggcggtggaggttctgaggggccacgggctacactcggtcctggaggagtggttcgtggaggtgctgcagaacgatctgcaggccaacatctcccctgagttctggaatgccatctcccaatgcgagaactctgcggatgagccccagtgccttttgctactccttgacgcttttggcctgctggagagccgcctggatccctacctgcgtagcctagagctgctggagaaatggactcgcctgggcttgctgatgggcactggtgctcaggggctgcgagaagaagtccacactatgttgcgcggagtcttgttctttagcacccccagaaccttccaagagatgatccagcgtctgtatgggtgcttcttgagagtctatatgcagagtaagaggaagggggaagggggcacagacccggaactggaaggggagctggacagccggtatgcccgtcgccggtactaccggctcctgcagagcccgctgtgtgcagggtgcagcagtgacaagcaacagtgctggtgtcgccaggctctggagcagttccatcagctcagccaggtcttacacaggctcagtctgctggagcgggtcagtgccgaggctgtgaccaccaccctgcaccaggtgacccgggagaggatggaggaccgttgccggggcgagtacgagcgctccttcctgcgtgagttccacaagtggatcgagcgggtggtcggctggctcggcaaggtgttcctgcaggacggccccgccaggcccgcatctcccgaggccggcaacaccctgcgccgctggcgctgccacgtgcaaaggttcttctaccgcatctacgccagcctgcgcatcgaggagctcttcagcatcgtccgagacttcccagactcccggccagccatcgaggacctcaagtactgcctggagaggacggaccagaggcagcagctgctcgtgtccctcaaggctgccctggagactcggctcctgcatccaggcgtcaacacgtgtgacatcatcaccctctatatctctgccatcaaggcgctgcgcgtgctggacccttccatggtcatcctggaggtggcctgtgagcctatccgccgctacctgaggacgcgggaggacacagtgcggcagattgtggctgggctgacgggggactcggacgggacaggggacctggctgttgagctgtccaagaccgacccggcgagcctggagacaggccaggacagtgaggatgactcaggcgagccagaggactgggtcccggaccctgtggatgccgatccagggaagtcgagctccaagcggcgttcatcggacatcatcagcctgctggtcagcatctacggcagcaaggacctcttcatcaatgagtaccgctcgctgctggccgaccgcctgctgcaccagttcagcttcagccccgagcgggagatccgcaacgtggagctgctgaagctgcgctttggcgaggccccaatgcacttctgtgaagtcatgctgaaggacatggcggactcccgccgcatcaatgccaacatccgggaggaggatgagaagcggccagcagaggagcagccaccgttcggggtctacgctgtcatcctgtccagtgagttctggccgcccttcaaggacgagaagctggaggtccccgaggatatcagggcagccctggaggcttactgcaagaagtatgagcagctcaaggccatgcggaccctcagttggaagcacaccctgggcctggtgaccatggacgtggagctggccgaccgcacgctgtctgtggcggtcaccccagtacaggcggtgatcttgctgtattttcaggaccaagccagctggaccctggaggaactgagcaaggcggtgaagatgcccgtggcgctgctgcggcggcggatgtccgtgtggctgcagcagggtgtgctgcgtgaggagccccccggcaccttctctgtcattgaggaggagcggcctcaggaccgggacaacatggtgctcattgacagtgacgacgagagcgactccggcatggcctcccaggccgaccagaaggaggaggagctgctgctcttctggacgtacatccaggccatgctgaccaacctggagagcctctcactggatcgtatctacaacatgctccgcatgtttgtggtgactgggcctgcactggccgagattgacctgcaggagctgcagggctacctgcagaagaaggtgcgggaccagcagctcgtctactcggccggcgtctaccgcctgcccaagaactgcagctgacacatcgcccgcccgcccgcccgcccgccaggcgctgccctgcaggtgctctcgtcctcccgtgccagcccccgcccgcccgtgtcccagaatgcactgctgaggagcatgcccacccccacccccgcagtgtgcagattaaagcaagtcagatcatc

SEQ ID NO: 107129 - DNA, 2685 bp, Homo sapiens
  Payload ID: 1029
  Gene Symbol: ANAPC4
  Gene Name: anaphase promoting complex subunit 4
  Uniprot ID: Q9UJX5
  ENST ID: ENST00000315368
  CDS Start-End: 143-2569
cccgacgccggaagtgcctggagcgcgcgacagcggcggggcggggcggcctggaggctgtggcgcgcggccggcagagggaggggagaggccactggggccgtgttagtctgccggtggggactcttgcagggccgtccccatgttgcgttttccgacctgtttcccatccttccgggtggtgggagagaagcagctcccgcaggagattattttcctggtctggtcgcccaagcgggatctcattgctttggccaacacagctggcgaggttttacttcatcgactggcaagttttcatcgagtttggagttttccaccaaatgaaaatacaggaaaggaggtgacgtgtctggcatggagaccagatggcaaacttttggcctttgctcttgctgataccaagaaaattgttttgtgtgatgtagaaaaacctgagagcttacactctttttctgtggaggctccagtttcctgtatgcattggatggaagtgacagtagaaagcagtgttctcacatcattttataatgctgaggatgaatcaaatcttctcttacctaaactacctacactgccaaaaaactatagcaacacctcaaaaatatttagtgaagaaaattctgatgaaattattaagctcttgggagacgtcaggcttaatattctcgtccttggaggaagctctggatttattgagctttatgcttatggaatgtttaaaattgctcgagtcacagggattgctggtacttgtcttgcattatgtttatcaagtgatttgaaatcattatcagtggtcacagaagtctctaccaatggtgcttcagaagtttcatactttcagcttgaaactaatctgttgtactctttcttacctgaagtaactcggatggccagaaagtttactcatatttcagctctgttacagtatataaatttgtcactaacatgtatgtgtgaagcatgggaagaaatactaatgcagatggattctcgtctcaccaagtttgtgcaggaaaagaacacaaccacatcagtgcaagatgagttcatgcacttgctattatgggggaaagcaagtgctgaacttcagactctcttgatgaatcagttaacagtaaagggcttgaaaaagcttggccagtctatagagtcatcatactccagtatacaaaaattggtcataagtcatttacagagtggctcggagtctttattataccatttgagtgaattgaaaggaatggcttcatggaagcaaaaatatgaacctcttggactagatgctgcaggaatcgaagaagctataactgctgtgggttcttttatactcaaggcaaatgaacttcttcaagttatagatagtagtatgaaaaacttcaaagcattttttcggtggctttatgtggcaatgttgagaatgacagaagaccatgtgcttcccgagctgaataagatgactcagaaagatatcacatttgttgctgaatttcttactgaacatttcaatgaggctccagacctttataatcgaaaaggaaaatactttaacgttgaaagagttggtcagtacttgaaagatgaagatgatgatcttgtgtcaccccctaacacagaaggaaaccagtggtatgactttcttcaaaatagcagccaccttaaagaaagtcctttgctgtttccttattatcctcgaaaatcattgcattttgtgaaaaggcggatggagaatattattgatcagtgtttgcaaaagccagcagatgtaattggaaaatcgatgaatcaagcaatctgtattccattgtatagagataccagaagtgaggattctacacgtagattgttcaaatttccttttctgtggaataataaaacttcaaatctacattatcttctttttactattctagaagattcactttataaaatgtgcatcttaaggagacatactgatatttctcaatctgtgagtaatggactaattgctattaaatttgggagctttacatatgccacaacagaaaaagtcagaagaagcatctacagttgtttagatgcacagttttatgatgatgaaactgtaacagtagttcttaaagacactgtaggacgtgaaggaagagatagactcttggtccagctgcctttgtctttagtatataacagtgaagattctgcagaatatcagttcactgggacttattctacaaggctagatgaacagtgtagtgctattcccacccgtaccatgcattttgagaagcactggagattactggaaagtatgaaagcacagtatgttgctgggaatggttttcgaaaagtgtcctgtgtgttaagctcaaatcttcgtcatgtgagagtatttgaaatggacatagatgatgaatgggagctcgatgagtcttcagatgaagaggaggaggccagtaataagcctgtaaaaataaaggaagaagtgttgtcggagtcagaggcagagaaccaacaagctggtgctgccgctttagctccagagatagtcattaaagtggaaaaacttgaccctgagctagactcctaatctagcttgccattattgtgtgtgtaattatggccaaaaggacataggagatggactaagatgtcttggaccacctttgtgtaacaaagaaataaacagtaaattttattttttca

SEQ ID NO: 107130 - DNA, 595 bp, Homo sapiens
  Payload ID: 1029
  Gene Symbol: ANAPC4
  Gene Name: anaphase promoting complex subunit 4
  ENST ID: ENST00000505991
  CDS Start-End: 109-595
agtctgccggtggggactcttgcaggtacaggcgcggtcggggctcctcgtggagagccgggggctcctgccggcctctgactggggtgtcgttgcagggccgtccccatgttgcgttttccgacctgtttcccatccttccgggtggtgggagagaagcagctcccgcaggagattattttcctggtctggtcgcccaagcgggatctcattgctttggccaacacagctggcgaggttttacttcatcgactggcaagttttcatcgagtttggagttttccaccaaatgaaaatacaggaaaggaggtgacgtgtctggcatggagaccagatggcaaacttttggcctttgctcttgctgataccaagaaaattgttttgtgtgatgtagaaaaacctgagagcttacactctttttctgtggaggctccagtttcctgtatgcattggatggaagtgacagtagaaagcagtgttctcacatcattttataatgctgaggatgaatcaaatcttctcttacctaaactacctacactgccaaaaaactatagcaacacctcaaaaatatttagtgaagaaaattctgatg

SEQ ID NO: 107131 - DNA, 569 bp, Homo sapiens
  Payload ID: 1029
  Gene Symbol: ANAPC4
  Gene Name: anaphase promoting complex subunit 4
  ENST ID: ENST00000505080
  CDS Start-End: 41-292
gtgttagtctgccggtggggactcttgcagggccgtccccatgttgcgttttccgacctgtttcccatccttccgggtggtgggagagaagcagctcccgcaggagattattttcctggtctggtcgcccaagcgggatctcattgctttggccaacacagctggcgaggttttacttcatcgactggcaagttttcatcgagtttggagttttccaccaaatgaaaatacaggaaaggagttttggcctttgctcttgctgataccaagaaaattgttttgtgtgatgtagaaaaacctgagagcttacactctttttctgtggaggctccagtttcctgtatgcattggatggaagtgacagtagaaagcagtgttctcacatcattttataatgctgaggatgaatcaaatcttctcttacctaaactacctacactgccaaaaaactatagcaacacctcaaaaatatttagtgaagaaaattctgatgaaattattaagctcttgggagacgtcaggcttaatattctcgtccttggaggaagctctggatttattgagcttta

SEQ ID NO: 107132 - DNA, 2599 bp, Homo sapiens
  Payload ID: 1029
  Gene Symbol: ANAPC4
  Gene Name: anaphase promoting complex subunit 4
  Uniprot ID: Q9UJX5
  ENST ID: ENST00000510092
  CDS Start-End: 63-2492
gaggggagaggccactggggccgtgttagtctgccggtggggactcttgcagggccgtccccatgttgcgttttccgacctgtttcccatccttccgggtggtgggagagaagcagctcccgcaggagattattttcctggtctggtcgcccaagcgggatctcattgctttggccaacacagctggcgaggttttacttcatcgactggcaagttttcatcgagtttggagttttccaccaaatgaaaatacaggaaaggaggtgacgtgtctggcatggagaccagatggcaaacttttggcctttgctcttgctgataccaagaaaattgttttgtgtgatgtagaaaaacctgagagcttacactctttttctgtggaggctccagtttcctgtatgcattggatggaagtgacagtagaaagcagtgttctcacatcattttataatgctgaggatgaatcaaatcttctcttacctaaactacctacactgccaaaaaactatagcaacacctcaaaaatatttagtgaagaaaattctgatgaaattattaagctcttgggagacgtcaggcttaatattctcgtccttggaggaagctctggatttattgagctttatgcttatggaatgtttaaaattgctcgagtcacagggattgctggtacttgtcttgcattatgtttatcaagtgatttgaaatcattatcagtggtcacagaagtctctaccaatggtgcttcagaagtttcatactttcagcttgaaactaatctgttgtactctttcttacctgaagtaactcggatggccagaaagtttactcatatttcagctctgttacagtatataaatttgtcactaacatgtatgtgtgaagcatgggaagaaatactaatgcagatggattctcgtctcaccaagtttgtgcaggaaaagaacacaaccacatcagtgcaagatgagttcatgcacttgctattatgggggaaagcaagtgctgaacttcagactctcttgatgaatcagttaacagtaaagggcttgaaaaagcttggccagtctatagagtcatcatactccagtatacaaaaattggtcataagtcatttacagagtggctcggagtctttattataccatttgagtgaattgaaaggaatggcttcatggaagcaaaaatatgaacctcttggactagatgctgcaggaatcgaagaagctataactgctgtgggttcttttatactcaaggcaaatgaacttcttcaagttatagatagtagtatgaaaaacttcaaagcattttttcggtggctttatgtggcaatgttgagaatgacagaagaccatgtgcttcccgagctgaataaggtaatgactcagaaagatatcacatttgttgctgaatttcttactgaacatttcaatgaggctccagacctttataatcgaaaaggaaaatactttaacgttgaaagagttggtcagtacttgaaagatgaagatgatgatcttgtgtcaccccctaacacagaaggaaaccagtggtatgactttcttcaaaatagcagccaccttaaagaaagtcctttgctgtttccttattatcctcgaaaatcattgcattttgtgaaaaggcggatggagaatattattgatcagtgtttgcaaaagccagcagatgtaattggaaaatcgatgaatcaagcaatctgtattccattgtatagagataccagaagtgaggattctacacgtagattgttcaaatttccttttctgtggaataataaaacttcaaatctacattatcttctttttactattctagaagattcactttataaaatgtgcatcttaaggagacatactgatatttctcaatctgtgagtaatggactaattgctattaaatttgggagctttacatatgccacaacagaaaaagtcagaagaagcatctacagttgtttagatgcacagttttatgatgatgaaactgtaacagtagttcttaaagacactgtaggacgtgaaggaagagatagactcttggtccagctgcctttgtctttagtatataacagtgaagattctgcagaatatcagttcactgggacttattctacaaggctagatgaacagtgtagtgctattcccacccgtaccatgcattttgagaagcactggagattactggaaagtatgaaagcacagtatgttgctgggaatggttttcgaaaagtgtcctgtgtgttaagctcaaatcttcgtcatgtgagagtatttgaaatggacatagatgatgaatgggagctcgatgagtcttcagatgaagaggaggaggccagtaataagcctgtaaaaataaaggaagaagtgttgtcggagtcagaggcagagaaccaacaagctggtgctgccgctttagctccagagatagtcattaaagtggaaaaacttgaccctgagctagactcctaatctagcttgccattattgtgtgtgtaattatggccaaaaggacataggagatggactaagatgtcttggaccacctttgtgtaacaaagaaataaacagtaaatttt

SEQ ID NO: 107133 - DNA, 2513 bp, Homo sapiens
  Payload ID: 1030
  Gene Symbol: ANAPC5
  Gene Name: anaphase promoting complex subunit 5
  Uniprot ID: Q9UJX4
  ENST ID: ENST00000261819
  CDS Start-End: 123-2390
gcggatgtctgtttcctgggatattgtgagggcgggcggagatgtagacccggtagtgttgtgccttgtggtgacaactggcggcagcgcgccgcgggcccgagacttagtctcgggccgccatggccagcgtccacgagagcctctacttcaatcccatgatgaccaatggggttgtgcacgccaatgtgttcggcatcaaggactgggtgacgccgtacaagatcgcggtgctggtgctgctgaacgagatgagccgcacaggcgagggcgccgtcagcctcatggagcggcggaggctcaaccagctgctcctgcccctgctgcagggcccagatattacactgtcaaaactttacaagttaattgaagagtcttgtccacagctggcaaattcagtgcagatcagaatcaaactgatggctgaaggcgagttgaaggatatggaacagttttttgatgacctttcagattctttctctggaactgaaccagaggttcacaaaacaagtgtagtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcattatctcagctacttaaacaacctccgtgtccaagatgttttcagttcaacacacagtctcctccattattttgatcgtctgattcttaccggagccgaaagcaaaagtaatggggaagagggctatggccggagcttgagatacgccgctctgaatcttgccgccctgcactgccgcttcggtcactatcaacaggcagagctcgccctgcaggaggcaattaggattgcccaggagtccaacgatcacgtgtgtctccagcactgtttgagctggctttatgtgctggggcagaagagatccgatagctatgttctgctggagcattctgtgaagaaggcagtacattttgggttaccgtacctcgcctccctgggaatacagtcccttgttcaacagagagcttttgctgggaagacggcaaacaagctgatggatgccctaaaggactccgacctcctgcactggaaacacagcctgtcagagctcatcgatatcagcatcgcacagaaaacggccatctggaggctgtatggccgcagcaccatggcactgcaacaggcccagatgttgctgagcatgaacagcctggaggcggtgaatgcgggcgtgcagcagaacaacacagagtcctttgctgtcgcactctgccacctcgcagagctacacgcggagcagggctgttttgctgcagcttctgaagtgttaaagcacttgaaggaacgatttccgcctaatagtcagcacgcccagttatggatgctatgtgatcaaaaaatacagtttgacagagcaatgaatgatggcaaatatcatttggctgattcacttgttacaggaatcacagctctcaatagcatagagggtgtttataggaaagcggttgtattacaagctcagaaccaaatgtcagaggcacataagcttttacaaaaattgttggttcattgtcagaaactgaagaacacagaaatggtgatcagtgtcctactgtccgtggcagagctgtactggcgatcttcctcccctaccatcgcgctgcccatgctcctgcaggctctggccctctccaaggagtaccggttacagtacttggcctctgaaacagtgctgaacttggcttttgcgcagctcattcttggaatcccagaacaggccttaagtcttctccacatggccatcgagcccatcttggctgacggggctatcctggacaaaggtcgtgccatgttcttagtggccaagtgccaggtggcttcagcagcttcctacgatcagccgaagaaagcagaagctctggaggctgccatcgagaacctcaatgaagccaagaactattttgcaaaggttgactgcaaagagcgcatcagggacgtcgtttacttccaggccagactctaccataccctggggaagacccaggagaggaaccggtgtgcgatgctcttccggcagctgcatcaggagctgccctctcatggggtacccttgataaaccatctctagagaggacatccctgctgggctgctgtgcagagtataagattttggacttgttcatgtcccctctctccctataaatgatgtatttgtgacaccctatcttgtcaataaacagcattctgatta

SEQ ID NO: 107134 - DNA, 2147 bp, Homo sapiens
  Payload ID: 1030
  Gene Symbol: ANAPC5
  Gene Name: anaphase promoting complex subunit 5
  Uniprot ID: Q9UJX4
  ENST ID: ENST00000441917
  CDS Start-End: 93-2024
agggcccagatattacactgtcaaaactttacaagttaattgaagagtcttgtccacagctggcaaattcagtgcagatcagaatcaaactgatggctgaaggcgagttgaaggatatggaacagttttttgatgacctttcagattctttctctggaactgaaccagaggttcacaaaacaagtgtagtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcattatctcagctacttaaacaacctccgtgtccaagatgttttcagttcaacacacagtctcctccattattttgatcgtctgattcttaccggagccgaaagcaaaagtaatggggaagagggctatggccggagcttgagatacgccgctctgaatcttgccgccctgcactgccgcttcggtcactatcaacaggcagagctcgccctgcaggaggcaattaggattgcccaggagtccaacgatcacgtgtgtctccagcactgtttgagctggctttatgtgctggggcagaagagatccgatagctatgttctgctggagcattctgtgaagaaggcagtacattttgggttaccgagagcttttgctgggaagacggcaaacaagctgatggatgccctaaaggactccgacctcctgcactggaaacacagcctgtcagagctcatcgatatcagcatcgcacagaaaacggccatctggaggctgtatggccgcagcaccatggcactgcaacaggcccagatgttgctgagcatgaacagcctggaggcggtgaatgcgggcgtgcagcagaacaacacagagtcctttgctgtcgcactctgccacctcgcagagctacacgcggagcagggctgttttgctgcagcttctgaagtgttaaagcacttgaaggaacgatttccgcctaatagtcagcacgcccagttatggatgctatgtgatcaaaaaatacagtttgacagagcaatgaatgatggcaaatatcatttggctgattcacttgttacaggaatcacagctctcaatagcatagagggtgtttataggaaagcggttgtattacaagctcagaaccaaatgtcagaggcacataagcttttacaaaaattgttggttcattgtcagaaactgaagaacacagaaatggtgatcagtgtcctactgtccgtggcagagctgtactggcgatcttcctcccctaccatcgcgctgcccatgctcctgcaggctctggccctctccaaggagtaccggttacagtacttggcctctgaaacagtgctgaacttggcttttgcgcagctcattcttggaatcccagaacaggccttaagtcttctccacatggccatcgagcccatcttggctgacggggctatcctggacaaaggtcgtgccatgttcttagtggccaagtgccaggtggcttcagcagcttcctacgatcagccgaagaaagcagaagctctggaggctgccatcgagaacctcaatgaagccaagaactattttgcaaaggttgactgcaaagagcgcatcagggacgtcgtttacttccaggccagactctaccataccctggggaagacccaggagaggaaccggtgtgcgatgctcttccggcagctgcatcaggagctgccctctcatggggtacccttgataaaccatctctagagaggacatccctgctgggctgctgtgcagagtataagattttggacttgttcatgtcccctctctccctataaatgatgtatttgtgacaccctatcttgtcaataaacagcattctgatta

SEQ ID NO: 107135 - DNA, 1715 bp, Homo sapiens
  Payload ID: 1030
  Gene Symbol: ANAPC5
  Gene Name: anaphase promoting complex subunit 5
  ENST ID: ENST00000539079
  CDS Start-End: 1-1189
ggcttctttgctaaagaatgatgagactaaggccctcactccagcttccttgcagaaggaattaaacaatttgttgaaatttaatcctgattttgctgaagcgcattatctcagctacttaaacaacctccgtgtccaagatgttttcagttcaacacacagtctcctccattattttgatcgtctgattcttaccggagccgaaagcaaaagtaatggggaagagggctatggccggagcttgagatacgccgctctgaatcttgccgccctgcactgccgcttcggtcactatcaacaggcagagctcgccctgcaggaggcaattaggattgcccaggagtccaacgatcacgtgtgtctccagcactgtttgagctggctttatgtgctggggcagaagagatccgatagctatgttctgctggagcattctgtgaagaaggcagtacattttgggttaccgtacctcgcctccctgggaatacagtcccttgttcaacagagagcttttgctgggaagacggcaaacaagctgatggatgccctaaaggactccgacctcctgcactggaaacacagcctgtcagagctcatcgatatcagcatcgcacagaaaacggccatctggaggctgtatggccgcagcaccatggcactgcaacaggcccagatgttgctgagcatgaacagcctggaggcggtgaatgcgggcgtgcagcagaacaacacagagtcctttgctgtcgcactctgccacctcgcagagctacacgcggagcagggctgttttgctgcagcttctgaagtgttaaagcacttgaaggaacgatttccgcctaatagtcagcacgcccagttatggatgctatgtgatcaaaaaatacagtttgacagagcaatgaatgatggcaaatatcatttggctgattcacttgttacaggaatcacagctctcaatagcatagagggtgtttataggaaagcggttgtattacaagctcagaaccaaatgtcagaggcacataagcttttacaaaaattgttggttcattgtcagaaactgaagaacacagaaatggtgatcagagctgtactggcgatcttcctcccctaccatcgcgctgcccatgctcctgcaggctctggccctctccaaggagtaccggttacagtacttggcctctgaaacagtgctgaacttggcttttgcgcagctcattcttggaatcccagaacaggccttaagtcttctccacatggccatcgagcccatcttggctgacggggctatcctggacaaaggtcgtgccatgttcttagtggccaagtgccaggtggcttcagcagcttcctacgatcagccgaagaaagcagaagctctggaggctgccatcgagaacctcaatgaagccaagaactattttgcaaaggttgactgcaaagagcgcatcagggacgtcgtttacttccaggccagactctaccataccctggggaagacccaggagaggaaccggtgtgcgatgctcttccggcagctgcatcaggagctgccctctcatggggtacccttgataaaccatctctagagaggacatccctgctgggctgctgtgcagagtataagattttggacttgttcatgtcccctctctccctataaatgatgtatttgtgacaccctatcttgtcaataaacagcattctgatta

SEQ ID NO: 107136 - DNA, 2077 bp, Homo sapiens
  Payload ID: 1030
  Gene Symbol: ANAPC5
  Gene Name: anaphase promoting complex subunit 5
  ENST ID: ENST00000535482
  CDS Start-End: 690-1955
attgcccaggagtccaacgatcacgtgtgtctccagcactgtttggtgaggccatcctctggtcttgggagttttgttcacgggttgaattggccttcacaaggccccgttgaattgggttgttttgcagttggagcagagatcttcagcagcaaaaggaaacaagttaggtggtcatgggaattcagaaagggcaacttatctttacttacctttcttaattcatgacatctgttttgcttttggcatatatctgctctacaaagtttaatgcaacttgccatgaaagaagagaaacctttatcacatttagcactggcattaacaaaagatgtatactacacttagtaactgggtgagatgttgtcctgtaatagcaaaatcaccagggcagtggaacacagaagctacttgacaagcacctgagaatcttatttctcaattgaaggccatatgggagcttcatgctttttttctgaaacacctgccactcagtggctgtcaggtgaagcagaacaatgactcatttatttcagcctggttttaatgatgttgatatgtttgacaggtctcattgagattcttgatatttcttgaaagagtatttgagaggattcattttgtcccttttaaattctttcttatgaccacattgatatttcactagaacatcagccattgccactgttatgatatattttgatgatttctcttgccagagctggctttatgtgctggggcagaagagatccgatagctatgttctgctggagcattctgtgaagaaggcagtacattttgggttaccgtacctcgcctccctgggaatacagtcccttgttcaacagagagcttttgctgggaagacggcaaacaagctgatggatgccctaaaggactccgacctcctgcactggaaacacagcctgtcagagctcatcgatatcagcatcgcacagaaaacggccatctggaggctgtatggccgcagcaccatggcactgcaacaggcccagatgttgctgagcatgaacagcctggaggcggtgaatgcgggcgtgcagcagaacaacacagagtcctttgctgtcgcactctgccacctcgcagagctacacgcggagcagggctgttttgctgcagcttctgaagtgttaaagcacttgaaggaacgatttccgcctaatagtcagcacgcccagttatggatgctatgtgatcaaaaaatacagtttgacagagcaatgaatgatggcaaatatcatttggctgattcacttgttacaggaatcacagctctcaatagcatagagggtgtttataggaaagcggttgtattacaagctcagaaccaaatgtcagaggcacataagcttttacaaaaattgttggttcattgtcagaaactgaagaacacagaaatggtgatcagtgtcctactgtccgtggcagagctgtactggcgatcttcctcccctaccatcgcgctgcccatgctcctgcaggctctggccctctccaaggagtaccggttacagtacttggcctctgaaacagtgctgaacttggcttttgcgcagctcattcttggaatcccagaacaggccttaagtcttctccacatggccatcgagcccatcttggctgacggggctatcctggacaaaggtcgtgccatgttcttagtggccaagtgccaggtggcttcagcagcttcctacgatcagccgaagaaagcagaagctctggaggctgccatcgagaacctcaatgaagccaagaactattttgcaaaggttgactgcaaagagcgcatcagggacgtcgtttacttccaggccagactctaccataccctggggaagacccaggagaggaaccggtgtgcgatgctcttccggcagctgcatcaggagctgccctctcatggggtacccttgataaaccatctctagagaggacatccctgctgggctgctgtgcagagtataagattttggacttgttcatgtcccctctctccctataaatgatgtatttgtgacaccctatcttgtcaataaacagcattctgatt

SEQ ID NO: 107137 - DNA, 2400 bp, Homo sapiens
  Payload ID: 1030
  Gene Symbol: ANAPC5
  Gene Name: anaphase promoting complex subunit 5
  ENST ID: ENST00000541887
  CDS Start-End: 49-2277
caactggcggcagcgcgccgcgggcccgagacttagtctcgggccgccatggccagcgtccacgagagcctctacttcaatcccatgatgaccaatggggttgtgcacgccaatgtgttcggcatcaaggactgggtgacgccgtacaagatcgcggtgctggtgctgctgaacgagatgagccgcacaggcgagggcgccgtcagcctcatggagcggcggaggctcaaccagctgctcctgcccctgctgcagggcccagatattacactgtcaaaactttacaagttaattgaagagtcttgtccacagctggcaaattcagtgcagatcagaatcaaactgatggctgaaggcgagttgaaggatatggaacagttttttgatgacctttcagattctttctctggaactgaaccagaggttcacaaaacaagtgtagtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcattatctcagctacttaaacaacctccgtgtccaagatgttttcagttcaacacacagtctcctccattattttgatcgtctgattcttaccggagccgaaagcaaaagtaatggggaagagggctatggccggagcttgagatacgccgctctgaatcttgccgccctgcactgccgcttcggtcactatcaacaggcagagctcgccctgcaggaggcaattaggattgcccaggagtccaacgatcacgtgtgtctccagcactgtttgagctggctttatgtgctggggcagaagagatccgatagctatgttctgctggagcattctgtgaagaaggcagtacattttgggttaccgagagcttttgctgggaagacggcaaacaagctgatggatgccctaaaggactccgacctcctgcactggaaacacagcctgtcagagctcatcgatatcagcatcgcacagaaaacggccatctggaggctgtatggccgcagcaccatggcactgcaacaggcccagatgttgctgagcatgaacagcctggaggcggtgaatgcgggcgtgcagcagaacaacacagagtcctttgctgtcgcactctgccacctcgcagagctacacgcggagcagggctgttttgctgcagcttctgaagtgttaaagcacttgaaggaacgatttccgcctaatagtcagcacgcccagttatggatgctatgtgatcaaaaaatacagtttgacagagcaatgaatgatggcaaatatcatttggctgattcacttgttacaggaatcacagctctcaatagcatagagggtgtttataggaaagcggttgtattacaagctcagaaccaaatgtcagaggcacataagcttttacaaaaattgttggttcattgtcagaaactgaagaacacagaaatggtgatcagtgtcctactgtccgtggcagagctgtactggcgatcttcctcccctaccatcgcgctgcccatgctcctgcaggctctggccctctccaaggagtaccggttacagtacttggcctctgaaacagtgctgaacttggcttttgcgcagctcattcttggaatcccagaacaggccttaagtcttctccacatggccatcgagcccatcttggctgacggggctatcctggacaaaggtcgtgccatgttcttagtggccaagtgccaggtggcttcagcagcttcctacgatcagccgaagaaagcagaagctctggaggctgccatcgagaacctcaatgaagccaagaactattttgcaaaggttgactgcaaagagcgcatcagggacgtcgtttacttccaggccagactctaccataccctggggaagacccaggagaggaaccggtgtgcgatgctcttccggcagctgcatcaggagctgccctctcatggggtacccttgataaaccatctctagagaggacatccctgctgggctgctgtgcagagtataagattttggacttgttcatgtcccctctctccctataaatgatgtatttgtgacaccctatcttgtcaataaacagcattctgatta

SEQ ID NO: 107138 - DNA, 915 bp, Homo sapiens
  Payload ID: 1030
  Gene Symbol: ANAPC5
  Gene Name: anaphase promoting complex subunit 5
  ENST ID: ENST00000544442
  CDS Start-End: 263-915
ctggcggcagcgcgccgcgggcccgagacttagtctcgggccgccatggccagcgtccacgagagcctctacttcaatcccatgatgaccaatggggttgtgcacgccaatgtgttcggcatcaaggactgggtgacgccgtacaagatcgcggtgctggtgctgctgaacgagatgagccgcacaggcgagggcgccgtcagcctcatggagcggcggaggctcaaccagctgctcctgcccctgctgcagaatcaaactgatggctgaaggcgagttgaaggatatggaacagttttttgatgacctttcagattctttctctggaactgaaccagaggttcacaaaacaagtgtagtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcattatctcagctacttaaacaacctccgtgtccaagatgttttcagttcaacacacagtctcctccattattttgatcgtctgattcttaccggagccgaaagcaaaagtaatggggaagagggctatggccggagcttgagatacgccgctctgaatcttgccgccctgcactgccgcttcggtcacta

SEQ ID NO: 107139 - DNA, 509 bp, Homo sapiens
  Payload ID: 1030
  Gene Symbol: ANAPC5
  Gene Name: anaphase promoting complex subunit 5
  ENST ID: ENST00000536837
  CDS Start-End: 377-509
aagacctgcggacctgggcgtggcggaaggcgcgctgcggcgctgctttctcggttgggtgtttgaaatgggagatagcgtccctgaggaagctgctgcggctttctgggctaggtggtcaagtttccggggaggggagcgcgggaagggccgtggtgaatttgaacacgccggttggctcgaaggcctttgttatgaccgtcagagcagggcctcagatttccttcccagacgttcccgcgttcatgctcggtgatgacctcggggctcctcactcgtgggtccgggcccagatattacactgtcaaaactttacaagttaattgaagagtcttgtccacagctggcaaattcagtgcagatcagaatcaaactgatggctgaaggcgagttgaaggatatggaacagttttttgatgacctttcagattctttctctggaactgaaccagaggttcacaaaacaagtgtagtaggtttgtttctgcgtcacatgatcttggcctaca

SEQ ID NO: 107140 - DNA, 704 bp, Homo sapiens
  Payload ID: 1030
  Gene Symbol: ANAPC5
  Gene Name: anaphase promoting complex subunit 5
  ENST ID: ENST00000539871
  CDS Start-End: 56-704
gtggtgacaactggcggcagcgcgccgcgggcccgagacttagtctcgggccgccatggccagcgtccacgagagcctctacttcaatcccatgatgaccaatggggttgtgcacgccaatgtgttcggcatcaaggactgggtgacgccgtacaagatcgcggtgctggtgctgctgaacgagatgagccgcacaggcgagggcgccgtcagcctcatggagcggcggaggctcaaccagctgctcctgcccctgctgcagagacgggattttgccatgttacccaggctggccgggaactcctggactcaagcaatcctcccgtctggtctcccagagtattgggattacaggagtgagccactgcgcccggccgtcatgtgttatttcattttgcagacacagggcccagatattacactgtcaaaactttacaagttaattgaagagtcttgtccacagctggcaaattcagtgcagatcagaatcaaactgatggctgaaggcgagttgaaggatatggaacagttttttgatgacctttcagattctttctctggaactgaaccagaggttcacaaaacaagtgtagtaggtttgtttctgcgtcacatgatcttggcctacagtaagctttctttcagccaagtgtttaaactgtacactgcccttcagcagtacttccagaatggtgagaaaaaga

SEQ ID NO: 107141 - DNA, 3045 bp, Homo sapiens
  Payload ID: 1031
  Gene Symbol: ANAPC7
  Gene Name: anaphase promoting complex subunit 7
  Uniprot ID: Q9UJX3
  ENST ID: ENST00000455511
  CDS Start-End: 2-1801
gatggaccccggcgacgccgccattttggagtcttccctaaggatcctctaccggcttttcgagtcagtgctgccgccgctgcccgcggctttgcagagcaggatgaatgtgatagaccacgtgcgggacatggcggccgcggggctgcactccaacgtgcggctcctcagcagcttgttacttacaatgagtaataacaaccctgagttattctccccacctcagaagtaccagcttttggtgtatcatgcagattctctctttcatgataaggaatatcggaatgctgtgagtaagtataccatggctttacagcagaagaaagcgctaagtaaaacttcaaaagtgagaccttcaactggaaattctgcatctactccacaaagtcagtgtcttccatctgaaattgaagtgaaatacaaaatggctgaatgttatacaatgctaaaacaagataaagatgccattgctatacttgatgggatcccttcaagacaaagaactcccaaaataaacatgatgctggcaaacctgtacaagaaggctggtcaggagcgcccttcagtcaccagctataaggaggtgctgaggcagtgcccattagcccttgatgccattctaggcttgttgtccctttctgtaaaaggggcagaggtggcatccatgacaatgaatgtgatccaaaccgtgcctaacttggactggctctctgtgtggatcaaagcgtatgcttttgtgcacactggtgacaactcaagagcaatcagtaccatctgttcactagagaaaaaatccttattgcgagataacgtggacctattgggaagcttggcagatctgtacttcagagctggagacaataaaaactctgtcctcaagtttgaacaggcacagatgttggatccttatctgataaaaggaatggatgtatatggctacctactggcacgagaagggcggctagaggatgttgagaaccttggatgccgccttttcaatatctctgatcagcatgcagaaccgtgggtggtttctggctgtcacagcttctatagcaaacgctactcccgggccctctatttaggagccaaggccattcagctgaacagtaatagtgttcaagctctgctacttaagggagcagcacttaggaacatgggcagagtccaagaagcaataatccactttcgggaggccatacggctcgcaccttgtcgcttagattgttatgaaggtcttatcgaatgttacttagcctccaacagtattcgagaagcaatggtaatggctaacaacgtttacaaaactctgggagcaaatgcacagacccttacccttttagccaccgtttgtcttgaagacccagtgacacaggagaaagccaaaacattattagataaagccctgacccaaaggccagattacattaaggctgtggtgaaaaaagcagaactacttagcagagaacagaaatatgaagatggaattgctttgctgaggaacgcactggctaatcagagtgactgtgtcctgcatcggatcctaggagatttccttgtagctgtcaatgagtatcaggaggcaatggaccagtatagtatagcactaagtttggaccccaatgaccagaagtctctagaggggatgcagaagatggagaaggaggagagtcccacggatgccactcaggaggaggatgtggacgacatggaagggagtggggaagaaggggacctggagggcagcgacagtgaggcggcccagtgggctgaccaggagcagtggttcggcatgcagtgagggggcggcagctccatggccgcagtggcctgccctgctctgagcacttccgtggactgaaggaaccgtaggagcctgctctcagaaggacaatgattcagcatgtgattgcagcaggggtctctgccccctcgctcccaattcctagtcgtgacttcatttctaaaacagagcctgaccaaccttccatgtatctccatcctcccctgctccagccagggaggactgagggagtgccccgagacccacgcacatgttggggcttctgggccaagagtactttttatataactaatttctaaatccaaaagctcaaggaatagacagtgttctgtgacatggattggtttgaaggagttacccaccatcccagcacgataatgtcatctcccaagttggatggcagcacgatctggccctagggagcttcctgttcccagaagtcattgtcctgggctatccagatgtccctagtaaatcttgcttccttctgcaatgttagtaatgccttaagctgacagttgctattttgcagaacagttttcctctttgcttagctagtaacttgcctctgagcctgggctgatctgagaaacaggtgtgacaagagcatgaaccagaggtgcacctggggcagttccctaataaaactggtttgtacagtcatggtgttggggtgatcagaatggaagcccttttcaaaatagactcttagtatttttgtcttattcgcaatgcattgattcagccccagaattatttgccagaaatagactttcttcccctggtgttgggagccaggagggttggaaagctcaggaaccctgagctggttcatctgtttgcatattgggtaggttaatttccctggagcctgagagtctttggccagatttcagctgcgtctgcctggctcttttgctgcagctgtgagattggggtctggttccagcagtctgtcactggtcagcctgagtatcacaccctgagctctggggctgggagtttcttcccacaccctctcccttgtgccttaagttgcgatggctctgagtatacaattaatcggaggtgaggggtgggtgtcacagctaatcccaaattcaaaaattagtccaaggtgctgcaaaatataaatttgatgtcagtagaaagtcgtatcctaaaatgtaaaaactgtaagtgtacagtagttaatgagctcagaacatctgataactgcaatttaaaatgggcaaaaagtt

SEQ ID NO: 107142 - DNA, 2200 bp, Homo sapiens
  Payload ID: 1031
  Gene Symbol: ANAPC7
  Gene Name: anaphase promoting complex subunit 7
  Uniprot ID: Q9UJX3
  ENST ID: ENST00000450008
  CDS Start-End: 2-1615
gatggaccccggcgacgccgccattttggagtcttccctaaggatcctctaccggcttttcgagtcagtgctgccgccgctgcccgcggctttgcagagcaggatgaatgtgatagaccacgtgcgggacatggcggccgcggggctgcactccaacgtgcggctcctcagcagcttgttacttacaatgagtaataacaaccctgagttattctccccacctcagaagtaccagcttttggtgtatcatgcagattctctctttcatgataaggaatatcggaatgctgtgagtaagtataccatggctttacagcagaagaaagcgctaagtaaaacttcaaaagtgagaccttcaactggaaattctgcatctactccacaaagtcagtgtcttccatctgaaattgaagtgaaatacaaaatggctgaatgttatacaatgctaaaacaagataaagatgccattgctatacttgatgggatcccttcaagacaaagaactcccaaaataaacatgatgctggcaaacctgtacaagaaggctggtcaggagcgcccttcagtcaccagctataaggaggtgctgaggcagtgcccattagcccttgatgccattctaggcttgttgtccctttctgtaaaaggggcagaggtggcatccatgacaatgaatgtgatccaaaccgtgcctaacttggactggctctctgtgtggatcaaagcgtatgcttttgtgcacactggtgacaactcaagagcaatcagtaccatctgttcactagagaaaaaatccttattgcgagataacgtggacctattgggaagcttggcagatctgtacttcagagctggagacaataaaaactctgtcctcaagtttgaacaggcacagatgttggatccttatctgataaaaggaatggatgtatatggctacctactggcacgagaagggcggctagaggatgttgagaaccttggatgccgccttttcaatatctctgatcagcatgcagaaccgtgggtggtttctggctgtcacagcttctatagcaaacgctactcccgggccctctatttaggagccaaggccattcagctgaacagtaatagtgttcaagctctgctacttaagggagcagcacttaggaacatgggcagagtccaagaagcaataatccactttcgggaggccatacggctcgcaccttgtcgcttagattgttatgaaggtcttatcgaatgttacttagcctccaacagtattcgagaagcaatggtaatggctaacaacgtttacaaaactctgggagcaaatgcacagacccttacccttttagccaccgtttgtcttgaagacccagtgacacaggagaaagccaaaacattattagataaagccctgacccaaaggccagattacattaaggctgtggtgaaaaaagcagaactacttagcagagaacagaaatatgaagatggaattgctttgctgaggaacgcactggctaatcagagtgactgtgtcctgcatcggatcctaggagatttccttgtagctgtcaatgagtatcaggaggcaatggaccagtatagtatagcactaaggtaggcactagcctcccttgggggaaggccactgaggagggtagaggaggcagtgagctgtgtcacaggagttatggaaacacacacacactttgtgtccatggttgaaagcagaataataatagtaatggtagaagagttatttgtgaattcatgacttctaaaaattttttcttaaaatatattaacaacattagagaactgtttcactcataaccatcccacaccactataacatctgtgttcatttgtatagctcatcttctgtccttgcccacacacacatatttttatagggctgtacctagtatatattttatattcttctttttcaaatcaaagtattgtaagtactttcccatgtttctatctactgtagtcattaagaacttgaggtctgaagttttgaatactaccttcaccacctgtgatcttgggcaagttactaacacatttccttgtctatatctagctaccttattagatattaaatgatcgaatgagggttaaatgattatttcatgtaaagctcttagccctgtgcctggtacatagtaaatgctaaataaatagtggtattcttactgtt

SEQ ID NO: 107143 - DNA, 910 bp, Homo sapiens
  Payload ID: 1031
  Gene Symbol: ANAPC7
  Gene Name: anaphase promoting complex subunit 7
  ENST ID: ENST00000552087
  CDS Start-End: 1-448
gctacttaagggagcagcacttaggaacatgggcagagtccaagaagcaataatccactttcgggaggccatacggctcgcaccttgtcgcttagattgttatgaaggcagagaacagaaatatgaagatggaattgctttgctgaggaacgcactggctaatcagagtgactgtgtcctgcatcggatcctaggagatttccttgtagctgtcaatgagtatcaggaggcaatggaccagtatagtatagcactaagtttggaccccaatgaccagaagtctctagaggggatgcagaagatggagaaggaggagagtcccacggatgccactcaggaggaggatgtggacgacatggaagggagtggggaagaaggggacctggagggcagcgacagtgaggcggcccagtgggctgaccaggagcagtggttcggcatgcagtgagggggcggcagctccatggccgcagtggcctgccctgctctgagcacttccgtggactgaaggaaccgtaggagcctgctctcagaaggacaatgattcagcatgtgattgcagcaggggtctctgccccctcgctcccaattcctagtcgtgacttcatttctaaaacagagcctgaccaaccttccatgtatctccatcctcccctgctccagccagggaggactgagggagtgccccgagacccacgcacatgttggggcttctgggccaagagtactttttatataactaatttctaaatccaaaagctcaaggaatagacagtgttctgtgacatggattggtttgaaggagttacccaccatcccagcacgataatgtcatctcccaagttggatggcagcacgatctggccctagggagcttcctgttcccagaagtcattgtcctgggctatcc

SEQ ID NO: 107144 - DNA, 579 bp, Homo sapiens
  Payload ID: 1031
  Gene Symbol: ANAPC7
  Gene Name: anaphase promoting complex subunit 7
  ENST ID: ENST00000552170
  CDS Start-End: 1-163
agtgctgccgccgctgcccgcggctttgcagagcaggatgaatgtgatagaccacgtgcgggacatggcggccgcggggctgcactccaacgtgcggctcctcagcagcttgttacttacaatgagtaataacaaccctgtcttccatctgaaattgaagtgaaatacaaaatggctgaatgttatacaatgctaaaacaagataaagatgccattgctatacttgatgggatcccttcaagacaaagaactcccaaaataaacatgatgctggcaaacctgtacaagaaggctggtcaggagcgcccttcagtcaccagctataaggaggtgctgaggcagtgcccattagcccttgatgccattctaggcttgttgtccctttctgtaaaaggggcagaggtggcatccatgacaatgaatgtgatccaaaccgtgcctaacttggactggctctctgtgtggatcaaagcgtatgcttttgtgcacactggtgacaactcaagagcaatcagtaccatctgttcactagagaaaaaatccttattgcgagataacgtggacctattgggaagcttg

SEQ ID NO: 107145 - DNA, 6220 bp, Homo sapiens
  Payload ID: 1032
  Gene Symbol: ALK
  Gene Name: anaplastic lymphoma receptor tyrosine kinase
  Uniprot ID: Q9UM73
  ENST ID: ENST00000389048
  CDS Start-End: 908-5770
gggggcggcagcggtggtagcagctggtacctcccgccgcctctgttcggagggtcgcggggcaccgaggtgctttccggccgccctctggtcggccacccaaagccgcgggcgctgatgatgggtgaggagggggcggcaagatttcgggcgcccctgccctgaacgccctcagctgctgccgccggggccgctccagtgcctgcgaactctgaggagccgaggcgccggtgagagcaaggacgctgcaaacttgcgcagcgcgggggctgggattcacgcccagaagttcagcaggcagacagtccgaagccttcccgcagcggagagatagcttgagggtgcgcaagacggcagcctccgccctcggttcccgcccagaccgggcagaagagcttggaggagccaaaaggaacgcaaaaggcggccaggacagcgtgcagcagctgggagccgccgttctcagccttaaaagttgcagagattggaggctgccccgagaggggacagaccccagctccgactgcggggggcaggagaggacggtacccaactgccacctcccttcaaccatagtagttcctctgtaccgagcgcagcgagctacagacgggggcgcggcactcggcgcggagagcgggaggctcaaggtcccagccagtgagcccagtgtgcttgagtgtctctggactcgcccctgagcttccaggtctgtttcatttagactcctgctcgcctccgtgcagttgggggaaagcaagagacttgcgcgcacgcacagtcctctggagatcaggtggaaggagccgctgggtaccaaggactgttcagagcctcttcccatctcggggagagcgaagggtgaggctgggcccggagagcagtgtaaacggcctcctccggcgggatgggagccatcgggctcctgtggctcctgccgctgctgctttccacggcagctgtgggctccgggatggggaccggccagcgcgcgggctccccagctgcggggccgccgctgcagccccgggagccactcagctactcgcgcctgcagaggaagagtctggcagttgacttcgtggtgccctcgctcttccgtgtctacgcccgggacctactgctgccaccatcctcctcggagctgaaggctggcaggcccgaggcccgcggctcgctagctctggactgcgccccgctgctcaggttgctggggccggcgccgggggtctcctggaccgccggttcaccagccccggcagaggcccggacgctgtccagggtgctgaagggcggctccgtgcgcaagctccggcgtgccaagcagttggtgctggagctgggcgaggaggcgatcttggagggttgcgtcgggccccccggggaggcggctgtggggctgctccagttcaatctcagcgagctgttcagttggtggattcgccaaggcgaagggcgactgaggatccgcctgatgcccgagaagaaggcgtcggaagtgggcagagagggaaggctgtccgcggcaattcgcgcctcccagccccgccttctcttccagatcttcgggactggtcatagctccttggaatcaccaacaaacatgccttctccttctcctgattattttacatggaatctcacctggataatgaaagactccttccctttcctgtctcatcgcagccgatatggtctggagtgcagctttgacttcccctgtgagctggagtattcccctccactgcatgacctcaggaaccagagctggtcctggcgccgcatcccctccgaggaggcctcccagatggacttgctggatgggcctggggcagagcgttctaaggagatgcccagaggctcctttctccttctcaacacctcagctgactccaagcacaccatcctgagtccgtggatgaggagcagcagtgagcactgcacactggccgtctcggtgcacaggcacctgcagccctctggaaggtacattgcccagctgctgccccacaacgaggctgcaagagagatcctcctgatgcccactccagggaagcatggttggacagtgctccagggaagaatcgggcgtccagacaacccatttcgagtggccctggaatacatctccagtggaaaccgcagcttgtctgcagtggacttctttgccctgaagaactgcagtgaaggaacatccccaggctccaagatggccctgcagagctccttcacttgttggaatgggacagtcctccagcttgggcaggcctgtgacttccaccaggactgtgcccagggagaagatgagagccagatgtgccggaaactgcctgtgggtttttactgcaactttgaagatggcttctgtggctggacccaaggcacactgtcaccccacactcctcaatggcaggtcaggaccctaaaggatgcccggttccaggaccaccaagaccatgctctattgctcagtaccactgatgtccccgcttctgaaagtgctacagtgaccagtgctacgtttcctgcaccgatcaagagctctccatgtgagctccgaatgtcctggctcattcgtggagtcttgaggggaaacgtgtccttggtgctagtggagaacaaaaccgggaaggagcaaggcaggatggtctggcatgtcgccgcctatgaaggcttgagcctgtggcagtggatggtgttgcctctcctcgatgtgtctgacaggttctggctgcagatggtcgcatggtggggacaaggatccagagccatcgtggcttttgacaatatctccatcagcctggactgctacctcaccattagcggagaggacaagatcctgcagaatacagcacccaaatcaagaaacctgtttgagagaaacccaaacaaggagctgaaacccggggaaaattcaccaagacagacccccatctttgaccctacagttcattggctgttcaccacatgtggggccagcgggccccatggccccacccaggcacagtgcaacaacgcctaccagaactccaacctgagcgtggaggtggggagcgagggccccctgaaaggcatccagatctggaaggtgccagccaccgacacctacagcatctcgggctacggagctgctggcgggaaaggcgggaagaacaccatgatgcggtcccacggcgtgtctgtgctgggcatcttcaacctggagaaggatgacatgctgtacatcctggttgggcagcagggagaggacgcctgccccagtacaaaccagttaatccagaaagtctgcattggagagaacaatgtgatagaagaagaaatccgtgtgaacagaagcgtgcatgagtgggcaggaggcggaggaggagggggtggagccacctacgtatttaagatgaaggatggagtgccggtgcccctgatcattgcagccggaggtggtggcagggcctacggggccaagacagacacgttccacccagagagactggagaataactcctcggttctagggctaaacggcaattccggagccgcaggtggtggaggtggctggaatgataacacttccttgctctgggccggaaaatctttgcaggagggtgccaccggaggacattcctgcccccaggccatgaagaagtgggggtgggagacaagagggggtttcggagggggtggaggggggtgctcctcaggtggaggaggcggaggatatataggcggcaatgcagcctcaaacaatgaccccgaaatggatggggaagatggggtttccttcatcagtccactgggcatcctgtacaccccagctttaaaagtgatggaaggccacggggaagtgaatattaagcattatctaaactgcagtcactgtgaggtagacgaatgtcacatggaccctgaaagccacaaggtcatctgcttctgtgaccacgggacggtgctggctgaggatggcgtctcctgcattgtgtcacccaccccggagccacacctgccactctcgctgatcctctctgtggtgacctctgccctcgtggccgccctggtcctggctttctccggcatcatgattgtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagagatctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctgagctcggtcgcacactcacttctcttccttgggatccctaagaccgtggaggagagagaggcaatggctccttcacaaaccagagaccaaatgtcacgttttgttttgtgccaacctattttgaagtaccaccaaaaaagctgtattttgaaaatgctttagaaaggttttgagcatgggttcatcctattctttcgaaagaagaaaatatcataaaaatgagtgataaatacaaggcccagatgtggttgcataaggtttttatgcatgtttgttgtatacttccttatgcttctttcaaattgtgtgtgctctgcttcaatgtagtcagaattagctgcttctatgtttcatagttggggtcatagatgtttccttgccttgttgatgtggacatgagccatttgaggggagagggaacggaaataaaggagttatttgtaatgactaa

SEQ ID NO: 107146 - DNA, 577 bp, Homo sapiens
  Payload ID: 1032
  Gene Symbol: ALK
  Gene Name: anaplastic lymphoma receptor tyrosine kinase
  ENST ID: ENST00000453137
  CDS Start-End: 1-459
tcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagtctctcttggaagcagttgttttgcttcaccttctgcctgaggccttcctgggagaaatcgaccatgaattctagcacccagtccacgcaccagtatctgagaaagacactctcctgccccctgagacacttcctcacccaagtgcctgagcaacatcctcacagctccagccactctcctgcaaatggaactcctgtggagcctgctgtggttcttcccacctgctcaccagcaagattctgggtttaggctcagcccgggacccctgctgcccatgtttacagaatgcctttatacattgtagctgctgaaaatgtaactttgtatcctgttcctcccagtttaagatttgcccagactcagctca

SEQ ID NO: 107147 - DNA, 2190 bp, Homo sapiens
  Payload ID: 1032
  Gene Symbol: ALK
  Gene Name: anaplastic lymphoma receptor tyrosine kinase
  ENST ID: ENST00000431873
  CDS Start-End: 1-1743
atggttactacgtgctcggcaatttacacatttcaattcattcgatcctcagtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagagatctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctgagctcggtcgcacactcacttctcttccttgggatccctaagaccgtggaggagagagaggcaatggctccttcacaaaccagagaccaaatgtcacgttttgttttgtgccaacctattttgaagtaccaccaaaaaagctgtattttgaaaatgctttagaaaggttttgagcatgggttcatcctattctttcgaaagaagaaaatatcataaaaatgagtgataaatacaaggcccagatgtggttgcataaggtttttatgcatgtttgttgtatacttccttatgcttctttcaaattgtgtgtgctctgcttcaatgtagtcagaattagctgcttctatgtttcatagttggggtcatagatgtttccttgccttgttgatgtggacatgagccatttgaggggagagggaacggaaataaaggagttatttgtaatgac

SEQ ID NO: 107148 - DNA, 4646 bp, Homo sapiens
  Payload ID: 1032
  Gene Symbol: ALK
  Gene Name: anaplastic lymphoma receptor tyrosine kinase
  ENST ID: ENST00000618119
  CDS Start-End: 468-4199
caggtcatagctccttggaatcaccaacaaacatgccttctccttctcctgattattttacatggaatctcacctggataatgaaagactccttccctttcctgtctcatcgcagccgatatggtctggagtgcagctttgacttcccctgtgagctggagtattcccctccactgcatgacctcaggaaccagagctggtcctggcgccgcatcccctccgaggaggcctcccagatggacttgctggatgggcctggggcagagcgttctaaggagatgcccagaggctcctttctccttctcaacacctcagctgactccaagcacaccatcctgagtccgtggatgaggagcagcagtgagcactgcacactggccgtctcggtgcacaggcacctgcagccctctggaaggtacattgcccagctgctgccccacaacgaggctgcaagagagatcctcctgatgcccactccagggaagcatggttggacagtgctccagggaagaatcgggcgtccagacaacccatttcgagtggccctggaatacatctccagtggaaaccgcagcttgtctgcagtggacttctttgccctgaagaactgcagtgaaggaacatccccaggctccaagatggccctgcagagctccttcacttgttggaatgggacagtcctccagcttgggcaggcctgtgacttccaccaggactgtgcccagggagaagatgagagccagatgtgccggaaactgcctgtgggtttttactgcaactttgaagatggcttctgtggctggacccaaggcacactgtcaccccacactcctcaatggcaggtcaggaccctaaaggatgcccggttccaggaccaccaagaccatgctctattgctcagtaccactgatgtccccgcttctgaaagtgctacagtgaccagtgctacgtttcctgcaccgatcaagagctctccatgtgagctccgaatgtcctggctcattcgtggagtcttgaggggaaacgtgtccttggtgctagtggagaacaaaaccgggaaggagcaaggcaggatggtctggcatgtcgccgcctatgaaggcttgagcctgtggcagtggatggtgttgcctctcctcgatgtgtctgacaggttctggctgcagatggtcgcatggtggggacaaggatccagagccatcgtggcttttgacaatatctccatcagcctggactgctacctcaccattagcggagaggacaagatcctgcagaatacagcacccaaatcaagaaacctgtttgagagaaacccaaacaaggagctgaaacccggggaaaattcaccaagacagacccccatctttgaccctacagttcattggctgttcaccacatgtggggccagcgggccccatggccccacccaggcacagtgcaacaacgcctaccagaactccaacctgagcgtggaggtggggagcgagggccccctgaaaggcatccagatctggaaggtgccagccaccgacacctacagcatctcgggctacggagctgctggcgggaaaggcgggaagaacaccatgatgcggtcccacggcgtgtctgtgctgggcatcttcaacctggagaaggatgacatgctgtacatcctggttgggcagcagggagaggacgcctgccccagtacaaaccagttaatccagaaagtctgcattggagagaacaatgtgatagaagaagaaatccgtgtgaacagaagcgtgcatgagtgggcaggaggcggaggaggagggggtggagccacctacgtatttaagatgaaggatggagtgccggtgcccctgatcattgcagccggaggtggtggcagggcctacggggccaagacagacacgttccacccagagagactggagaataactcctcggttctagggctaaacggcaattccggagccgcaggtggtggaggtggctggaatgataacacttccttgctctgggccggaaaatctttgcaggagggtgccaccggaggacattcctgcccccaggccatgaagaagtgggggtgggagacaagagggggtttcggagggggtggaggggggtgctcctcaggtggaggaggcggaggatatataggcggcaatgcagcctcaaacaatgaccccgaaatggatggggaagatggggtttccttcatcagtccactgggcatcctgtacaccccagctttaaaagtgatggaaggccacggggaagtgaatattaagcattatctaaactgcagtcactgtgaggtagacgaatgtcacatggaccctgaaagccacaaggtcatctgcttctgtgaccacgggacggtgctggctgaggatggcgtctcctgcattgtgtcacccaccccggagccacacctgccactctcgctgatcctctctgtggtgacctctgccctcgtggccgccctggtcctggctttctccggcatcatgattgtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagagatctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctgagctcggtcgcacactcacttctcttccttgggatccctaagaccgtggaggagagagaggcaatggctccttcacaaaccagagaccaaatgtcacgttttgttttgtgccaacctattttgaagtaccaccaaaaaagctgtattttgaaaatgctttagaaaggttttgagcatgggttcatcctattctttcgaaagaagaaaatatcataaaaatgagtgataaatacaaggcccagatgtggttgcataaggtttttatgcatgtttgttgtatacttccttatgcttctttcaaattgtgtgtgctctgcttcaatgtagtcagaattagctgcttctatgtttcatagttggggtcatagatgtttccttgccttgttgatgtggacatgagccatttgaggggagagggaacggaaataaaggagttatttgtaatgac

SEQ ID NO: 107149 - DNA, 1695 bp, Homo sapiens
  Payload ID: 1033
  Gene Symbol: AUP1
  Gene Name: ancient ubiquitous protein 1
  Uniprot ID: Q9Y679
  ENST ID: ENST00000377526
  CDS Start-End: 311-1543
acagtaggacgcggggcacgccggtacctgaagtccttcagaagtgcacgccgggaccaggattccgggaggccgactcctccctgccccacgaatgccgggaattgtggtctccgccggacgcgagttgtgagacggcccaaggggccgcggggtatgctgggaccgctagcccttccggcgcgcctcaggacttcgggtcccctcaccccgggcggatgcccaaagactccgccttcccaagagcccctgcggccgggcgcgaaaatggcggcggcggcgacggccgggcgctcctgaagcagcagttatggagcttccctcagggccggggccggagcggctctttgactcgcaccggcttccgggtgactgcttcctactgctcgtgctgctgctctacgcgccagtcgggttctgcctcctcgtcctgcgcctctttctcgggatccacgtcttcctggtcagctgcgcgctgccagacagcgtccttcgcagattcgtagtgcggaccatgtgtgcggtgctagggctcgtggcccggcaggaggactccggactccgggatcacagtgtcagggtcctcatttccaaccatgtgacacctttcgaccacaacatagtcaatttgcttaccacctgtagcacccctctactcaatagtccccccagctttgtgtgctggtctcggggcttcatggagatgaatgggcggggggagttggtggagtcactcaagagattctgtgcttccacgaggcttccccccactcctctgctgctattccctgaggaagaggccaccaatggccgggaggggctcctgcgcttcagttcctggccattttctatccaagatgtggtacaacctcttaccctgcaagttcagagacccctggtctctgtgacggtgtcagatgcctcctgggtctcagaactgctgtggtcacttttcgtccctttcacggtgtatcaagtaaggtggcttcgtcctgttcatcgccaactaggggaagcgaatgaggagtttgcactccgtgtacaacagctggtggccaaggaattgggccagacagggacacggctcactccagctgacaaagcagagcacatgaagcgacaaagacaccccagattgcgcccccagtcagcccagtcttctttccctccctcccctggtccttctcctgatgtgcaactggcaactctggctcagagagtcaaggaagttttgccccatgtgccattgggtgtcatccagagagacctggccaagactggctgtgtagacttgactatcactaatctgcttgagggggccgtagctttcatgcctgaagacatcaccaagggaactcagtccctacccacagcctctgcctccaagtttcccagctctggcccggtgacccctcagccaacagccctaacatttgccaagtcttcctgggcccggcaggagagcctgcaggagcgcaagcaagcactatatgaatacgcaagaaggagattcacagagagacgagcccaggaggctgactgagctcaaaggaacaggatggcacccagagccgcaggacggagactgggggcagccctcacccaactcacaacaggctggatgggtgggtggtaaaaagggaaggatgaggctcccccaatgtcacattaaattcatggttttcattcaaggca

SEQ ID NO: 107150 - DNA, 1581 bp, Homo sapiens
  Payload ID: 1033
  Gene Symbol: AUP1
  Gene Name: ancient ubiquitous protein 1
  Uniprot ID: Q9Y679
  ENST ID: ENST00000425118
  CDS Start-End: 132-1253
ggcgcgcctcaggacttcgggtcccctcaccccgggcggatgcccaaagactccgccttcccaagagcccctgcggccgggcgcgaaaatggcggcggcggcgacggccgggcgctcctgaagcagcagttatggagcttccctcagggccggggccggagcggctctttgactcgcaccggcttccgggtgactgcttcctactgctcgtgctgctgctctacgcgccagtcgggttctgcctcctcgtcctgcgcctctttctcgggatccacgtcttcctggtcagctgcgcgctgccagacagcgtccttcgcagattcgtagtgcggaccatgtgtgcggtgctagggctcgtggcccggcaggaggactccggactccgggatcacagtgtcagggtcctcatttccaaccatgtgacacctttcgaccacaacatagtcaatttgcttaccacctgtagcacccctctactcaatagtccccccagctttgtgtgctggtctcggggcttcatggagatgaatgggcggggggagttggtggagtcactcaagagattctgtgcttccacgaggcttccccccactcctctgctgctattccctgaggaagaggccaccaatggccgggaggggctcctgcgcttcagttcctggccattttctatccaagatgtggtacaacctcttaccctgcaagttcagagacccctggtctctgtgacggtgtcagatgcctcctgggtctcagaactgctgtggtcacttttcgtccctttcacggtgtatcaagtaaggtggcttcgtcctgttcatcgccaactaggggaagcgaatgaggagtttgcactccgtgtacaacagctggtggccaaggaattgggccagacagggacacggctcactccagctgacaaagcagagcacatgaagcgacaaagacaccccagattgcgcccccagtcagcccagtcttctttccctccctcccctggtccttctcctgatgtgcaactggcaactctggctcagagagtcaaggaagttttgccccatgtgccattgggtgtcatccagagagacctggccaagactggctgtgtagacttgactatcactaatctgcttgagggggccgtagctttcatgcctgaagacatcaccaagggaactcagtccctacccacagcctctgcctccaaggcattcgatgcgtgtttaatgatgatgactccgcaagccctctgacattgtgatcacctcagtttcccagctctggcccggtgacccctcagccaacagccctaacatttgccaagtcttcctgggcccggcaggagagcctgcaggagcgcaagcaagcactatatgaatacgcaagaaggagattcacagagagacgagcccaggaggctgactgagctcaaaggaacaggatggcacccagagccgcaggacggagactgggggcagccctcacccaactcacaacaggctggatgggtgggtggtaaaaagggaaggatgaggctcccccaatgtcacattaaattcatggttttcattcaaggcatct

SEQ ID NO: 107151 - DNA, 10065 bp, Homo sapiens
  Payload ID: 1034
  Gene Symbol: AR
  Gene Name: androgen receptor
  ENST ID: ENST00000374690
  CDS Start-End: 525-3287
gcggagagaaccctctgttttcccccactctctctccacctcctcctgccttccccaccccgagtgcggagccagagatcaaaagatgaaaaggcagtcaggtcttcagtagccaaaaaacaaaacaaacaaaaacaaaaaagccgaaataaaagaaaaagataataactcagttcttatttgcacctacttcagtggacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcgtttggagactgccagggaccatgttttgcccattgactattactttccaccccagaagacctgcctgatctgtggagatgaagcttctgggtgtcactatggagctctcacatgtggaagctgcaaggtcttcttcaaaagagccgctgaagggaaacagaagtacctgtgcgccagcagaaatgattgcactattgataaattccgaaggaaaaattgtccatcttgtcgtcttcggaaatgttatgaagcagggatgactctgggagcccggaagctgaagaaacttggtaatctgaaactacaggaggaaggagaggcttccagcaccaccagccccactgaggagacaacccagaagctgacagtgtcacacattgaaggctatgaatgtcagcccatctttctgaatgtcctggaagccattgagccaggtgtagtgtgtgctggacacgacaacaaccagcccgactcctttgcagccttgctctctagcctcaatgaactgggagagagacagcttgtacacgtggtcaagtgggccaaggccttgcctggcttccgcaacttacacgtggacgaccagatggctgtcattcagtactcctggatggggctcatggtgtttgccatgggctggcgatccttcaccaatgtcaactccaggatgctctacttcgcccctgatctggttttcaatgagtaccgcatgcacaagtcccggatgtacagccagtgtgtccgaatgaggcacctctctcaagagtttggatggctccaaatcaccccccaggaattcctgtgcatgaaagcactgctactcttcagcattattccagtggatgggctgaaaaatcaaaaattctttgatgaacttcgaatgaactacatcaaggaactcgatcgtatcattgcatgcaaaagaaaaaatcccacatcctgctcaagacgcttctaccagctcaccaagctcctggactccgtgcagcctattgcgagagagctgcatcagttcacttttgacctgctaatcaagtcacacatggtgagcgtggactttccggaaatgatggcagagatcatctctgtgcaagtgcccaagatcctttctgggaaagtcaagcccatctatttccacacccagtgaagcattggaaaccctatttccccaccccagctcatgccccctttcagatgtcttctgcctgttataactctgcactactcctctgcagtgccttggggaatttcctctattgatgtacagtctgtcatgaacatgttcctgaattctatttgctgggctttttttttctctttctctcctttctttttcttcttccctccctatctaaccctcccatggcaccttcagactttgcttcccattgtggctcctatctgtgttttgaatggtgttgtatgcctttaaatctgtgatgatcctcatatggcccagtgtcaagttgtgcttgtttacagcactactctgtgccagccacacaaacgtttacttatcttatgccacgggaagtttagagagctaagattatctggggaaatcaaaacaaaaacaagcaaacaaaaaaaaaaagcaaaaacaaaacaaaaaataagccaaaaaaccttgctagtgttttttcctcaaaaataaataaataaataaataaatacgtacatacatacacacatacatacaaacatatagaaatccccaaagaggccaatagtgacgagaaggtgaaaattgcaggcccatggggagttactgattttttcatctcctccctccacgggagactttattttctgccaatggctattgccattagagggcagagtgaccccagagctgagttgggcaggggggtggacagagaggagaggacaaggagggcaatggagcatcagtacctgcccacagccttggtccctgggggctagactgctcaactgtggagcaattcattatactgaaaatgtgcttgttgttgaaaatttgtctgcatgttaatgcctcacccccaaacccttttctctctcactctctgcctccaacttcagattgactttcaatagtttttctaagacctttgaactgaatgttctcttcagccaaaacttggcgacttccacagaaaagtctgaccactgagaagaaggagagcagagatttaaccctttgtaaggccccatttggatccaggtctgctttctcatgtgtgagtcagggaggagctggagccagaggagaagaaaatgatagcttggctgttctcctgcttaggacactgactgaatagttaaactctcactgccactaccttttccccacctttaaaagacctgaatgaagttttctgccaaactccgtgaagccacaagcaccttatgtcctcccttcagtgttttgtgggcctgaatttcatcacactgcatttcagccatggtcatcaagcctgtttgcttcttttgggcatgttcacagattctctgttaagagcccccaccaccaagaaggttagcaggccaacagctctgacatctatctgtagatgccagtagtcacaaagatttcttaccaactctcagatcgctggagcccttagacaaactggaaagaaggcatcaaagggatcaggcaagctgggcgtcttgcccttgtcccccagagatgataccctcccagcaagtggagaagttctcacttccttctttagagcagctaaaggggctacccagatcagggttgaagagaaaactcaattaccagggtgggaagaatgaaggcactagaaccagaaaccctgcaaatgctcttcttgtcacccagcatatccacctgcagaagtcatgagaagagagaaggaacaaagaggagactctgactactgaattaaaatcttcagcggcaaagcctaaagccagatggacaccatctggtgagtttactcatcatcctcctctgctgctgattctgggctctgacattgcccatactcactcagattccccacctttgttgctgcctcttagtcagagggaggccaaaccattgagactttctacagaaccatggcttctttcggaaaggtctggttggtgtggctccaatactttgccacccatgaactcagggtgtgccctgggacactggttttatatagtcttttggcacacctgtgttctgttgacttcgttcttcaagcccaagtgcaagggaaaatgtccacctactttctcatcttggcctctgcctccttacttagctcttaatctcatctgttgaactcaagaaatcaagggccagtcatcaagctgcccattttaattgattcactctgtttgttgagaggatagtttctgagtgacatgatatgatccacaagggtttccttccctgatttctgcattgatattaatagccaaacgaacttcaaaacagctttaaataacaagggagaggggaacctaagatgagtaatatgccaatccaagactgctggagaaaactaaagctgacaggttccctttttggggtgggatagacatgttctggttttctttattattacacaatctggctcatgtacaggatcacttttagctgttttaaacagaaaaaaatatccaccactcttttcagttacactaggttacattttaataggtcctttacatctgttttggaatgattttcatcttttgtgatacacagattgaattatatcattttcatatctctccttgtaaatactagaagctctcctttacatttctctatcaaatttttcatctttatgggtttcccaattgtgactcttgtcttcatgaatatatgtttttcatttgcaaaagccaaaaatcagtgaaacagcagtgtaattaaaagcaacaactggattactccaaatttccaaatgacaaaactagggaaaaatagcctacacaagcctttaggcctactctttctgtgcttgggtttgagtgaacaaaggagattttagcttggctctgttctcccatggatgaaaggaggaggattttttttttcttttggccattgatgttctagccaatgtaattgacagaagtctcattttgcatgcgctctgctctacaaacagagttggtatggttggtatactgtactcacctgtgagggactggccactcagacccacttagctggtgagctagaagatgaggatcactcactggaaaagtcacaaggaccatctccaaacaagttggcagtgctcgatgtggacgaagagtgaggaagagaaaaagaaggagcaccagggagaaggctccgtctgtgctgggcagcagacagctgccaggatcacgaactctgtagtcaaagaaaagagtcgtgtggcagtttcagctctcgttcattgggcagctcgcctaggcccagcctctgagctgacatgggagttgttggattctttgtttcatagctttttctatgccataggcaatattgttgttcttggaaagtttattatttttttaactcccttactctgagaaagggatattttgaaggactgtcatatatctttgaaaaaagaaaatctgtaatacatatatttttatgtatgttcactggcactaaaaaatatagagagcttcattctgtcctttgggtagttgctgaggtaattgtccaggttgaaaaataatgtgctgatgctagagtccctctctgtccatactctacttctaaatacatataggcatacatagcaagttttatttgacttgtactttaagagaaaatatgtccaccatccacatgatgcacaaatgagctaacattgagcttcaagtagcttctaagtgtttgtttcattaggcacagcacagatgtggcctttccccccttctctcccttgatatctggcagggcataaaggcccaggccacttcctctgccccttcccagccctgcaccaaagctgcatttcaggagactctctccagacagcccagtaactacccgagcatggcccctgcatagccctggaaaaataagaggctgactgtctacgaattatcttgtgccagttgcccaggtgagagggcactgggccaagggagtggttttcatgtttgacccactacaaggggtcatgggaatcaggaatgccaaagcaccagatcaaatccaaaacttaaagtcaaaataagccattcagcatgttcagtttcttggaaaaggaagtttctacccctgatgcctttgtaggcagatctgttctcaccattaatctttttgaaaatcttttaaagcagtttttaaaaagagagatgaaagcatcacattatataaccaaagattacattgtacctgctaagataccaaaattcataagggcagggggggagcaagcattagtgcctctttgataagctgtccaaagacagactaaaggactctgctggtgactgacttataagagctttgtgggtttttttttccctaataatatacatgtttagaagaattgaaaataatttcgggaaaatgggattatgggtccttcactaagtgattttataagcagaactggctttccttttctctagtagttgctgagcaaattgttgaagctccatcattgcatggttggaaatggagctgttcttagccactgtgtttgctagtgcccatgttagcttatctgaagatgtgaaacccttgctgataagggagcatttaaagtactagattttgcactagagggacagcaggcagaaatccttatttctgcccactttggatggcacaaaaagttatctgcagttgaaggcagaaagttgaaatacattgtaaatgaatatttgtatccatgtttcaaaattgaaatatatatatatatatatatatatatatatatatatatatagtgtgtgtgtgtgttctgatagctttaactttctctgcatctttatatttggttccagatcacacctgatgccatgtacttgtgagagaggatgcagttttgttttggaagctctctcagaacaaacaagacacctggattgatcagttaactaaaagttttctcccctattgggtttgacccacaggtcctgtgaaggagcagagggataaaaagagtagaggacatgatacattgtactttactagttcaagacagatgaatgtggaaagcataaaaactcaatggaactgactgagatttaccacagggaaggcccaaacttggggccaaaagcctacccaagtgattgaccagtggccccctaatgggacctgagctgttggaagaagagaactgttccttggtcttcaccatccttgtgagagaagggcagtttcctgcattggaacctggagcaagcgctctatctttcacacaaattccctcacctgagattgaggtgctcttgttactgggtgtctgtgtgctgtaattctggttttggatatgttctgtaaagattttgacaaatgaaaatgtgtttttctctgttaaaacttgtcagagtactagaagttgtatctctgtaggtgcaggtccatttctgcccacaggtagggtgtttttctttgattaagagattgacacttctgttgcctaggacctcccaactcaaccatttctaggtgaaggcagaaaaatccacattagttactcctcttcagacatttcagctgagataacaaatcttttggaattttttcacccatagaaagagtggtagatatttgaatttagcaggtggagtttcatagtaaaaacagcttttgactcagctttgatttatcctcatttgatttggccagaaagtaggtaatatgcattgattggcttctgattccaattcagtatagcaaggtgctaggttttttcctttccccacctgtctcttagcctggggaattaaatgagaagccttagaatgggtggcccttgtgacctgaaacacttcccacataagctacttaacaagattgtcatggagctgcagattccattgcccaccaaagactagaacacacacatatccatacaccaaaggaaagacaattctgaaatgctgtttctctggtggttccctctctggctgctgcctcacagtatgggaacctgtactctgcagaggtgacaggccagatttgcattatctcacaaccttagcccttggtgctaactgtcctacagtgaagtgcctggggggttgtcctatcccataagccacttggatgctgacagcagccaccatcagaatgacccacgcaaaaaaaagaaaaaaaaaattaaaaagtcccctcacaacccagtgacacctttctgctttcctctagactggaacattgattagggagtgcctcagacatgacattcttgtgctgtccttggaattaatctggcagcaggagggagcagactatgtaaacagagataaaaattaattttcaatattgaaggaaaaaagaaataagaagagagagagaaagaaagcatcacacaaagattttcttaaaagaaacaattttgcttgaaatctctttagatggggctcatttctcacggtggcacttggcctccactgggcagcaggaccagctccaagcgctagtgttctgttctctttttgtaatcttggaatcttttgttgctctaaatacaattaaaaatggcagaaacttgtttgttggactacatgtgtgactttgggtctgtctctgcctctgctttcagaaatgtcatccattgtgtaaaatattggcttactggtctgccagctaaaacttggccacatcccctgttatggctgcaggatcgagttattgttaacaaagagacccaagaaaagctgctaatgtcctcttatcattgttgttaatttgttaaaacataaagaaatctaaaatttca

SEQ ID NO: 107152 - DNA, 1728 bp, Homo sapiens
  Payload ID: 1034
  Gene Symbol: AR
  Gene Name: androgen receptor
  Uniprot ID: P10275
  ENST ID: ENST00000396043
  CDS Start-End: 115-1281
gcctatgcaaatgcctgcctgaagctgctggaggctggctttgtaccggactttgtacagggaaccagggaaacgaatgcagagtgctcctgacattgcctgtcactttttcccatgatactctggcttcacagtttggagactgccagggaccatgttttgcccattgactattactttccaccccagaagacctgcctgatctgtggagatgaagcttctgggtgtcactatggagctctcacatgtggaagctgcaaggtcttcttcaaaagagccgctgaagggaaacagaagtacctgtgcgccagcagaaatgattgcactattgataaattccgaaggaaaaattgtccatcttgtcgtcttcggaaatgttatgaagcagggatgactctgggagcccggaagctgaagaaacttggtaatctgaaactacaggaggaaggagaggcttccagcaccaccagccccactgaggagacaacccagaagctgacagtgtcacacattgaaggctatgaatgtcagcccatctttctgaatgtcctggaagccattgagccaggtgtagtgtgtgctggacacgacaacaaccagcccgactcctttgcagccttgctctctagcctcaatgaactgggagagagacagcttgtacacgtggtcaagtgggccaaggccttgcctggcttccgcaacttacacgtggacgaccagatggctgtcattcagtactcctggatggggctcatggtgtttgccatgggctggcgatccttcaccaatgtcaactccaggatgctctacttcgcccctgatctggttttcaatgagtaccgcatgcacaagtcccggatgtacagccagtgtgtccgaatgaggcacctctctcaagagtttggatggctccaaatcaccccccaggaattcctgtgcatgaaagcactgctactcttcagcattattccagtggatgggctgaaaaatcaaaaattctttgatgaacttcgaatgaactacatcaaggaactcgatcgtatcattgcatgcaaaagaaaaaatcccacatcctgctcaagacgcttctaccagctcaccaagctcctggactccgtgcagcctattgcgagagagctgcatcagttcacttttgacctgctaatcaagtcacacatggtgagcgtggactttccggaaatgatggcagagatcatctctgtgcaagtgcccaagatcctttctgggaaagtcaagcccatctatttccacacccagtgaagcattggaaaccctatttccccaccccagctcatgccccctttcagatgtcttctgcctgttataactctgcactactcctctgcagtgccttggggaatttcctctattgatgtacagtctgtcatgaacatgttcctgaattctatttgctgggctttttttttctctttctctcctttctttttcttcttccctccctatctaaccctcccatggcaccttcagactttgcttcccattgtggctcctatctgtgttttgaatggtgttgtatgcctttaaatctgtgatgatcctcatatggcccagtgtcaagttgtgcttgtttacagcactactctgtgccagccacacaaacgtttacttatcttatgccacgggaagtttagagagctaagattatctggggaaatcaaaacaaaaacaagcaaacaaaaaaaaaaa

SEQ ID NO: 107153 - DNA, 10221 bp, Homo sapiens
  Payload ID: 1034
  Gene Symbol: AR
  Gene Name: androgen receptor
  ENST ID: ENST00000396044
  CDS Start-End: 1116-3320
cgagatcccggggagccagcttgctgggagagcgggacggtccggagcaagcccagaggcagaggaggcgacagagggaaaaagggccgagctagccgctccagtgctgtacaggagccgaagggacgcaccacgccagccccagcccggctccagcgacagccaacgcctcttgcagcgcggcggcttcgaagccgccgcccggagctgccctttcctcttcggtgaagtttttaaaagctgctaaagactcggaggaagcaaggaaagtgcctggtaggactgacggctgcctttgtcctcctcctctccaccccgcctccccccaccctgccttccccccctcccccgtcttctctcccgcagctgcctcagtcggctactctcagccaacccccctcaccacccttctccccacccgcccccccgcccccgtcggcccagcgctgccagcccgagtttgcagagaggtaactccctttggctgcgagcgggcgagctagctgcacattgcaaagaaggctcttaggagccaggcgactggggagcggcttcagcactgcagccacgacccgcctggttaggctgcacgcggagagaaccctctgttttcccccactctctctccacctcctcctgccttccccaccccgagtgcggagccagagatcaaaagatgaaaaggcagtcaggtcttcagtagccaaaaaacaaaacaaacaaaaacaaaaaagccgaaataaaagaaaaagataataactcagttcttatttgcacctacttcagtggacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcgtttggagactgccagggaccatgttttgcccattgactattactttccaccccagaagacctgcctgatctgtggagatgaagcttctgggtgtcactatggagctctcacatgtggaagctgcaaggtcttcttcaaaagagccgctgaagggaaacagaagtacctgtgcgccagcagaaatgattgcactattgataaattccgaaggaaaaattgtccatcttgtcgtcttcggaaatgttatgaagcagggatgactctgggagcccggaagctgaagaaacttggtaatctgaaactacaggaggaaggagaggcttccagcaccaccagccccactgaggagacaacccagaagctgacagtgtcacacattgaaggctatgaatgtcagcccatctttctgaatgtcctggaagccattgagccaggtgtagtgtgtgctggacacgacaacaaccagcccgactcctttgcagccttgctctctagcctcaatgaactgggagagagacagcttgtacacgtggtcaagtgggccaaggccttgcctgattgcgagagagctgcatcagttcacttttgacctgctaatcaagtcacacatggtgagcgtggactttccggaaatgatggcagagatcatctctgtgcaagtgcccaagatcctttctgggaaagtcaagcccatctatttccacacccagtgaagcattggaaaccctatttccccaccccagctcatgccccctttcagatgtcttctgcctgttataactctgcactactcctctgcagtgccttggggaatttcctctattgatgtacagtctgtcatgaacatgttcctgaattctatttgctgggctttttttttctctttctctcctttctttttcttcttccctccctatctaaccctcccatggcaccttcagactttgcttcccattgtggctcctatctgtgttttgaatggtgttgtatgcctttaaatctgtgatgatcctcatatggcccagtgtcaagttgtgcttgtttacagcactactctgtgccagccacacaaacgtttacttatcttatgccacgggaagtttagagagctaagattatctggggaaatcaaaacaaaaacaagcaaacaaaaaaaaaaagcaaaaacaaaacaaaaaataagccaaaaaaccttgctagtgttttttcctcaaaaataaataaataaataaataaatacgtacatacatacacacatacatacaaacatatagaaatccccaaagaggccaatagtgacgagaaggtgaaaattgcaggcccatggggagttactgattttttcatctcctccctccacgggagactttattttctgccaatggctattgccattagagggcagagtgaccccagagctgagttgggcaggggggtggacagagaggagaggacaaggagggcaatggagcatcagtacctgcccacagccttggtccctgggggctagactgctcaactgtggagcaattcattatactgaaaatgtgcttgttgttgaaaatttgtctgcatgttaatgcctcacccccaaacccttttctctctcactctctgcctccaacttcagattgactttcaatagtttttctaagacctttgaactgaatgttctcttcagccaaaacttggcgacttccacagaaaagtctgaccactgagaagaaggagagcagagatttaaccctttgtaaggccccatttggatccaggtctgctttctcatgtgtgagtcagggaggagctggagccagaggagaagaaaatgatagcttggctgttctcctgcttaggacactgactgaatagttaaactctcactgccactaccttttccccacctttaaaagacctgaatgaagttttctgccaaactccgtgaagccacaagcaccttatgtcctcccttcagtgttttgtgggcctgaatttcatcacactgcatttcagccatggtcatcaagcctgtttgcttcttttgggcatgttcacagattctctgttaagagcccccaccaccaagaaggttagcaggccaacagctctgacatctatctgtagatgccagtagtcacaaagatttcttaccaactctcagatcgctggagcccttagacaaactggaaagaaggcatcaaagggatcaggcaagctgggcgtcttgcccttgtcccccagagatgataccctcccagcaagtggagaagttctcacttccttctttagagcagctaaaggggctacccagatcagggttgaagagaaaactcaattaccagggtgggaagaatgaaggcactagaaccagaaaccctgcaaatgctcttcttgtcacccagcatatccacctgcagaagtcatgagaagagagaaggaacaaagaggagactctgactactgaattaaaatcttcagcggcaaagcctaaagccagatggacaccatctggtgagtttactcatcatcctcctctgctgctgattctgggctctgacattgcccatactcactcagattccccacctttgttgctgcctcttagtcagagggaggccaaaccattgagactttctacagaaccatggcttctttcggaaaggtctggttggtgtggctccaatactttgccacccatgaactcagggtgtgccctgggacactggttttatatagtcttttggcacacctgtgttctgttgacttcgttcttcaagcccaagtgcaagggaaaatgtccacctactttctcatcttggcctctgcctccttacttagctcttaatctcatctgttgaactcaagaaatcaagggccagtcatcaagctgcccattttaattgattcactctgtttgttgagaggatagtttctgagtgacatgatatgatccacaagggtttccttccctgatttctgcattgatattaatagccaaacgaacttcaaaacagctttaaataacaagggagaggggaacctaagatgagtaatatgccaatccaagactgctggagaaaactaaagctgacaggttccctttttggggtgggatagacatgttctggttttctttattattacacaatctggctcatgtacaggatcacttttagctgttttaaacagaaaaaaatatccaccactcttttcagttacactaggttacattttaataggtcctttacatctgttttggaatgattttcatcttttgtgatacacagattgaattatatcattttcatatctctccttgtaaatactagaagctctcctttacatttctctatcaaatttttcatctttatgggtttcccaattgtgactcttgtcttcatgaatatatgtttttcatttgcaaaagccaaaaatcagtgaaacagcagtgtaattaaaagcaacaactggattactccaaatttccaaatgacaaaactagggaaaaatagcctacacaagcctttaggcctactctttctgtgcttgggtttgagtgaacaaaggagattttagcttggctctgttctcccatggatgaaaggaggaggattttttttttcttttggccattgatgttctagccaatgtaattgacagaagtctcattttgcatgcgctctgctctacaaacagagttggtatggttggtatactgtactcacctgtgagggactggccactcagacccacttagctggtgagctagaagatgaggatcactcactggaaaagtcacaaggaccatctccaaacaagttggcagtgctcgatgtggacgaagagtgaggaagagaaaaagaaggagcaccagggagaaggctccgtctgtgctgggcagcagacagctgccaggatcacgaactctgtagtcaaagaaaagagtcgtgtggcagtttcagctctcgttcattgggcagctcgcctaggcccagcctctgagctgacatgggagttgttggattctttgtttcatagctttttctatgccataggcaatattgttgttcttggaaagtttattatttttttaactcccttactctgagaaagggatattttgaaggactgtcatatatctttgaaaaaagaaaatctgtaatacatatatttttatgtatgttcactggcactaaaaaatatagagagcttcattctgtcctttgggtagttgctgaggtaattgtccaggttgaaaaataatgtgctgatgctagagtccctctctgtccatactctacttctaaatacatataggcatacatagcaagttttatttgacttgtactttaagagaaaatatgtccaccatccacatgatgcacaaatgagctaacattgagcttcaagtagcttctaagtgtttgtttcattaggcacagcacagatgtggcctttccccccttctctcccttgatatctggcagggcataaaggcccaggccacttcctctgccccttcccagccctgcaccaaagctgcatttcaggagactctctccagacagcccagtaactacccgagcatggcccctgcatagccctggaaaaataagaggctgactgtctacgaattatcttgtgccagttgcccaggtgagagggcactgggccaagggagtggttttcatgtttgacccactacaaggggtcatgggaatcaggaatgccaaagcaccagatcaaatccaaaacttaaagtcaaaataagccattcagcatgttcagtttcttggaaaaggaagtttctacccctgatgcctttgtaggcagatctgttctcaccattaatctttttgaaaatcttttaaagcagtttttaaaaagagagatgaaagcatcacattatataaccaaagattacattgtacctgctaagataccaaaattcataagggcagggggggagcaagcattagtgcctctttgataagctgtccaaagacagactaaaggactctgctggtgactgacttataagagctttgtgggtttttttttccctaataatatacatgtttagaagaattgaaaataatttcgggaaaatgggattatgggtccttcactaagtgattttataagcagaactggctttccttttctctagtagttgctgagcaaattgttgaagctccatcattgcatggttggaaatggagctgttcttagccactgtgtttgctagtgcccatgttagcttatctgaagatgtgaaacccttgctgataagggagcatttaaagtactagattttgcactagagggacagcaggcagaaatccttatttctgcccactttggatggcacaaaaagttatctgcagttgaaggcagaaagttgaaatacattgtaaatgaatatttgtatccatgtttcaaaattgaaatatatatatatatatatatatatatatatatatatatatagtgtgtgtgtgtgttctgatagctttaactttctctgcatctttatatttggttccagatcacacctgatgccatgtacttgtgagagaggatgcagttttgttttggaagctctctcagaacaaacaagacacctggattgatcagttaactaaaagttttctcccctattgggtttgacccacaggtcctgtgaaggagcagagggataaaaagagtagaggacatgatacattgtactttactagttcaagacagatgaatgtggaaagcataaaaactcaatggaactgactgagatttaccacagggaaggcccaaacttggggccaaaagcctacccaagtgattgaccagtggccccctaatgggacctgagctgttggaagaagagaactgttccttggtcttcaccatccttgtgagagaagggcagtttcctgcattggaacctggagcaagcgctctatctttcacacaaattccctcacctgagattgaggtgctcttgttactgggtgtctgtgtgctgtaattctggttttggatatgttctgtaaagattttgacaaatgaaaatgtgtttttctctgttaaaacttgtcagagtactagaagttgtatctctgtaggtgcaggtccatttctgcccacaggtagggtgtttttctttgattaagagattgacacttctgttgcctaggacctcccaactcaaccatttctaggtgaaggcagaaaaatccacattagttactcctcttcagacatttcagctgagataacaaatcttttggaattttttcacccatagaaagagtggtagatatttgaatttagcaggtggagtttcatagtaaaaacagcttttgactcagctttgatttatcctcatttgatttggccagaaagtaggtaatatgcattgattggcttctgattccaattcagtatagcaaggtgctaggttttttcctttccccacctgtctcttagcctggggaattaaatgagaagccttagaatgggtggcccttgtgacctgaaacacttcccacataagctacttaacaagattgtcatggagctgcagattccattgcccaccaaagactagaacacacacatatccatacaccaaaggaaagacaattctgaaatgctgtttctctggtggttccctctctggctgctgcctcacagtatgggaacctgtactctgcagaggtgacaggccagatttgcattatctcacaaccttagcccttggtgctaactgtcctacagtgaagtgcctggggggttgtcctatcccataagccacttggatgctgacagcagccaccatcagaatgacccacgcaaaaaaaagaaaaaaaaaattaaaaagtcccctcacaacccagtgacacctttctgctttcctctagactggaacattgattagggagtgcctcagacatgacattcttgtgctgtccttggaattaatctggcagcaggagggagcagactatgtaaacagagataaaaattaattttcaatattgaaggaaaaaagaaataagaagagagagagaaagaaagcatcacacaaagattttcttaaaagaaacaattttgcttgaaatctctttagatggggctcatttctcacggtggcacttggcctccactgggcagcaggaccagctccaagcgctagtgttctgttctctttttgtaatcttggaatcttttgttgctctaaatacaattaaaaatggcagaaacttgtttgttggactacatgtgtgactttgggtctgtctctgcctctgctttcagaaatgtcatccattgtgtaaaatattggcttactggtctgccagctaaaacttggccacatcccctgttatggctgcaggatcgagttattgttaacaaagagacccaagaaaagctgctaatgtcctcttatcattgttgttaatttgttaaaacataaagaaatctaaaatttc

SEQ ID NO: 107154 - DNA, 3615 bp, Homo sapiens
  Payload ID: 1034
  Gene Symbol: AR
  Gene Name: androgen receptor
  ENST ID: ENST00000504326
  CDS Start-End: 328-2262
gacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcgtttggagactgccagggaccatgttttgcccattgactattactttccaccccagaagacctgcctgatctgtggagatgaagcttctgggtgtcactatggagctctcacatgtggaagctgcaaggtcttcttcaaaagagccgctgaagggaaacagaagtacctgtgcgccagcagaaatgattgcactattgataaattccgaaggaaaaattgtccatcttgtcgtcttcggaaatgttatgaagcagggatgactctgggagaaaaattccgggttggcaattgcaagcatctcaaaatgaccagaccctgaagaaaggctgacttgcctcattcaaaatgagggctctagagggctctagtggatagtctggagaaacctggcgtctgaggcttaggagcttaggtttttgctcctcaacacagactttgacgttggggttgggggctactctcttgattgctgactccctccagcgggaccaatagtgttttcctacctcacagggatgttgtgaggacgggctgtagaagtaatagtggttaccattcatgtagttgtgagtatcatgattattgtttcctgtaatgtggcttggcattggcaaagtgctttttgattgttcttgatcacatatgatgggggccaggcactgactcaggcggatgcagtgaagctctggctcagtcgcttgcttttcgtggtgtgctgccaggaagaaactttgctgatgggactcaaggtgtcaccttggacaagaagcaactgtgtctgtctgaggttcctgtggccatctttatttgtgtattaggcaattcgtatttcccccttaggttctagccttctggatcccagccagtgacctagatcttagcctcaggccctgtcactgagctgaaggtagtagctgatccacagaagttcagtaaacaaggaccagatttctgcttctccaggagaagaagccagccaacccctctcttcaaacacactgagagactacagtccgactttccctcttacatctagccttactgtagccacactccttgattgctctctcacatcacatgcttctcttcatcagttgtaagcctctcattcttctcccaagccagactcaaatattgtattgatgtcaaagaagaatcacttagagtttggaatatcttgttctctctctgctccatagcttccatattgacaccagtttctttctagtggagaagtggagtctgtgaagccagggaaacacacatgtgagagtcagaaggactctccctgacttgcctggggcctgtctttcccaccttctccagtctgtctaaacacacacacacacacacacacacacacacacacgctctctctctctctccccccccaacacacacacactctctctctctctcacacacacacacatacacacacacttctttctctttcccctgactcagcaacattctggagaaaagccaaggaaggacttcaggaggggagtttcccccttctcagggcagaattttaatctccagaccaacaagaagttccctaatgtggattgaaaggctaatgaggtttatttttaactactttctatttgtttgaatgttgcatatttctactagtgaaattttcccttaataaagccattaatacacc

SEQ ID NO: 107155 - DNA, 3899 bp, Homo sapiens
  Payload ID: 1034
  Gene Symbol: AR
  Gene Name: androgen receptor
  ENST ID: ENST00000514029
  CDS Start-End: 328-2130
gacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcgtttggagactgccagggaccatgttttgcccattgactattactttccaccccagaagacctgcctgatctgtggagatgaagcttctgggtgtcactatggagctctcacatgtggaagctgcaaggtcttcttcaaaagagccgctgaaggatttttcagaatgaacaaattaaaagaatcataatcagacactaaccccaagccatactgcatggcagcaccaatgggactgacagaaaacaacagaaataggaagaaatcctacagagaaacaaacttgaaagctgtctcatggcctttgaatcatacttaagttttatgatggaaggatacgactatgaagaaagacacagagcaacatcagacagtcaagaatttcagagccagctggcatgcagtggacctcatgccagcccattttatgactatttagggaaacagaagtacctgtgcgccagcagaaatgattgcactattgataaattccgaaggaaaaattgtccatcttgtcgtcttcggaaatgttatgaagcagggatgactctgggagaaaaattccgggttggcaattgcaagcatctcaaaatgaccagaccctgaagaaaggctgacttgcctcattcaaaatgagggctctagagggctctagtggatagtctggagaaacctggcgtctgaggcttaggagcttaggtttttgctcctcaacacagactttgacgttggggttgggggctactctcttgattgctgactccctccagcgggaccaatagtgttttcctacctcacagggatgttgtgaggacgggctgtagaagtaatagtggttaccattcatgtagttgtgagtatcatgattattgtttcctgtaatgtggcttggcattggcaaagtgctttttgattgttcttgatcacatatgatgggggccaggcactgactcaggcggatgcagtgaagctctggctcagtcgcttgcttttcgtggtgtgctgccaggaagaaactttgctgatgggactcaaggtgtcaccttggacaagaagcaactgtgtctgtctgaggttcctgtggccatctttatttgtgtattaggcaattcgtatttcccccttaggttctagccttctggatcccagccagtgacctagatcttagcctcaggccctgtcactgagctgaaggtagtagctgatccacagaagttcagtaaacaaggaccagatttctgcttctccaggagaagaagccagccaacccctctcttcaaacacactgagagactacagtccgactttccctcttacatctagccttactgtagccacactccttgattgctctctcacatcacatgcttctcttcatcagttgtaagcctctcattcttctcccaagccagactcaaatattgtattgatgtcaaagaagaatcacttagagtttggaatatcttgttctctctctgctccatagcttccatattgacaccagtttctttctagtggagaagtggagtctgtgaagccagggaaacacacatgtgagagtcagaaggactctccctgacttgcctggggcctgtctttcccaccttctccagtctgtctaaacacacacacacacacacacacacacacacacacgctctctctctctctccccccccaacacacacacactctctctctctctcacacacacacacatacacacacacttctttctctttcccctgactcagcaacattctggagaaaagccaaggaaggacttcaggaggggagtttcccccttctcagggcagaattttaatctccagaccaacaagaagttccctaatgtggattgaaaggctaatgaggtttatttttaactactttctatttgtttgaatgttgcatatttctactagtgaaattttcccttaataaagccattaatacacc

SEQ ID NO: 107156 - DNA, 3532 bp, Homo sapiens
  Payload ID: 1034
  Gene Symbol: AR
  Gene Name: androgen receptor
  ENST ID: ENST00000613054
  CDS Start-End: 328-2046
gacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcgaaatacccgaagaaagagactctggaaactcattatcaggtctatcaactcttgtatttgttctcccagggaaacagaagtacctgtgcgccagcagaaatgattgcactattgataaattccgaaggaaaaattgtccatcttgtcgtcttcggaaatgttatgaagcagggatgactctgggagaaaaattccgggttggcaattgcaagcatctcaaaatgaccagaccctgaagaaaggctgacttgcctcattcaaaatgagggctctagagggctctagtggatagtctggagaaacctggcgtctgaggcttaggagcttaggtttttgctcctcaacacagactttgacgttggggttgggggctactctcttgattgctgactccctccagcgggaccaatagtgttttcctacctcacagggatgttgtgaggacgggctgtagaagtaatagtggttaccattcatgtagttgtgagtatcatgattattgtttcctgtaatgtggcttggcattggcaaagtgctttttgattgttcttgatcacatatgatgggggccaggcactgactcaggcggatgcagtgaagctctggctcagtcgcttgcttttcgtggtgtgctgccaggaagaaactttgctgatgggactcaaggtgtcaccttggacaagaagcaactgtgtctgtctgaggttcctgtggccatctttatttgtgtattaggcaattcgtatttcccccttaggttctagccttctggatcccagccagtgacctagatcttagcctcaggccctgtcactgagctgaaggtagtagctgatccacagaagttcagtaaacaaggaccagatttctgcttctccaggagaagaagccagccaacccctctcttcaaacacactgagagactacagtccgactttccctcttacatctagccttactgtagccacactccttgattgctctctcacatcacatgcttctcttcatcagttgtaagcctctcattcttctcccaagccagactcaaatattgtattgatgtcaaagaagaatcacttagagtttggaatatcttgttctctctctgctccatagcttccatattgacaccagtttctttctagtggagaagtggagtctgtgaagccagggaaacacacatgtgagagtcagaaggactctccctgacttgcctggggcctgtctttcccaccttctccagtctgtctaaacacacacacacacacacacacacacacacacacgctctctctctctctccccccccaacacacacacactctctctctctctcacacacacacacatacacacacacttctttctctttcccctgactcagcaacattctggagaaaagccaaggaaggacttcaggaggggagtttcccccttctcagggcagaattttaatctccagaccaacaagaagttccctaatgtggattgaaaggctaatgaggtttatttttaactactttctatttgtttgaatgttgcatatttctactagtgaaattttcccttaataaagccattaatacacc

SEQ ID NO: 107157 - DNA, 3896 bp, Homo sapiens
  Payload ID: 1034
  Gene Symbol: AR
  Gene Name: androgen receptor
  ENST ID: ENST00000612010
  CDS Start-End: 328-2256
gacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcgtttggagactgccagggaccatgttttgcccattgactattactttccaccccagaagacctgcctgatctgtggagatgaagcttctgggtgtcactatggagctctcacatgtggaagctgcaaggtcttcttcaaaagagccgctgaaggatttttcagaatgaacaaattaaaagaatcatcagacactaaccccaagccatactgcatggcagcaccaatgggactgacagaaaacaacagaaataggaagaaatcctacagagaaacaaacttgaaagctgtctcatggcctttgaatcatacttaagttttatgatggaaggatacgactatgaagaaagacacagagcaacatcagacagtcaagaatttcagagccagctggcatgcagtggacctcatgccagcccattttatgactatttagggaaacagaagtacctgtgcgccagcagaaatgattgcactattgataaattccgaaggaaaaattgtccatcttgtcgtcttcggaaatgttatgaagcagggatgactctgggagaaaaattccgggttggcaattgcaagcatctcaaaatgaccagaccctgaagaaaggctgacttgcctcattcaaaatgagggctctagagggctctagtggatagtctggagaaacctggcgtctgaggcttaggagcttaggtttttgctcctcaacacagactttgacgttggggttgggggctactctcttgattgctgactccctccagcgggaccaatagtgttttcctacctcacagggatgttgtgaggacgggctgtagaagtaatagtggttaccattcatgtagttgtgagtatcatgattattgtttcctgtaatgtggcttggcattggcaaagtgctttttgattgttcttgatcacatatgatgggggccaggcactgactcaggcggatgcagtgaagctctggctcagtcgcttgcttttcgtggtgtgctgccaggaagaaactttgctgatgggactcaaggtgtcaccttggacaagaagcaactgtgtctgtctgaggttcctgtggccatctttatttgtgtattaggcaattcgtatttcccccttaggttctagccttctggatcccagccagtgacctagatcttagcctcaggccctgtcactgagctgaaggtagtagctgatccacagaagttcagtaaacaaggaccagatttctgcttctccaggagaagaagccagccaacccctctcttcaaacacactgagagactacagtccgactttccctcttacatctagccttactgtagccacactccttgattgctctctcacatcacatgcttctcttcatcagttgtaagcctctcattcttctcccaagccagactcaaatattgtattgatgtcaaagaagaatcacttagagtttggaatatcttgttctctctctgctccatagcttccatattgacaccagtttctttctagtggagaagtggagtctgtgaagccagggaaacacacatgtgagagtcagaaggactctccctgacttgcctggggcctgtctttcccaccttctccagtctgtctaaacacacacacacacacacacacacacacacacacgctctctctctctctccccccccaacacacacacactctctctctctctcacacacacacacatacacacacacttctttctctttcccctgactcagcaacattctggagaaaagccaaggaaggacttcaggaggggagtttcccccttctcagggcagaattttaatctccagaccaacaagaagttccctaatgtggattgaaaggctaatgaggtttatttttaactactttctatttgtttgaatgttgcatatttctactagtgaaattttcccttaataaagccattaatacacc

SEQ ID NO: 107158 - DNA, 10676 bp, Homo sapiens
  Payload ID: 1034
  Gene Symbol: AR
  Gene Name: androgen receptor
  ENST ID: ENST00000612452
  CDS Start-End: 1686-3899
cgagatcccggggagccagcttgctgggagagcgggacggtccggagcaagcccagaggcagaggaggcgacagagggaaaaagggccgagctagccgctccagtgctgtacaggagccgaagggacgcaccacgccagccccagcccggctccagcgacagccaacgcctcttgcagcgcggcggcttcgaagccgccgcccggagctgccctttcctcttcggtgaagtttttaaaagctgctaaagactcggaggaagcaaggaaagtgcctggtaggactgacggctgcctttgtcctcctcctctccaccccgcctccccccaccctgccttccccccctcccccgtcttctctcccgcagctgcctcagtcggctactctcagccaacccccctcaccacccttctccccacccgcccccccgcccccgtcggcccagcgctgccagcccgagtttgcagagaggtaactccctttggctgcgagcgggcgagctagctgcacattgcaaagaaggctcttaggagccaggcgactggggagcggcttcagcactgcagccacgacccgcctggttaggctgcacgcggagagaaccctctgttttcccccactctctctccacctcctcctgccttccccaccccgagtgcggagccagagatcaaaagatgaaaaggcagtcaggtcttcagtagccaaaaaacaaaacaaacaaaaacaaaaaagccgaaataaaagaaaaagataataactcagttcttatttgcacctacttcagtggacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcgtttggagactgccagggaccatgttttgcccattgactattactttccaccccagaagacctgcctgatctgtggagatgaagcttctgggtgtcactatggagctctcacatgtggaagctgcaaggtcttcttcaaaagagccgctgaagggaaacagaagtacctgtgcgccagcagaaatgattgcactattgataaattccgaaggaaaaattgtccatcttgtcgtcttcggaaatgttatgaagcagggatgactctgggagcccggaagctgaagaaacttggtaatctgaaactacaggaggaaggagaggcttccagcaccaccagccccactgaggagacaacccagaagctgacagtgtcacacattgaaggctatgaatgtcagcccatctttctgaatgtcctggaagccattgagccaggtgtagtgtgtgctggacacgacaacaaccagcccgactcctttgcagccttgctctctagcctcaatgaactgggagagagacagcttgtacacgtggtcaagtgggccaaggccttgcctggcttccgcaacttacacgtggacgaccagatggctgtcattcagtactcctggatggggctcatggtgtttgccatgggctggcgatccttcaccaatgtcaactccaggatgctctacttcgcccctgatctggttttcaatgagtaccgcatgcacaagtcccggatgtacagccagtgtgtccgaatgaggcacctctctcaagagtttggatggctccaaatcaccccccaggaattcctgtgcatgaaagcactgctactcttcagcattaaagccaatttatttgctagaattccagtggatgggctgaaaaatcaaaaattctttgatgaacttcgaatgaactacatcaaggaactcgatcgtatcattgcatgcaaaagaaaaaatcccacatcctgctcaagacgcttctaccagctcaccaagctcctggactccgtgcagcctattgcgagagagctgcatcagttcacttttgacctgctaatcaagtcacacatggtgagcgtggactttccggaaatgatggcagagatcatctctgtgcaagtgcccaagatcctttctgggaaagtcaagcccatctatttccacacccagtgaagcattggaaaccctatttccccaccccagctcatgccccctttcagatgtcttctgcctgttataactctgcactactcctctgcagtgccttggggaatttcctctattgatgtacagtctgtcatgaacatgttcctgaattctatttgctgggctttttttttctctttctctcctttctttttcttcttccctccctatctaaccctcccatggcaccttcagactttgcttcccattgtggctcctatctgtgttttgaatggtgttgtatgcctttaaatctgtgatgatcctcatatggcccagtgtcaagttgtgcttgtttacagcactactctgtgccagccacacaaacgtttacttatcttatgccacgggaagtttagagagctaagattatctggggaaatcaaaacaaaaacaagcaaacaaaaaaaaaaagcaaaaacaaaacaaaaaataagccaaaaaaccttgctagtgttttttcctcaaaaataaataaataaataaataaatacgtacatacatacacacatacatacaaacatatagaaatccccaaagaggccaatagtgacgagaaggtgaaaattgcaggcccatggggagttactgattttttcatctcctccctccacgggagactttattttctgccaatggctattgccattagagggcagagtgaccccagagctgagttgggcaggggggtggacagagaggagaggacaaggagggcaatggagcatcagtacctgcccacagccttggtccctgggggctagactgctcaactgtggagcaattcattatactgaaaatgtgcttgttgttgaaaatttgtctgcatgttaatgcctcacccccaaacccttttctctctcactctctgcctccaacttcagattgactttcaatagtttttctaagacctttgaactgaatgttctcttcagccaaaacttggcgacttccacagaaaagtctgaccactgagaagaaggagagcagagatttaaccctttgtaaggccccatttggatccaggtctgctttctcatgtgtgagtcagggaggagctggagccagaggagaagaaaatgatagcttggctgttctcctgcttaggacactgactgaatagttaaactctcactgccactaccttttccccacctttaaaagacctgaatgaagttttctgccaaactccgtgaagccacaagcaccttatgtcctcccttcagtgttttgtgggcctgaatttcatcacactgcatttcagccatggtcatcaagcctgtttgcttcttttgggcatgttcacagattctctgttaagagcccccaccaccaagaaggttagcaggccaacagctctgacatctatctgtagatgccagtagtcacaaagatttcttaccaactctcagatcgctggagcccttagacaaactggaaagaaggcatcaaagggatcaggcaagctgggcgtcttgcccttgtcccccagagatgataccctcccagcaagtggagaagttctcacttccttctttagagcagctaaaggggctacccagatcagggttgaagagaaaactcaattaccagggtgggaagaatgaaggcactagaaccagaaaccctgcaaatgctcttcttgtcacccagcatatccacctgcagaagtcatgagaagagagaaggaacaaagaggagactctgactactgaattaaaatcttcagcggcaaagcctaaagccagatggacaccatctggtgagtttactcatcatcctcctctgctgctgattctgggctctgacattgcccatactcactcagattccccacctttgttgctgcctcttagtcagagggaggccaaaccattgagactttctacagaaccatggcttctttcggaaaggtctggttggtgtggctccaatactttgccacccatgaactcagggtgtgccctgggacactggttttatatagtcttttggcacacctgtgttctgttgacttcgttcttcaagcccaagtgcaagggaaaatgtccacctactttctcatcttggcctctgcctccttacttagctcttaatctcatctgttgaactcaagaaatcaagggccagtcatcaagctgcccattttaattgattcactctgtttgttgagaggatagtttctgagtgacatgatatgatccacaagggtttccttccctgatttctgcattgatattaatagccaaacgaacttcaaaacagctttaaataacaagggagaggggaacctaagatgagtaatatgccaatccaagactgctggagaaaactaaagctgacaggttccctttttggggtgggatagacatgttctggttttctttattattacacaatctggctcatgtacaggatcacttttagctgttttaaacagaaaaaaatatccaccactcttttcagttacactaggttacattttaataggtcctttacatctgttttggaatgattttcatcttttgtgatacacagattgaattatatcattttcatatctctccttgtaaatactagaagctctcctttacatttctctatcaaatttttcatctttatgggtttcccaattgtgactcttgtcttcatgaatatatgtttttcatttgcaaaagccaaaaatcagtgaaacagcagtgtaattaaaagcaacaactggattactccaaatttccaaatgacaaaactagggaaaaatagcctacacaagcctttaggcctactctttctgtgcttgggtttgagtgaacaaaggagattttagcttggctctgttctcccatggatgaaaggaggaggattttttttttcttttggccattgatgttctagccaatgtaattgacagaagtctcattttgcatgcgctctgctctacaaacagagttggtatggttggtatactgtactcacctgtgagggactggccactcagacccacttagctggtgagctagaagatgaggatcactcactggaaaagtcacaaggaccatctccaaacaagttggcagtgctcgatgtggacgaagagtgaggaagagaaaaagaaggagcaccagggagaaggctccgtctgtgctgggcagcagacagctgccaggatcacgaactctgtagtcaaagaaaagagtcgtgtggcagtttcagctctcgttcattgggcagctcgcctaggcccagcctctgagctgacatgggagttgttggattctttgtttcatagctttttctatgccataggcaatattgttgttcttggaaagtttattatttttttaactcccttactctgagaaagggatattttgaaggactgtcatatatctttgaaaaaagaaaatctgtaatacatatatttttatgtatgttcactggcactaaaaaatatagagagcttcattctgtcctttgggtagttgctgaggtaattgtccaggttgaaaaataatgtgctgatgctagagtccctctctgtccatactctacttctaaatacatataggcatacatagcaagttttatttgacttgtactttaagagaaaatatgtccaccatccacatgatgcacaaatgagctaacattgagcttcaagtagcttctaagtgtttgtttcattaggcacagcacagatgtggcctttccccccttctctcccttgatatctggcagggcataaaggcccaggccacttcctctgccccttcccagccctgcaccaaagctgcatttcaggagactctctccagacagcccagtaactacccgagcatggcccctgcatagccctggaaaaataagaggctgactgtctacgaattatcttgtgccagttgcccaggtgagagggcactgggccaagggagtggttttcatgtttgacccactacaaggggtcatgggaatcaggaatgccaaagcaccagatcaaatccaaaacttaaagtcaaaataagccattcagcatgttcagtttcttggaaaaggaagtttctacccctgatgcctttgtaggcagatctgttctcaccattaatctttttgaaaatcttttaaagcagtttttaaaaagagagatgaaagcatcacattatataaccaaagattacattgtacctgctaagataccaaaattcataagggcagggggggagcaagcattagtgcctctttgataagctgtccaaagacagactaaaggactctgctggtgactgacttataagagctttgtgggtttttttttccctaataatatacatgtttagaagaattgaaaataatttcgggaaaatgggattatgggtccttcactaagtgattttataagcagaactggctttccttttctctagtagttgctgagcaaattgttgaagctccatcattgcatggttggaaatggagctgttcttagccactgtgtttgctagtgcccatgttagcttatctgaagatgtgaaacccttgctgataagggagcatttaaagtactagattttgcactagagggacagcaggcagaaatccttatttctgcccactttggatggcacaaaaagttatctgcagttgaaggcagaaagttgaaatacattgtaaatgaatatttgtatccatgtttcaaaattgaaatatatatatatatatatatatatatatatatatatatatagtgtgtgtgtgtgttctgatagctttaactttctctgcatctttatatttggttccagatcacacctgatgccatgtacttgtgagagaggatgcagttttgttttggaagctctctcagaacaaacaagacacctggattgatcagttaactaaaagttttctcccctattgggtttgacccacaggtcctgtgaaggagcagagggataaaaagagtagaggacatgatacattgtactttactagttcaagacagatgaatgtggaaagcataaaaactcaatggaactgactgagatttaccacagggaaggcccaaacttggggccaaaagcctacccaagtgattgaccagtggccccctaatgggacctgagctgttggaagaagagaactgttccttggtcttcaccatccttgtgagagaagggcagtttcctgcattggaacctggagcaagcgctctatctttcacacaaattccctcacctgagattgaggtgctcttgttactgggtgtctgtgtgctgtaattctggttttggatatgttctgtaaagattttgacaaatgaaaatgtgtttttctctgttaaaacttgtcagagtactagaagttgtatctctgtaggtgcaggtccatttctgcccacaggtagggtgtttttctttgattaagagattgacacttctgttgcctaggacctcccaactcaaccatttctaggtgaaggcagaaaaatccacattagttactcctcttcagacatttcagctgagataacaaatcttttggaattttttcacccatagaaagagtggtagatatttgaatttagcaggtggagtttcatagtaaaaacagcttttgactcagctttgatttatcctcatttgatttggccagaaagtaggtaatatgcattgattggcttctgattccaattcagtatagcaaggtgctaggttttttcctttccccacctgtctcttagcctggggaattaaatgagaagccttagaatgggtggcccttgtgacctgaaacacttcccacataagctacttaacaagattgtcatggagctgcagattccattgcccaccaaagactagaacacacacatatccatacaccaaaggaaagacaattctgaaatgctgtttctctggtggttccctctctggctgctgcctcacagtatgggaacctgtactctgcagaggtgacaggccagatttgcattatctcacaaccttagcccttggtgctaactgtcctacagtgaagtgcctggggggttgtcctatcccataagccacttggatgctgacagcagccaccatcagaatgacccacgcaaaaaaaagaaaaaaaaaattaaaaagtcccctcacaacccagtgacacctttctgctttcctctagactggaacattgattagggagtgcctcagacatgacattcttgtgctgtccttggaattaatctggcagcaggagggagcagactatgtaaacagagataaaaattaattttcaatattgaaggaaaaaagaaataagaagagagagagaaagaaagcatcacacaaagattttcttaaaagaaacaattttgcttgaaatctctttagatggggctcatttctcacggtggcacttggcctccactgggcagcaggaccagctccaagcgctagtgttctgttctctttttgtaatcttggaatcttttgttgctctaaatacaattaaaaatggcagaaacttgtttgttggactacatgtgtgactttgggtctgtctctgcctctgctttcagaaatgtcatccattgtgtaaaatattggcttactggtctgccagctaaaacttggccacatcccctgttatggctgcaggatcgagttattgttaacaaagagacccaagaaaagctgctaatgtcctcttatcattgttgttaatttgttaaaacataaagaaatctaaaatttc

SEQ ID NO: 107159 - DNA, 891 bp, Homo sapiens
  Payload ID: 1035
  Gene Symbol: ADTRP
  Gene Name: androgen-dependent TFPI-regulating protein
  Uniprot ID: Q96IZ2
  ENST ID: ENST00000229583
  CDS Start-End: 45-791
agaaagtactcaagacattcacggtgccccggtcagcactcgccatgacgaagacttctacatgcatataccacttccttgttctgagctggtatactttcctcaattattacatctcacaggaaggaaaagacgaggtgaaacccaaaatcttggcaaatggtgcaaggtggaaatatatgacgctgcttaatctgctcaagaacaggactgctgggtttgacatctaccagccaggaagctttaggcagctcttgcagaccattttctacggggtcacctgcctggatgatgtgctgaaaagaaccaaagggggaaaagacattaagttcctaactgccttcagagacctgcttttcaccactctggcttttcctgtatccacgtttgtatttttggcattctggatcctctttctctacaatcgagatctcatttaccccaaggtcctagatactgtcatccccgtgtggctgaatcatgcaatgcacactttcatattccccatcacattggctgaagtcgtcctcaggcctcactcctatccatcaaagaagacaggactcaccttgctggctgctgccagcattgcttacatcagccgcatcctatggctctactttgagacgggtacctgggtgtatcctgtgtttgccaaactcagcctcttgggtctagcagctttcttctctctcagctacgtcttcatcgccagcatctacctacttggagagaagctcaaccactggaaatggggtgacatgaggcagccacggaagaagaggaagtaattgcacaccattttccaagaaccaagaaagaagaaaacacaagagatttttctcatcttttttttttttttctggtggagggaggtggtggaggaacata

SEQ ID NO: 107160 - DNA, 991 bp, Homo sapiens
  Payload ID: 1035
  Gene Symbol: ADTRP
  Gene Name: androgen-dependent TFPI-regulating protein
  ENST ID: ENST00000379415
  CDS Start-End: 486-991
agtctccaaaccagagccaccattcttgcgaagtgagttcccacccacccgagagggagatccttagctcctcatcatcgccagtcatgatgatgagatactctggaagacatccattctgtggaaaccccacaaggtgaggccacgtctaaatagcttacagagtcttgctctttcacccaggctggagtgctgtggtgttatctcagctcactgcagtttcaagctcctgggctcaagtgatcttacctcagccttctgagtagctgggactccaggcatctgaaaaccagcagtaatcctgcctctgaagtttatcaggaaaggagcttaaaagagaaccaaattcagcctgtgttggaactctcagtcccagaggggtgtggtttgtagctctccggcctgctgttggacttaggctgtgacccacagaaggacgccagaaagtactcaagacattcacggtgccccggtcagcactcgccatgacgaagacttctacatgcatataccacttccttgttctgagctggtatactttcctcaattattacatctcacaggaaggaaaagacgaggtgaaacccaaaatcttggcaaatggtgcaaggtggaaatatatgacgctgcttaatctgctcttgcagaccattttctacggggtcacctgcctggatgatgtgctgaaaagaaccaaagggggaaaagacattaagttcctaactgccttcagagacctgcttttcaccactctggcttttcctgtatccacgtttgtatttttggcattctggatcctctttctctacaatcgagatctcatttaccccaaggtcctagatactgtcatccccgtgtggctgaatcatgcaatgcacactttcatattccccatcacattggctgaagtcgtcctcaggcctcactcctatccatcaaagaagacaggactcaccttgctggctgctgccagcattgcttacatcagccg

SEQ ID NO: 107161 - DNA, 2058 bp, Homo sapiens
  Payload ID: 1035
  Gene Symbol: ADTRP
  Gene Name: androgen-dependent TFPI-regulating protein
  Uniprot ID: Q96IZ2
  ENST ID: ENST00000414691
  CDS Start-End: 412-1104
gaaaagaaaagagactacagccatggaagtatttcgctagattttcctagtatttcatgcttacttcatttaaccatgcccctgccccagtgccctagtgaaacagtacaatgtacagctcttgcattgctacctgcccttctcaaagcccacatgttgtattttatgcaaatctacagattatctatcattatctaaatgcaggcatctgaaaaccagcagtaatcctgcctctgaagtttatcaggaaaggagcttaaaagagaaccaaattcagcctgtgttggaactctcagtcccagaggggtgtggtttgtagctctccggcctgctgttggacttaggctgtgacccacagaaggacgccagaaagtactcaagacattcacggtgccccggtcagcactcgccatgacgaagacttctacatgcatataccacttccttgttctgagctggtatactttcctcaattattacatctcacaggaaggaaaagacgaggtgaaacccaaaatcttggcaaatggtgcaaggtggaaatatatgacgctgcttaatctgctcttgcagaccattttctacggggtcacctgcctggatgatgtgctgaaaagaaccaaagggggaaaagacattaagttcctaactgccttcagagacctgcttttcaccactctggcttttcctgtatccacgtttgtatttttggcattctggatcctctttctctacaatcgagatctcatttaccccaaggtcctagatactgtcatccccgtgtggctgaatcatgcaatgcacactttcatattccccatcacattggctgaagtcgtcctcaggcctcactcctatccatcaaagaagacaggactcaccttgctggctgctgccagcattgcttacatcagccgcatcctatggctctactttgagacgggtacctgggtgtatcctgtgtttgccaaactcagcctcttgggtctagcagctttcttctctctcagctacgtcttcatcgccagcatctacctacttggagagaagctcaaccactggaaatggggtgacatgaggcagccacggaagaagaggaagtaattgcacaccattttccaagaaccaagaaagaagaaaacacaagagatttttctcatcttttttttttttttctggtggagggaggtggtggaggaacatagcaaagtaggagggacagagagtgatacttaaatttaataagaggttcgtgaaggtagcttaacttgagaactcttggttttttgaaaggttgactgcacatgccaaaaacaactcctgctatctcagaattaattatctttgaccttcgtggaggatggtctctggttaaaatctggccaaagaaactcacataaacttggtgttagagaacatctagagagagagagaggaacttagagtcatttaaactcttcagtttacagagaaggatgctgaggacctagatgagaagttacctgcaaaaggcaaaagggttacttagtgtcagaaccaaggcaatgacttctctctcccagatctcctagctactggtcctgggccatttttttttttttaaataatcccaactttctttaaaagacaagcatttcagtaagctagttattttcatgggttgctcatccatttttttcagtgatctaaaaatgtagggagatggctactactgaagttgtctgtctacttgggataatagcaaattaattgaagacaatgggaaagtaagttataaaaaatactgggaaatctgtttctcttctgagcaagcattcagggcaggtataaacatcaaacatagtgacattgtcaaaacctcttccatttgaacattgattaattcatcaaataaatggtatagtaataaattttgcttgcagaagaatctggatgggaagtgatagaattataagggctgttgagattgctttgctacaaagcacttttctgaattagtgtgtggtttaacaaagctgatttccagatgcttaacaaggattcatgatccctgctgtg

SEQ ID NO: 107162 - DNA, 539 bp, Homo sapiens
  Payload ID: 1035
  Gene Symbol: ADTRP
  Gene Name: androgen-dependent TFPI-regulating protein
  ENST ID: ENST00000485323
  CDS Start-End: 1-261
atgacgaagacttctacatgcatataccacttccttgttctgagctggtatactttcctcaattattacatctcacaggaaggaaaagacgaggtgaaacccaaaatcttggcaaatggtgcaaggtggaaatatatgacgctgcttaatctgtctagctcaagaacaggactgctgggtttgacatctaccagccaggaagctttaggcagctcttgcagaccattttctacggggtcacctgcctggatgatgtgctgaaaagaaccaaagggggaaaagacattaagttcctaactgccttcagagacctgcttttcaccactctggcttttcctgtatccacgtttgtatttttggcattctggatcctctttctctacaatcgagatctcatttaccccaaggtcctagatactgtcatccccgtgtggctgaatcatgcaatggaattctgttccaaatgatcgttaatgtagaggacgggagctgctgattgtgggcagggttaataaaattcatcagatcaatggccagta

SEQ ID NO: 107163 - DNA, 817 bp, Homo sapiens
  Payload ID: 1035
  Gene Symbol: ADTRP
  Gene Name: androgen-dependent TFPI-regulating protein
  ENST ID: ENST00000506810
  CDS Start-End: 314-817
acctgagtcagagcctagtccggcatgctgcctagcccagccacgtctcatcctattcatggcagagcggggactctcaccctctcccagcaatgtctaaagtcaggcatctgaaaaccagcagtaatcctgcctctgaagtttatcaggaaaggagcttaaaagagaaccaaattcagcctgtgttggaactctcagtcccagaggggtgtggtttgtagctctccggcctgctgttggacttaggctgtgacccacagaaggacgccagaaagtactcaagacattcacggtgccccggtcagcactcgccatgacgaagacttctacatgcatataccacttccttgttctgagctggtatactttcctcaattattacatctcacaggaaggaaaagacgaggtgaaacccaaaatcttggcaaatggtgcaaggtggaaatatatgacgctgcttaatctgctcttgcagaccattttctacggggtcacctgcctggatgatgtgctgaaaagaaccaaagggggaaaagacattaagttcctaactgccttcagagacctgcttttcaccactctggcttttcctgtatccacgtttgtatttttggcattctggatcctctttctctacaatcgagatctcatttaccccaaggtcctagatactgtcatccccgtgtggctgaatcatgcaatgcacactttcatattccccatcacattggctgaagtcgtcctcaggcctcactcctatccatcaaagaagacaggactcaccttgctggctgctgccagcattgcttacatcagc

SEQ ID NO: 107164 - DNA, 687 bp, Homo sapiens
  Payload ID: 1035
  Gene Symbol: ADTRP
  Gene Name: androgen-dependent TFPI-regulating protein
  ENST ID: ENST00000505099
  CDS Start-End: 1-362
atctcatttaccccaaggtcctagatactgtcatccccgtgtggctgaatcatgcaatgcacactttcatattccccatcacattggctgaagtcgtcctcaggcctcactcctatccatcaaagaagacaggactcaccttgctggctgctgccagcattgcttacatcagccgcatcctatggctctactttgagacgggtacctgggtgtatcctgtgtttgccaaactcagcctcttgggtctagcagctttcttctctctcagctacgtcttcatcgccagcatctacctacttggagagaagctcaaccactggaaatggggtgacatgaggcagccacggaagaagaggaagtaattgcacaccattttccaagaaccaagaaagaagaaaacacaagagatttttctcatcttttttttttttttctggtggagggaggtggtggaggaacatagcaaagtaggagggacagagagtgatacttaaatttaataagagagcaaagcagtaccgggtcatccaaaaactttatttaaaaaacaaaacagaaatgtgtccacatcttgcagagctggacaaaagaaggtggtcaagagatcccaaattggtggaaactgtccccgttacaggaggaggaaggacgctgccaccactaccccagggactggcctatactcat

SEQ ID NO: 107165 - DNA, 526 bp, Homo sapiens
  Payload ID: 1035
  Gene Symbol: ADTRP
  Gene Name: androgen-dependent TFPI-regulating protein
  ENST ID: ENST00000503285
  CDS Start-End: 1-351
gctgaagtcgtcctcaggcctcactcctatccatcaaagaagacaggactcaccttgctggctgctgccagcattgcttacatcagccgcatcctatggctctactttgagacgggtacctgggtgtatcctgtgtttgccaaactcagcctcttgggtctagcagctttcttctctctcagctacgtcttcatcgccagcatctacctacttggagagaagctcaaccactggaaatgggtttctgttcagatcttgcaaagatggaggctagaatctgttggaatctgcttccagtggcccgattggaagtcaccagccaagcaccaactggtcaagaatatcaggtgaaatatcagggctataaaaatatttctagcccttgctactatctgacagcagttaaaggaataaaacaagtcggggtgaatctaacttcctatctgccaactaggatactttctactgggaaaaatgcttctcaatcaagaaaatatttataataaacataattttccaattacaa

SEQ ID NO: 107166 - DNA, 1202 bp, Homo sapiens
  Payload ID: 1036
  Gene Symbol: AIG1
  Gene Name: androgen-induced 1
  Uniprot ID: Q9NVV5
  ENST ID: ENST00000275235
  CDS Start-End: 26-763
cagccggtccaggcctctggcgaacatggcgcttgtcccctgccaggtgctgcggatggcaatcctgctgtcttactgctctatcctgtgtaactacaaggccatcgaaatgccctcacaccagacctacggagggagctggaaattcctgacgttcattgatctggttatccaggctgtcttttttggcatctgtgtgctgactgatctttccagtcttctgactcgaggaagtgggaaccaggagcaagagaggcagctcaagaagctcatctctctccgggactggatgttagctgtgttggcctttcctgttggggtttttgttgtagcagtgttctggatcatttatgcctatgacagagagatgatatacccgaagctgctggataattttatcccagggtggctgaatcacggaatgcacacgacggttctgccctttatattaatcgagatgaggacatcgcaccatcagtatcccagcaggagcagcggacttaccgccatatgtaccttctctgttggctatatattatgggtgtgctgggtgcatcatgtaactggcatgtgggtgtaccctttcctggaacacattggcccaggagccagaatcatcttctttgggtctacaaccatcttaatgaacttcctgtacctgctgggagaagttctgaacaactatatctgggatacacagaaaaagcctccatcttggcaagatatgaaaattaagtttatgtacctaggaccatctagttagttccacaaagacagatgttttgtgccaagtaagtatcatcctcatttacaagaggggtcacaaactgctggcctcccccaacttctacctatcaagttctgttaggcctacatcgtggaatttttgtttttgaatcagtattttaaaattgggtgattttggctgggcgcagtggctcatgcctgtaatcccggcactttgggagactgaggcaggtggatcacgaggtcaagagatggagaccatcctggccaacatggtgaaatcccatctctactaaaaatacaaaaattagccaggcatggtggcgtgtgcctgtagtcccaggtactcgggaggctgaggcaggagaactgcttgaacccaggaggcagaggttgcagtgagctgagatcatgccactgcaccccagcctggcaacagaacaagactccatctc

SEQ ID NO: 107167 - DNA, 1321 bp, Homo sapiens
  Payload ID: 1036
  Gene Symbol: AIG1
  Gene Name: androgen-induced 1
  ENST ID: ENST00000344492
  CDS Start-End: 12-683
aggtgctgcggatggcaatcctgctgtcttactgctctatcctgtgtaactacaaggccatcgaaatgccctcacaccagacctacggagggagctggaaattcctgacgttcattgatctggttatccaggctgtcttttttggcatctgtgtgctgactgatctttccagtcttctgactcgaggaagtgggaaccaggagcaagagaggcagctcaagaagctcatctctctccgggactggatgttagctgtgttggcctttcctgttggggtttttgttgtagcagtgttctggatcatttatgcctatgacagagagatgatatacccgaagctgctggataattttatcccagggtggctgaatcacggaatgcacacgacggttctgccctttatattaatcgagatgaggacatcgcaccatcagtatcccagcaggagcagcggacttaccgccatatgtaccttctctgttggctatatattatgggtgtgctgggtgcatcatgtaactggcatgggtgtaccctttcctggaacaattggcccaggagccagaatcatcttctttgggtctacaaccatcttaatgaacttcctgtacctgctgggagaagttctgaacaactatatctgggatacagaaaagtatggaagaagagaaagaaaagcctaaattggaatgagatccaagtctaaacgcaagagctagattgagccgccattgaagactccttcccctcgggcattggcagtgggggagaaaaggcttcaaaggaacttggtggcatcagcacccccctcccccaatgaggacaccttttatatataaatatgtataaacatagaatacagttgtttccaaaagaactcaccctcactgtgtgttaaagaattcttcccaaagtcattactgataataacattttttccttttctagttttaaaaccagaattggaccttggatttttattttggcaattgtaactccatctaatcaagaaagaataaaagtttattgcacttctttttgagaaatatgttaaagtcaaaggggcatatatagagtaaggcttttgtgtatttaatcctaaaggtggctgtaatcatgaacctaggccaccatggggacctgagagggaaggggacagatgtttctcattgcataatgtcacagttgcctcaaatgagcaccatttgtaataatgatgtcaatttcatgaaaagcctgagtgtattgcatctcttgatttaatcatgtgaaacttttcctagatgcaaatgctgactaataaagacaaagccaccctgaa

SEQ ID NO: 107168 - DNA, 1395 bp, Homo sapiens
  Payload ID: 1036
  Gene Symbol: AIG1
  Gene Name: androgen-induced 1
  Uniprot ID: Q9NVV5
  ENST ID: ENST00000357847
  CDS Start-End: 51-767
cctcacgcccgccctccttgccgcccagccggtccaggcctctggcgaacatggcgcttgtcccctgccaggtgctgcggatggcaatcctgctgtcttactgctctatcctgtgtaactacaaggccatcgaaatgccctcacaccagacctacggagggagctggaaattcctgacgttcattgatctggttatccaggctgtcttttttggcatctgtgtgctgactgatctttccagtcttctgactcgaggaagtgggaaccaggagcaagagaggcagctcaagaagctcatctctctccgggactggatgttagctgtgttggcctttcctgttggggtttttgttgtagcagtgttctggatcatttatgcctatgacagagagatgatatacccgaagctgctggataattttatcccagggtggctgaatcacggaatgcacacgacggttctgccctttatattaatcgagatgaggacatcgcaccatcagtatcccagcaggagcagcggacttaccgccatatgtaccttctctgttggctatatattatgggtgtgctgggtgcatcatgtaactggcatgtgggtgtaccctttcctggaacacattggcccaggagccagaatcatcttctttgggtctacaaccatcttaatgaacttcctgtacctgctgggagaagttctgaacaactatatctgggatacacagaaaagtatggaagaagagaaagaaaagcctaaattggaatgagatccaagtctaaacgcaagagctagattgagccgccattgaagactccttcccctcgggcattggcagtgggggagaaaaggcttcaaaggaacttggtggcatcagcacccccctcccccaatgaggacaccttttatatataaatatgtataaacatagaatacagttgtttccaaaagaactcaccctcactgtgtgttaaagaattcttcccaaagtcattactgataataacattttttccttttctagttttaaaaccagaattggaccttggatttttattttggcaattgtaactccatctaatcaagaaagaataaaagtttattgcacttctttttgagaaatatgttaaagtcaaaggggcatatatagagtaaggcttttgtgtatttaatcctaaaggtggctgtaatcatgaacctaggccaccatggggacctgagagggaaggggacagatgtttctcattgcataatgtcacagttgcctcaaatgagcaccatttgtaataatgatgtcaatttcatgaaaagcctgagtgtattgcatctcttgatttaatcatgtgaaacttttcctagatgcaaatgctgactaataaagacaaagccaccctgaa

SEQ ID NO: 107169 - DNA, 559 bp, Homo sapiens
  Payload ID: 1036
  Gene Symbol: AIG1
  Gene Name: androgen-induced 1
  ENST ID: ENST00000367596
  CDS Start-End: 26-169
cagccggtccaggcctctggcgaacatggcgcttgtcccctgccaggtgctgcggatggcaatcctgctgtcttactgctctatcctgtgtaactacaaggccatcgaaatgccctcacaccagacctacggagggagctggaaattcctgacgttcattgatctgtgattgcgtgtgaaggcctggctgcccccgcagcggcaccttctgaaccactcaccgttacctggtagctgggtacccttacctggcaactgggggacaaatggaggtggggcgcagccaggtggtgggctctttggagggggacaccgaactgcttctaagaggtgacacgggaagaatcttcaacaaaagcatcggacctgatcctgaatggcctgagacccattcgccctcaaggtgcttttcagagcacccaccgtgggatgaacttgttgcaactgaaggaaactgggtattgtctagtgatttggaacttcacctgaaagaaccaaatccttctcataagggagagaaagcacctaataaagttgtcttctttgcatctgttttttt

SEQ ID NO: 107170 - DNA, 727 bp, Homo sapiens
  Payload ID: 1036
  Gene Symbol: AIG1
  Gene Name: androgen-induced 1
  ENST ID: ENST00000367601
  CDS Start-End: 150-727
cgcccactagccacagggcccgcttccccctggagatcagcgcgcacttcccgagccctcgtagcactcagaggtcgcatccacacctgggatgcctagggggcgcctcctggccgggtgtcccgggaccctgcgaacgcaggagcagaatgacgaaggtgctgcggatggcaatcctgctgtcttactgctctatcctgtgtaactacaaggccatcgaaatgccctcacaccagacctacggagggagctggaaattcctgacgttcattgatctggttatccaggctgtcttttttggcatctgtgtgctgactgatctttccagtcttctgactcgaggaagtgggaaccaggagcaagagaggcagctcaagaagctcatctctctccgggactggatgttagctgtgttggcctttcctgttggggtttttgttgtagcagtgttctggatcatttatgcctatgacagagagatgatatacccgaagctgctggataattttatcccagggtggctgaatcacggaatgcacacgacggttctgccctttatattaatcgagatgaggacatcgcaccatcagtatcccagcaggagcagcggacttaccgccatatgtaccttctctgttggctatatattatgggtgtgctgggtgcatcatgtaactggcatgtgggtgtaccctttcctggaacacattggcccaggagccagaat

SEQ ID NO: 107171 - DNA, 444 bp, Homo sapiens
  Payload ID: 1036
  Gene Symbol: AIG1
  Gene Name: androgen-induced 1
  ENST ID: ENST00000447498
  CDS Start-End: 74-444
cgcccccgcgcgcccggcgcctccctcacgcccgccctccttgccgcccagccggtccaggcctctggcgaacatggcgcttgtcccctgccaggtgctgcggatggcaatcctgctgtcttactgctctatcctgtgtaactacaaggccatcgaaatgccctcacaccagacctacggagggagctggaaattcctgacgttcattgatctgtttgttgtagcagtgttctggatcatttatgcctatgacagagagatgatatacccgaagctgctggataattttatcccagggtggctgaatcacggaatgcacacgacggttctgccctttatattaatcgagatgaggacatcgcaccatcagtatcccagcaggagcagcggacttaccgccatatgtaccttctctgttggctatatattatgggtgtgctgggt

SEQ ID NO: 107172 - DNA, 593 bp, Homo sapiens
  Payload ID: 1036
  Gene Symbol: AIG1
  Gene Name: androgen-induced 1
  ENST ID: ENST00000458219
  CDS Start-End: 179-593
gcattgatttctctacggagtagcattcaaatatgtaactgatcatggactccaggttatccaggctgtcttttttggcatctgtgtgctgactgatctttccagtcttctgactcgaggaagtgggaaccaggagcaagagaggcagctcaagaagctcatctctctccgggactggatgttagctgtgttggcctttcctgttggggtttttgttgtagcagtgttctggatcatttatgcctatgacagagagatgatatacccgaagctgctggataattttatcccagggtggctgaatcacggaatgcacacgacggttctgccctttatattaatcgagatgaggacatcgcaccatcagtatcccagcaggagcagcggacttaccgccatatgtaccttctctgttggctatatattatgggtgtgctgggtgcatcatgtaactggcatgtgggtgtaccctttcctggaacacattggcccaggagccagaatcatcttctttgggtctacaaccatcttaatgaacttcctgtacctgctgggagaagttctgaacaactatatctgggatacacagaaaa

SEQ ID NO: 107173 - DNA, 3393 bp, Homo sapiens
  Payload ID: 1036
  Gene Symbol: AIG1
  Gene Name: androgen-induced 1
  Uniprot ID: Q9NVV5
  ENST ID: ENST00000494282
  CDS Start-End: 26-439
cagccggtccaggcctctggcgaacatggcgcttgtcccctgccaggtgctgcggatggcaatcctgctgtcttactgctctatcctgtgtaactacaaggccatcgaaatgccctcacaccagacctacggagggagctggaaattcctgacgttcattgatctggttatccaggctgtcttttttggcatctgtgtgctgactgatctttccagtcttctgactcgaggaagtgggaaccaggagcaagagaggcagctcaagaagctcatctctctccgggactggatgttagctgtgttggcctttcctgttggggtttttgttgtagcagtgttctggatcatttatgcctatgacagagagatgatatacccgaagctgctggataattttatcccagggtggctgaatcacggaatgcatttcaaagcttaaagttttcttggcacgcttttcaaacgcccatctgactttgaagcaggctgcctctccacagaaagcttgctccagcaatgactaaaggattgacctggtgccatgcatgctgctctgcacaagaaggacatttggaaatgaccttgaagcgaagttttgccaagttgatgaaatacgggccttcaagaagtgccatttctcaagcgatgtacagaagggtatccgcagcattgtcaaaaattaccccttaatttggtgttggatgaacatgaatttttaacctccataaggaatgatacttgctcttgattttattagttgcattttgtaacaggttggaaaaattaggtaatggagaactttggcataccacttttgtttcttttaggtgatttttaaaaaacatttgctgaaggagaggttgatgctcaaagggtacagtgataaatggagagacgggagtttaaaatgaaggataagccgcaaatgaggatgaagttaatggatagagaaaagatgggaggaagaggtatctctctttactcgtaagctgcccatcgatatgatttagactctaggagaggggcgtttctttcctcagtaggcacactcatagagtaaactgttgccgctgtttaaacatgttaattgatgttgacaccagttgttgctatacagttttccattttactgagcgatgtatttatgttgctgcataatgtcgcctgattgcacttctcatgctggtgaagttggctgacatttcaggctctggataacatgaagctgtgctttaaccttatttggaagtcagggttagagtggcactggaaggtctccttcagcttcccttcctgtgacctgcctactataaccctggcaaggctgagacagtccaagtttggggcagtcaaggtgggacagcagaagatttcagggtacaagtcatctattctcttatgccagctctcagatttgtatataaaatctgattctacacttcttttaacaaataataaataaataaataggaccatccaacccctctagagctctctaaggagactgtagaagacttgtggccactctcattttaaagattctaataatctccacaaagtaatcctgggaaacatacatctgtaagaccagggaaacatactggcaatagcaacttcccagaacattcctttttacactgcctgggatttttcaataagaaatttggcatttctgtaaatttaaagtgtattcagtaaaattaatgcgtttttttcttaaaagctcaagccttccagactcatcattttgtagttaaaaaagtaagccatgcaactgagataaaagtcaaagttatagattataactgtttgcacaactgttcacatttttaactttttttattttttggagactttttaagagtctcactgtgtcatccaggctggaatacacagtggcactatcatggctcaccacacccttaaactgcagggctcaagcaatcctcctgcctcagccccccaagtagctgggaccacagatgtggaccaccacccctggctacttttttaaaaatttttttgtagagacaatgggctcactatgtttcccaagctagagacaatggcctcattatgtttcccaggctggtctcgaactcctggcctcaagcgatcctcctgcctcagccttcctgaagtcctaggattacatgcatgagctaccacacccagcccctgctcacattttatatagtaacttattttaagaatagtaaagtatttgcaaaatagttttttaatacagtaatttattatatattgaaatcaagcttgatgatatttcattaggttttgctgagtgtcatatgctaagttatttgcttatgaatttttctccaattgcctgtatttggtaagtttgcatggaaagttctgacaggaaactcagaaatatttcattgttttaccctactatcttttttgatgtgtcttaaagttgatttgctttaaattgcagtatcatcctttttttctgtacctaaatgtttttaactgaagaacacaatttccctcaaaaccctcatccctaatttagagccctcttatattaatatgagtcattttaaatgtatttcctgaaacacttctcaacttcgtaaataaaaaagagatatatcttagtccattcaggctactataacaaaatagcacaattgggtggcttataaacaacataaatttatttatcatagttctagagcctgggaagtccaagagctgggtgccagcatggttgggttctgatgaggatcctcttccagattacagacttccagcttcttgctgtgtcctcacatggtggaaggaacaagtaatctctctggagcctcttttaaaagcccaccaatcccattcattgaggattccaccccagtgacctaatcacttcccaaagggccatctcctaatgctataaccttagaggttagggtttcaacatatgaattttgaggggacagaaacattcagcccatagcaggatgagaaaaagaaaggaaagtacaacaaagaacatcaaccataaggaacaccatgacttctgatatttaatatcatggatcacagattgtaggagtcgagaaacagaataaaaagacaaggcccaggcccagtgagcttttgatgcttgaggctcctcatgcccttgctctcccactgacctcagtgctcagcactggctttcttctcctggtgatattttccatttatcttttggtgtaaacattttagagatgagagaagtagggagcttatcattatttagtctgatcagacaatatcttcacttttaagttatgttcagaatttcattgtcctgttctttttaagaatcatatgagattatttttgtgtatgtgaataaactatgaagcattttcttacaaaaaa

SEQ ID NO: 107174 - DNA, 3636 bp, Homo sapiens
  Payload ID: 1036
  Gene Symbol: AIG1
  Gene Name: androgen-induced 1
  Uniprot ID: Q9NVV5
  ENST ID: ENST00000629020
  CDS Start-End: 28-432
cccagccggtccaggcctctggcgaacatggcgcttgtcccctgccaggtgctgcggatggcaatcctgctgtcttactgctctatcctgtgtaactacaaggccatcgaaatgccctcacaccagacctacggagggagctggaaattcctgacgttcattgatctggttatccaggctgtcttttttggcatctgtgtgctgactgatctttccagtcttctgactcgaggaagtgggaaccaggagcaagagaggcagctcaagaagctcatctctctccgggactggatgttagctgtgttggcctttcctgttggggtttttgttgtagcagtgttctggatcatttatgcctatgacagagagatgatatacccgaagctgctggataattttatcccagggtggctgaatcacggaatgctatagcaactagattccaccactttgggcttttacacagaactacagtatgatcagcttggttgaagtttggcactcgacactctgctcaattgaagacatatgcacaaaatcacttaccacattttttaacctgtttttcacactgggtaggcctgtaatatttgcataaaaatatgaaaagcaaccttctgcagggagagaaggcaattaaaagatgttgcgacctttctttctgcagcatttcaaagcttaaagttttcttggcacgcttttcaaacgcccatctgactttgaagcaggctgcctctccacagaaagcttgctccagcaatgactaaaggattgacctggtgccatgcatgctgctctgcacaagaaggacatttggaaatgaccttgaagcgaagttttgccaagttgatgaaatacgggccttcaagaagtgccatttctcaagcgatgtacagaagggtatccgcagcattgtcaaaaattaccccttaatttggtgttggatgaacatgaatttttaacctccataaggaatgatacttgctcttgattttattagttgcattttgtaacaggttggaaaaattaggtaatggagaactttggcataccacttttgtttcttttaggtgatttttaaaaaacatttgctgaaggagaggttgatgctcaaagggtacagtgataaatggagagacgggagtttaaaatgaaggataagccgcaaatgaggatgaagttaatggatagagaaaagatgggaggaagaggtatctctctttactcgtaagctgcccatcgatatgatttagactctaggagaggggcgtttctttcctcagtaggcacactcatagagtaaactgttgccgctgtttaaacatgttaattgatgttgacaccagttgttgctatacagttttccattttactgagcgatgtatttatgttgctgcataatgtcgcctgattgcacttctcatgctggtgaagttggctgacatttcaggctctggataacatgaagctgtgctttaaccttatttggaagtcagggttagagtggcactggaaggtctccttcagcttcccttcctgtgacctgcctactataaccctggcaaggctgagacagtccaagtttggggcagtcaaggtgggacagcagaagatttcagggtacaagtcatctattctcttatgccagctctcagatttgtatataaaatctgattctacacttcttttaacaaataataaataaataaataggaccatccaacccctctagagctctctaaggagactgtagaagacttgtggccactctcattttaaagattctaataatctccacaaagtaatcctgggaaacatacatctgtaagaccagggaaacatactggcaatagcaacttcccagaacattcctttttacactgcctgggatttttcaataagaaatttggcatttctgtaaatttaaagtgtattcagtaaaattaatgcgtttttttcttaaaagctcaagccttccagactcatcattttgtagttaaaaaagtaagccatgcaactgagataaaagtcaaagttatagattataactgtttgcacaactgttcacatttttaactttttttattttttggagactttttaagagtctcactgtgtcatccaggctggaatacacagtggcactatcatggctcaccacacccttaaactgcagggctcaagcaatcctcctgcctcagccccccaagtagctgggaccacagatgtggaccaccacccctggctacttttttaaaaatttttttgtagagacaatgggctcactatgtttcccaagctagagacaatggcctcattatgtttcccaggctggtctcgaactcctggcctcaagcgatcctcctgcctcagccttcctgaagtcctaggattacatgcatgagctaccacacccagcccctgctcacattttatatagtaacttattttaagaatagtaaagtatttgcaaaatagttttttaatacagtaatttattatatattgaaatcaagcttgatgatatttcattaggttttgctgagtgtcatatgctaagttatttgcttatgaatttttctccaattgcctgtatttggtaagtttgcatggaaagttctgacaggaaactcagaaatatttcattgttttaccctactatcttttttgatgtgtcttaaagttgatttgctttaaattgcagtatcatcctttttttctgtacctaaatgtttttaactgaagaacacaatttccctcaaaaccctcatccctaatttagagccctcttatattaatatgagtcattttaaatgtatttcctgaaacacttctcaacttcgtaaataaaaaagagatatatcttagtccattcaggctactataacaaaatagcacaattgggtggcttataaacaacataaatttatttatcatagttctagagcctgggaagtccaagagctgggtgccagcatggttgggttctgatgaggatcctcttccagattacagacttccagcttcttgctgtgtcctcacatggtggaaggaacaagtaatctctctggagcctcttttaaaagcccaccaatcccattcattgaggattccaccccagtgacctaatcacttcccaaagggccatctcctaatgctataaccttagaggttagggtttcaacatatgaattttgaggggacagaaacattcagcccatagcaggatgagaaaaagaaaggaaagtacaacaaagaacatcaaccataaggaacaccatgacttctgatatttaatatcatggatcacagattgtaggagtcgagaaacagaataaaaagacaaggcccaggcccagtgagcttttgatgcttgaggctcctcatgcccttgctctcccactgacctcagtgctcagcactggctttcttctcctggtgatattttccatttatcttttggtgtaaacattttagagatgagagaagtagggagcttatcattatttagtctgatcagacaatatcttcacttttaagttatgttcagaatttcattgtcctgttctttttaagaatcatatgagattatttttgtgtatgtgaataaactatgaagcattttcttacaaaaaa

SEQ ID NO: 107175 - DNA, 918 bp, Homo sapiens
  Payload ID: 1037
  Gene Symbol: ADGB
  Gene Name: androglobin
  ENST ID: ENST00000326916
  CDS Start-End: 141-918
actgccgaaattccaacggcatcgcactgtgcggcctcttctgaggttcctctctcattgggcagggatgtgttcttcctcggtctcatcattgcatctctagcactagtgggagatgtcaataagtgtttaatgaatgaatgcatgaacatgccacaccagtgacctcagcttatggtgaaagacacgaggagttaattaacttaggaagcccagactcccacactattagtgagggacaaaaatcttcagtaacttccaaaacaacaaggaaaggcaaagaaaagtcttctgagaaagaaaagacagccaaagaaaaacaagcacctcgctttgagcctcagatatccactgttcaccctcaacaagaagacccaaataaaccctactggattttgaggttggtcactgaacacaatgaatcagaattatttgaagtgaaaaaggatacagaaagggcagatgaaatccgagccatgaaacaagcctgggagacaactgagccaggaagagcaatcaaggcttctcaggctcgtttgcattaccttagcgggttcattaagaaaacatctgatgctgagagtccgcctatatctgaaagccaaactaaaccaaaagaagaagtagaaacagctgcacgtggcgtaaaagaaccaaactcaaagaattctgcaggttcagagagcaaagagatgacacaaacaggatcagggagtgcggtgtggaagaagtggcaattgaccaaaggcttgagggatgtggcaaaatccacgagtagcgaaagtggaggagtgtcttcaccagggaaagaagagcgcgagcagagcacacggaaggaaaacattcaaacaggacctcgtacacgatctccaacaattttggaaacatctccacgacttattcgaaaagcactagaat

SEQ ID NO: 107176 - DNA, 590 bp, Homo sapiens
  Payload ID: 1037
  Gene Symbol: ADGB
  Gene Name: androglobin
  ENST ID: ENST00000367489
  CDS Start-End: 1-339
gatgaattgaatcagcagcaggcaatgcaaaaggcggaagaaattcatcagtttcgacagcataggaccagagtccttagcattcgaaacattgaccaagaagagcggttgaagttaaaggatgaagtcctggatatgtataaggaaatgcaggactccttagatgaagcccgacagaaaattttcgacatccgggaagagtacagaaacaaattgctggaagctgagcacctaaagctggaagctctctctgctcaggaagccgccatgaagctggagacagaaaagatgaccccagctcctgacacacagaaaaaaaagaaaggaaagaaaaagtaaccaggggatgtccaataccaccctgcttctggagagaaaaaatttatttgtaatgatctttaactgcctgctgataagatattgggccaactgaaaatagaaattgttctttcttagaaatattttaatgctaacttgttagttttcctcagaaagctagtatttgaagccattcgagtttaagatgctctaatttcaataaaatagcttccaaatatttaaaatgtaataaaatatatgtttgacactct

SEQ ID NO: 107177 - DNA, 2123 bp, Homo sapiens
  Payload ID: 1037
  Gene Symbol: ADGB
  Gene Name: androglobin
  ENST ID: ENST00000367490
  CDS Start-End: 1-1878
gttgcagatactcttcaaaaagtttgggctgtattggaaatgaatttagaacagtatgcagtttctctcttaagactaatgtttaaaagcaagtgcaagtctttggaatcttatccatgctatcaagatgaagaaactaagattgcttttgcagattatactgtgacttatcaagaacagccaccaaattcttggtttatagtattcagagaaacatttttggttcatcaagacatgattttggttcccaaagtatatactacacttccaatctgtatcctacacattgttaataatgacacaatggagcaagtgccaaaggtgttccaaaaagtggtgccttatctttataccaagaataagaagggatacacttttgtggcggaagcatttacaggcgacacatatgtagcagcctcacgatggaaactgcgtctcatcggttcttctgctccactgccatgcctctctcgagactctccatgcaattcctttgccataaaggaaatccgagattactacatacccaatgataagaaaattttattcaggtattcggttaaagttctaacaccacaacctgctacaatacaggtacgcacatccaaaccagatgcattcatcaagctgcaggtcctagaaaatgaagaaactatggtgagctccactggaaaaggccaagctataatcccagcatttcacttcttgaagagtgagaaaggtttgagctcccagtcttatggtgaaagacacgaggagttaattaacttaggaagcccagactcccacactattagtgagggacaaaaatcttcagtaacttccaaaacaacaaggaaaggcaaagaaaagtcttctgagaaagaaaagacagccaaagaaaaacaagcacctcgctttgagcctcagatatccactgttcaccctcaacaagaagacccaaataaaccctactggattttgaggttggtcactgaacacaatgaatcagaattatttgaagtgaaaaaggatacagaaagggcagatgaaatccgagccatgaaacaagcctgggagacaactgagccaggaagagcaatcaaggcttctcaggctcgtttgcattaccttagcgggttcattaagaaaacatctgatgctgagagtccgcctatatctgaaagccaaactaaaccaaaagaagaagtagaaacagctgcacgtggcgtaaaagaaccaaactcaaagaattctgcaggttcagagagcaaagagatgacacaaacaggatcagggagtgcggtgtggaagaagtggcaattgaccaaaggcttgagggatgtggcaaaatccacgagtagcgaaagtggaggagtgtcttcaccagggaaagaagagcgcgagcagagcacacggaaggaaaacattcaaacaggacctcgtacacgatctccaacaattttggaaacatctccacgacttattcgaaaagcactagaatttatggatttaagtcaatatgttcggaaaacagatacagatcctctgctgcaaacagatgaattgaatcagcagcaggcaatgcaaaaggcggaagaaattcatcagtttcgacagcataggaccagagtccttagcattcgaaacattgaccaagaagagcggttgaagttaaaggatgaagtcctggatatgtataaggaaatgcaggactccttagatgaagcccgacagaaaattttcgacatccgggaagagtacagaaacaaattgctggaagctgagcacctaaagctggaaactctggctgctcaggaagcagccatgaagctggagacagaaaagatgaccccagctcctgacacacagaaaaaaaagaaaggaaagaaaaagtaaccaggggatgtccaatactaccctgcttctggagagaaaaaatctatttgtaatgatctttaactgcctgctgttaagatattaggccaaatgaaaatagaaatttctctttcttagaaatattttaatgctaacttgttagttttcctcagaaagctagtatttgaagccatttgagtttaagatgctctaatttcaataaaatagcttccaaatatttaataaaatatgtttgacactctaaa

SEQ ID NO: 107178 - DNA, 5325 bp, Homo sapiens
  Payload ID: 1037
  Gene Symbol: ADGB
  Gene Name: androglobin
  Uniprot ID: Q8N7X0
  ENST ID: ENST00000397944
  CDS Start-End: 77-5080
gcaacgcagacgcggagccgagcgcgcccgcaggctctttgctcagagctcagccctacatagatcggcttctgccatggcctccaaacaaaccaaaaagaaagaggtgcatcgtatcaactcggcgcacggatcggataaatcgaaagatttctatccttttggcagtaatgtacaatctggttctactgaacaaaagaaggggaaattcccactctggccagagtggagtgaagctgacataaattcagaaaagtgggatgcaggcaaaggtgcaaaagaaaaggacaaaacaggaaaaagccctgtatttcatttttttgaggaccctgaaggaaagattgagttaccaccatccttgaaaatttattcctggaaacgtccacaagatattttatttagtcagactccagtagttgtgaaaaatgaaatcacgtttgacttattttcagcaaatgaacatttactctgcagcgagctgatgagatggattatcagtgaaatctatgcagtgtggaagatcttcaatggaggaattttgagcaattattttaaggggacttcaggggaacctcctcttctcccctggaagccctgggaacacatatactctctgtgcaaggctgtgaagggtcatatgcctttgttcaatagctatggaaagtatgttgtgaaactttactggatgggttgctggagaaagataacaattgatgactttttgccttttgatgaagataacaatctattgcttccagctacaacttatgaatttgaactgtggccaatgcttttgtctaaagctattatcaagctggcaaatattgacatccatgtagcagacaggagagagctgggggagttcacggttattcatgcgctcacaggatggttaccagaagtcatttctcttcacccgggatatatggacaaagtttgggagctcctgaaagaaatattgcctgagtttaagctgtcagatgaggccagctctgaaagcaaaatagcagtgttagattctaaattaaaagaaccagggaaagaagggaaggagggaaaagaaataaaggatggaaaggaagtaaaagacgtgaaggaattcaaacctgaaagttctttgacaacactaaaggctcctgagaaaagcgacaaagttccaaaggagaaagcagatgcaagagacattggaaagaagagaagcaaagatggagaaaaagaaaaattcaaattctcacttcatggttcaagaccctcatcagaagtgcagtactctgtgcagtccctatcagattgttcttctgcaatacagacctctcatatggtcgtatatgcgacatttacacctctttatttgtttgaaaacaagatcttttcattagagaagatggcagattctgctgagaaacttagagaatatgggctttcccacatctgtagccatcctgtgctggtgactagaagtaggtcttgtcctctggtagcaccaccaaaaccacctcctctacctccctggaaactcattcgtcaaaaaaaggaaactgttataacagatgaagctcaagagttaatagtaaagaagcctgaacggttccttgagatttcaagtccatttttgaattatagaatgactccatttacaattccaacagaaatgcattttgtgcgctccttaattaagaaaggaatacctccaggatctgatttaccttccgtcagtgaaactgatgaaactgcaacacatagccagacagacttgagtcaaataacaaaagctacatctcagggaaatactgcttcacaagttatacttggaaaaggcacagatgaacaaacagactttggattgggtgatgctcatcagagtgatggattaaacttggaaagagagatagtcagccagaccacagcaacacaggaaaagtcacaggaagaacttccaacaacaaataatagtgtttctaaagaaatatggttagattttgaagatttctgtgtatgctttcaaaatatatatattttccacaagccaagttcatattgccttaactttcaaaaatcagaatttaagttctcagaagaacgagtgtcctactatctatttgtagatagtctaaaacctattgaactactggtttgcttttctgcattggtacgctggggggagtatggagccttaacaaaagacagtcctcccatagagcctggacttctcacagctgaaacgttttcttggaaatccctgaaaccaggcagtcttgttctgaagattcacacatatgctaccaaggctacagtggttcgtctgcctgttgggagacacatgctactcttcaacgcatactccccagtaggacactccatacacatctgcagcatggtgtcatttgtcattggggatgaacacgttgtactgcccaactttgaaccagagagctgccgatttacggaacagtctctgttgattatgaaagctattggaaatgtgattgctaatttcaaagataagggtaaactctctgcagctttgaaggatctgcaaacagctcactaccctgtccccttccatgataaagaactaactgcacagcacttcagggtttttcatctttccttatggcgtttaatgaaaaaagttcaaataacaaaacctcctccaaacttcaaatttgcattccgggctatggttttggacttggagttactcaattcctccttggaagaggtttctttagtggaatggctggacgttaaatattgtatgcccacaagtgataaagagtattctgctgaggaagtagcagcagcaattaaaattcaagccatgtggagaggaacttacgttagattgcttatgaaagccagaataccagacacaaaagaaaatatcagtgttgcagatactcttcaaaaagtttgggctgtattggaaatgaatttagaacagtatgcagtttctctcttaagactaatgtttaaaagcaagtgcaagtctttggaatcttatccatgctatcaagatgaagaaactaagattgcttttgcagattatactgtgacttatcaagaacagccaccaaattcttggtttatagtattcagagaaacatttttggttcatcaagacatgattttggttcccaaagtatatactacacttccaatctgtatcctacacattgttaataatgacacaatggagcaagtgccaaaggtgttccaaaaagtggtgccttatctttataccaagaataagaagggatacacttttgtggcggaagcatttacaggcgacacatatgtagcagcctcacgatggaaactgcgtctcatcggttcttctgctccactgccatgcctctctcgagactctccatgcaattcctttgccataaaggaaatccgagattactacatacccaatgataagaaaattttattcaggtattcggttaaagttctaacaccacaacctgctacaatacaggtacgcacatccaaaccagatgcattcatcaagctgcaggtcctagaaaatgaagaaactatggtgagctccactggaaaaggccaagctataatcccagcatttcacttcttgaagagtgagaaaggtttgagctcccagtctagcaagcacattctttcatttcactctgcatccaagaaagagcaagaagtgtatgttaagaagaaagctgctcagggaattcagaaatcccccaagggtagagctgtaagtgcaatacaagacattggtctaccccttgtggaggaggaaactaccagtacacccactagagaagacagttccagcacaccactgcagaattacaagtatattatacagtgttcggtgttgtataacagttggcctctcactgaaagccagctgacatttgttcaagcactgaaagacttaaagaaaagtaataccaaagcttatggtgaaagacacgaggagttaattaacttaggaagcccagactcccacactattagtgagggacaaaaatcttcagtaacttccaaaacaacaaggaaaggcaaagaaaagtcttctgagaaagaaaagacagccaaagaaaaacaagcacctcgctttgagcctcagatatccactgttcaccctcaacaagaagacccaaataaaccctactggattttgaggttggtcactgaacacaatgaatcagaattatttgaagtgaaaaaggatacagaaagggcagatgaaatccgagccatgaaacaagcctgggagacaactgagccaggaagagcaatcaaggcttctcaggctcgtttgcattaccttagcgggttcattaagaaaacatctgatgctgagagtccgcctatatctgaaagccaaactaaaccaaaagaagaagtagaaacagctgcacgtggcgtaaaagaaccaaactcaaagaattctgcaggttcagagagcaaagagatgacacaaacaggatcagggagtgcggtgtggaagaagtggcaattgaccaaaggcttgagggatgtggcaaaatccacgagtagcgaaagtggaggagtgtcttcaccagggaaagaagagcgcgagcagagcacacggaaggaaaacattcaaacaggacctcgtacacgatctccaacaattttggaaacatctccacgacttattcgaaaagcactagaatttatggatttaagtcaatatgttcggaaaacagatacagatcctctgctgcaaacagatgaattgaatcagcagcaggcaatgcaaaaggcggaagaaattcatcagtttcgacagcataggaccagagtccttagcattcgaaacattgaccaagaagagcggttgaagttaaaggatgaagtcctggatatgtataaggaaatgcaggactccttagatgaagcccgacagaaaattttcgacatccgggaagagtacagaaacaaattgctggaagctgagcacctaaagctggaaactctggctgctcaggaagcagccatgaagctggagacagaaaagatgaccccagctcctgacacacagaaaaaaaagaaaggaaagaaaaagtaaccaggggatgtccaatactaccctgcttctggagagaaaaaatctatttgtaatgatctttaactgcctgctgttaagatattaggccaaatgaaaatagaaatttctctttcttagaaatattttaatgctaacttgttagttttcctcagaaagctagtatttgaagccatttgagtttaagatgctctaatttcaataaaatagcttccaaatatttaataaaatatgtttgacactctaaa

SEQ ID NO: 107179 - DNA, 557 bp, Homo sapiens
  Payload ID: 1037
  Gene Symbol: ADGB
  Gene Name: androglobin
  ENST ID: ENST00000470716
  CDS Start-End: 135-557
gaaattccaacggcatcgcactgtgcggcctcttctgaggttcctctctcattgggcagggatgtgttcttcctcggtctcatcattgcatctctagcactagtgggagatgtcaataagtgtttaatgaatgaatgcatgaacatgccacaccagtgacctcagcttatggtgaaagacacgaggagttaattaacttaggaagcccagactcccacactattagtgagggacaaaaatcttcagtaacttccaaaacaacaaggaaaggcaaagaaaagtcttctgagaaagaaaagacagccaaagaaaaacaagcacctcgctttgagcctcaggcttctcaggctcgtttgcattaccttagcgggttcattaagaaaacatctgatgctgagagtccgcctatatctgaaagccaaactaaaccaaaagaagaagtagaaacagctgcacgtggcgtaaaagaaccaaactcaaagaattctgcaggttcagagagcaaagagatgacacaaacaggatcagggagtgcggtgtggaagaagtggcaattg

SEQ ID NO: 107180 - DNA, 607 bp, Homo sapiens
  Payload ID: 1037
  Gene Symbol: ADGB
  Gene Name: androglobin
  ENST ID: ENST00000522242
  CDS Start-End: 72-607
gcagacgcggagccgagcgcgcccgcaggctctttgctcagagctcagccctacatagatcggcttctgccatggcctccaaacaaaccaaaaagaaagaggtgcatcgtatcaactcggcgcacggatcggataaatcgaaagataatgtacaatctggttctactgaacaaaagaaggggaaattcccactctggccagagtggagtgaagctgacataaattcagaaaagtgggatgcaggcaaaggtgcaaaagaaaaggacaaaacaggaaaaagccctgtatttcatttttttgaggaccctgaaggaaagattgagttaccaccatccttgaaaatttattcctggaaacgtccacaagatattttatttagtcagactccagtagttgtgaaaaatgaaatcacgtttgacttattttcagcaaatgaacatttactctgcagcgagctgatgagatggattatcagtgaaatctatgcagtgtggaagatcttcaatggaggaattttgagcaattattttaaggggacttcaggggaacctcctcttctcccctggaagccctgggaacacatatactctctgtgcaaggctgtgaa

SEQ ID NO: 107181 - DNA, 3072 bp, Homo sapiens
  Payload ID: 1037
  Gene Symbol: ADGB
  Gene Name: androglobin
  ENST ID: ENST00000480328
  CDS Start-End: 1-2144
gcacagatgaacaaacagactttggattgggtgatgctcatcagagtgatggattaaacttggaaagagagatagtcagccagaccacagcaacacaggaaaagtcacaggaagaacttccaacaacaaataatagtgtttctaaagaaatatggttagattttgaagatttctgtgtatgctttcaaaatatatatattttccacaagccaagttcatattgccttaactttcaaaaatcagaatttaagttctcagaagaacgagtgtcctactatctatttgtagatagtctaaaacctattgaactactggtttgcttttctgcattggtacgctggggggagtatggagccttaacaaaagacagtcctcccatagagcctggacttctcacagctgaaacgttttcttggaaatccctgaaaccaggcagtcttgttctgaagattcacacatatgctaccaaggctacagtggttcgtctgcctgttgggagacacatgctactcttcaacgcatactccccagtaggacactccatacacatctgcagcatggtgtcatttgtcattggggatgaacacgttgtactgcccaactttgaaccagagagctgccgatttacggaacagtctctgttgattatgaaagctattggaaatgtgattgctaatttcaaagataagggtaaactctctgcagctttgaaggatctgcaaacagctcactaccctgtccccttccatgataaagaactaactgcacagcacttcagggtttttcatctttccttatggcgtttaatgaaaaaagttcaaataacaaaacctcctccaaacttcaaatttgcattccgggctatggttttggacttggagttactcaattcctccttggaagaggtttctttagtggaatggctggacgttaaatattgtatgcccacaagtgataaagagtattctgctgaggaagtagcagcagcaattaaaattcaagccatgtggagaggaacttacgttagattgcttatgaaagccagaataccagacacaaaagaaaatatcagtgttgcagatactcttcaaaaagtttgggctgtattggaaatgaatttagaacagtatgcagtttctctcttaagactaatgtttaaaagcaagtgcaagtctttggaatcttatccatgctatcaagatgaagaaactaagattgcttttgcagattatactgtgacttatcaagaacagccaccaaattcttggtttatagtattcagagaaacatttttggttcatcaagacatgattttggttcccaaagtatatactacacttccaatctgtatcctacacattgttaataatgacacaatggagcaagtgccaaaggtgttccaaaaagtggtgccttatctttataccaagaataagaagggatacacttttgtggcggaagcatttacaggcgacacatatgtagcagcctcacgatggaaactgcgtctcatcggttcttctgctccactgccatgcctctctcgagactctccatgcaattcctttgccataaaggaaatccgagattactacatacccaatgataagaaaattttattcaggtattcggttaaagttctaacaccacaacctgctacaatacaggtacgcacatccaaaccagatgcattcatcaagctgcaggtcctagaaaatgaagaaactatggtgagctccactggaaaaggccaagctataatcccagcatttcacttcttgaagagtgagaaaggtttgagctcccagtcttatggtgaaagacacgaggagttaattaacttaggaagcccagactcccacactattagtgagggacaaaaatcttcagtaacttccaaaacaacaaggaaaggcaaagaaaagtcttctgagaaagaaaagacagccaaagaaaaacaagcacctcgctttgagcctcagatatccactgttcaccctcaacaagaagacccaaataaaccctactggattttgaggcttctcaggctcgtttgcattaccttagcgggttcattaagaaaacatctgatgctgagagtccgcctatatctgaaagccaaactaaaccaaaagaagaagtagaaacagctgcacgtggcgtaaaagaaccaaactcaaagaattctgcaggttcagagagcaaagagatgacacaaacaggatcagggagtgcggtgtggaagaagtggcaattgaccaaaggcttgagggatgtggcaaaatccacgagtagcgaaagtggaggagtgtcttcaccagggaaagaagagcgcgagcagagcacacggaaggaaaacattcaaacaggacctcgtacacgatctccaacaattttggaaacatctccacgacttattcgaaaagcactagaatttatggatttaagtcaatatgttcggaaaacagatacagatcctctgctgcaaacagatgaattgaatcagcagcaggcaatgcaaaaggcggaagaaattcatcagtttcgacagcataggaccagagtccttagcattcgaaacattgaccaagaagagcggttgaagttaaaggatgaagtcctggatatgtataaggaaatgcaggactccttagatgaagcccgacagaaaattttcgacatccgggaagagtacagaaacaaattgctggaagctgagcacctaaagctggaaactctggctgctcaggaagcagccatgaagctggagacagaaaagatgaccccagctcctgacacacagaaaaaaaagaaaggaaagaaaaagtaaccaggggatgtccaatactaccctgcttctggagagaaaaaatctatttgtaatgatctttaactgcctgctgttaagatattaggccaaatgaaaatagaaatttctctttcttagaaatattttaatgctaacttgttagttttcctcagaaagctagtatttgaagccatttgagtttaagatgctctaatttcaataaaatagcttccaaatatttaataaaatatgtttgacactct

SEQ ID NO: 107182 - DNA, 571 bp, Homo sapiens
  Payload ID: 1037
  Gene Symbol: ADGB
  Gene Name: androglobin
  ENST ID: ENST00000522396
  CDS Start-End: 75-182
aacgcagacgcggagccgagcgcgcccgcaggctctttgctcagagctcagccctacatagatcggcttctgccatggcctccaaacaaaccaaaaagaaagaggtgcatcgtatcaactcggcgcacggatcggataaatcgaaagagtccaaggccgaggacgcccttcagaatcagtaatgtacaatctggttctactgaacaaaagaaggggaaattcccactctggccagagtggagtgaagctgacataaattcagaaaagtgggatgcaggcaaaggtgcaaaagaaaaggacaaaacaggaaaaagccctgtatttcatttttttgaggaccctgaaggaaagattgagttaccaccatccttgaaaatttattcctggaaacgtccacaagatattttatttagtcagactccagtagttgtgaaaaatgaaatcacgtttgacttattttcagcaaatgaacatttactctgcagcgagctgatgagatggattatcagtgaaatctatgcagtgtggaagatcttcaatggaggaattttgagcaattattttaagggga

SEQ ID NO: 107183 - DNA, 6779 bp, Homo sapiens
  Payload ID: 1037
  Gene Symbol: ADGB
  Gene Name: androglobin
  ENST ID: ENST00000493950
  CDS Start-End: 37-699
gctcagagctcagccctacatagatcggcttctgccatggcctccaaacaaaccaaaaagaaagaggtgcatcgtatcaactcggcgcacggatcggataaatcgaaagatttctatccttttggcagtaatgtacaatctggttctactgaacaaaagaaggggaaattcccactctggccagagtggagtgaagctgacataaattcagaaaagtgggatgcaggcaaaggtgcaaaagaaaaggacaaaacaggaaaaagccctgtatttcatttttttgaggaccctgaaggaaagattgagttaccaccatccttgaaaatttattcctggaaacgtccacaagatattttatttagtcagactccagtagttgtgaaaaatgaaatcacgtttgacttattttcagcaaatgaacatttactctgcagcgagctgatgagatggattatcagtgaaatctatgcagtgtggaagatcttcaatggaggaattttgagcaattattttaaggggacttcaggggaacctcctcttctcccctggaagccctgggaacacatatactctctgtgcaaggctgtgaagggtcatatgcctttgttcaatagctatggaaagtatgttgtgaaactttactggatgcccgggatatatggacaaagtttgggagctcctgaaagaaatattgcctgagtttaagctgtcagatgaggccagctctgaaagcaaaatagcagtgttagattctaaattaaaagaaccagggaaagaagggaaggagggaaaagaaataaaggatggaaaggaagtaaaagacgtgaaggaattcaaacctgaaagttctttgacaacactaaaggctcctgagaaaagcgacaaagttccaaaggagaaagcagatgcaagagacattggaaagaagagaagcaaagatggagaaaaagaaaaattcaaattctcacttcatggttcaagaccctcatcagaagtgcagtactctgtgcagtccctatcagattgttcttctgcaatacagacctctcatatggtcgtatatgcgacatttacacctctttatttgtttgaaaacaagatcttttcattagagaagatggcagattctgctgagaaacttagagaatatgggctttcccacatctgtagccatcctgtgctggtgactagaagtaggtcttgtcctctggtagcaccaccaaaaccacctcctctacctccctggaaactcattcgtcaaaaaaaggaaactgttataacagatgaagctcaagagttaatagtaaagaagcctgaacggttccttgagatttcaagtccatttttgaattatagaatgactccatttacaattccaacagaaatgcattttgtgcgctccttaattaagaaaggaatacctccaggatctgatttaccttccgtcagtgaaactgatgaaactgcaacacatagccagacagacttgagtcaaataacaaaagctacatctcaggcacagatgaacaaacagactttggattgggtgatgctcatcagagtgatggattaaacttggaaagagagatagtcagccagaccacagcaacacaggaaaagtcacaggaagaacttccaacaacaaataatagtgtttctaaagaaatatggttagattttgaagatttctgtgtatgctttcaaaatatatatattttccacaagccaagttcatattgccttaactttcaaaaatcagaatttaagttctcagaagaacgagtgtcctactatctatttgtagatagtctaaaacctattgaactactggtttgcttttctgcattggtacgctggggggagtatggagccttaacaaaagacagtcctcccatagagcctggacttctcacagctgaaacgttttcttggaaatccctgaaaccaggcagtcttgttctgaagattcacacatatgctaccaaggctacagtggttcgtctgcctgttgggtatgaagtggcttcatttttcccataataaaaattgtttgaaggcttgcaaattgttggttactaaagaagtaaacaatatggactctaagacattgtttctcaaagcaatttctcaaggcataggtccatgattattattcttgagaaaaatatttccaaaaaactacattgagaaatactgtacaatgaatatccctttgggagattcataattgtcaaagattctgggaatatatttagtcaacaatactgcttgagcttgtttaacccagcattttctaaaattaatttataaatattatacacataacatttataatactttagtatgaattttctcataaatatttcttataagttttctcaccaatataatacttagcaaaaaccttgattttatttaaatgcaaattgagaaatatgcattttcccctaccaatctagattttcttgtggcttatttttgttagatattatttttaattcagataaagctggttaaacacattagtttcaattttaaagaaaatacatataatggaaaagattttattttgatgaataaaattcaaaatattacctcaaatttcagaagaaatattttcactaggctttgaaataaacattttcactagcttttacttttttcccaagatcaatcatgctaattctatgtgatcaatgaaaagctatgtctcttatgcaaaaagcaaagcctcagcaacaaatgctaaaataattgtgtcaagcatctagtacttctacaaaatactacattttgaaactctgacatttctcacatctcccctttatactccagcaaatcaaattactctgtctgagtgcttattcatttgagacaaccaaggacaaggaatttaataaagattcttcttatatccgcttttccccccacagaacctaaaccatcaacatgtatgttttgaacatgctctaaatctgcagtccccaactccagagccatggactggtcctggtccgaggcctgttaggaactgggccatgcagcaggaggttagcggtgcctgagctctgcctcctgtcagatcagcagcagcattagagtctcataggagcgggaatcctattgtgaactgcatatgcaagggatccaggttggacactccttataagaatctaatgcctgatgatctgaggtggaacagtttcatcctgaaaccatccccaaaccaagtccatggaaatattgtcttttgtgaaaccagtccttggtgccaaaaagaatggggatggctgctctaaatgctcaataactggaggaccatgaatatccctgctctcacgatacgacaacctggtagaggagacacgattaacatacatgaaatgatgcatttgtgagaaaaagactaggaagtctacacagccctatacctgcttgagtttttcttgttgttagggagaaatcaagactagtcttcacaccatgactgcagtgtgtgggaggtcactccagcatgtactgcagagaagtttggtatttagcctaactatttttgtcctacataataagtaaagcgtagatttcatgatcccgtagggttcttatagagtgcaaattcaaagatccttatctcatctgtgttaaaaattgaactcttccctaaccttttacttcatttgagttccaaagtgtgaataagcaactcacaggtcaaatgccaccacccaggaagcactcggttatcatccggcatcccttctctttaggagacacatgctactcttcaacgcatactccccagtaggacactccatacacatctgcagcatggtgtcatttgtcattggggatgaacacgttgtactgcccaactttgaaccagagagctgccgatttacggaacagtctctgttgattatgaaagctattggaaatgtgattgctaatttcaaagataagggtaaactctctgcagctttgaaggatctgcaaacagctcactaccctgtccccttccatgataaagaactaactgcacagcacttcagggtttttcatctttccttatggcgtttaatgaaaaaagttcaaataacaaaacctcctccaaacttcaaatttgcattccgggctatggttttggacttggagttactcaattcctccttggaagaggtttctttagtggaatggctggacgttaaatattgtatgcccacaagtgataaagagtattctgctgaggaagtagcagcagcaattaaaattcaagccatgtggagaggaacttacgttagattgcttatgaaagccagaataccagacacaaaagaaaatatcagtgttgcagatactcttcaaaaagtttgggctgtattggaaatgaatttagaacagtatgcagtttctctcttaagactaatgtttaaaagcaagtgcaagtctttggaatcttatccatgctatcaagatgaagaaactaagattgcttttgcagattatactgtgacttatcaagaacagccaccaaattcttggtttatagtattcagagaaacatttttggttcatcaagacatgattttggttcccaaagtatatactacacttccaatctgtatcctacacattgttaataatgacacaatggagcaagtgccaaaggtgttccaaaaagtggtgccttatctttataccaagaataagaagggatacacttttgtggcggaagcatttacaggcgacacatatgtagcagcctcacgatggaaactgcgtctcatcggttcttctgctccactgccatgcctctctcgagactctccatgcaattcctttgccataaaggaaatccgagattactacatacccaatgataagaaaattttattcaggtattcggttaaagttctaacaccacaacctgctacaatacaggtacgcacatccaaaccagatgcattcatcaagctgcaggtcctagaaaatgaagaaactatggtgagctccactggaaaaggccaagctataatcccagcatttcacttcttgaagagtgagaaaggtttgagctcccagtctagcaagcacattctttcatttcactctgcatccaagaaagagcaagaagtgtatgttaagaagaaagctgctcagggaattcagaaatcccccaagggtagagctgtaagtgcaatacaagacattggtctaccccttgtggaggaggaaactaccagtacacccactagagaagacagttccagcacaccactgcagaattacaagtatattatacagtgttcggtgttgtataacagttggcctctcactgaaagccagctgacatttgttcaagcactgaaagacttaaagaaaagtaataccaaagcttatggtgaaagacacgaggagttaattaacttaggaagcccagactcccacactattagtgagggacaaaaatcttcagtaacttccaaaacaacaaggaaaggcaaagaaaagtcttctgagaaagaaaagacagccaaagaaaaacaagcacctcgctttgagcctcagatatccactgttcaccctcaacaagaagacccaaataaaccctactggattttgaggttggtcactgaacacaatgaatcagaattatttgaagtgaaaaaggatacagaaagggcagatgaaatccgagccatgaaacaagcctgggagacaactgagccaggaagagcaatcaaggcttctcaggctcgtttgcattaccttagcgggttcattaagaaaacatctgatgctgagagtccgcctatatctgaaagccaaactaaaccaaaagaagaagtagaaacagctgcacgtggcgtaaaagaaccaaactcaaagaattctgcaggttcagagagcaaagagatgacacaaacaggatcagggagtgcggtgtggaagaagtggcaattgaccaaaggcttgagggatgtggcaaaatccacgagtagcgaaagtggaggagtgtcttcaccagggaaagaagagcgcgagcagagcacacggaaggaaaacattcaaacaggacctcgtacacgatctccaacaattttggaaacatctccacgacttattcgaaaagcactagaatttatggatttaagtcaatatgttcggaaaacagatacagatcctctgctgcaaacagatgaattgaatcagcagcaggcaatgcaaaaggcggaagaaattcatcagtttcgacagcataggaccagagtccttagcattcgaaacattgaccaagaagagcggttgaagttaaaggatgaagtcctggatatgtataaggaaatgcaggactccttagatgaagcccgacagaaaattttcgacatccgggaagagtacagaaacaaattgctggaagctgagcacctaaagctggaaactctggctgctcaggaagcagccatgaagctggagacagaaaagatgaccccagctcctgacacacagaaaaaaaagaaaggaaagaaaaagtaaccaggggatgtccaatactaccctgcttctggagagaaaaaatctatttgtaatgatctttaactgcctgctgttaagatattaggccaaatgaaaatagaaatttctctttcttagaaatattttaatgctaacttgttagttttcctcagaaagctagtatttgaagccatttgagtttaagatgctctaatttcaataaaatagcttccaaatatttaataaaatatgtttgacactctaaa

SEQ ID NO: 107184 - DNA, 242 bp, Homo sapiens
  Payload ID: 1037
  Gene Symbol: ADGB
  Gene Name: androglobin
  ENST ID: ENST00000473647
  CDS Start-End: 1-216
cctttgttcaatagctatggaaagtatgttgtgaaactttactggatgggttgctggagaaagataacaattgatgactttttgccttttgatgaagataacaatctattgcttccagctacaacttatgaatttgaactgtggccaatgcttttgtctaaagctattatcaagctggcaaatattgagtatgtaatgacactatcactcacatgaataaaaaaagcaaacaaaaacattaa

SEQ ID NO: 107185 - DNA, 5176 bp, Homo sapiens
  Payload ID: 1038
  Gene Symbol: ANGEL1
  Gene Name: angel homolog 1 (Drosophila)
  Uniprot ID: Q9UNK9
  ENST ID: ENST00000251089
  CDS Start-End: 114-2126
gttgaagcgcggcggcggcaccacgtgggccggaccgggccgggggcggggccgagctgagggaggacctgctggctgcagtgaggagcggaggcgggcgcgggcggccggccatgatcgcgtcgtgcttgtgttacctgctgctgccggccacgcgcctcttccgcgccctctcagatgctttcttcacatgtcgaaaaaatgtccttctggcgaacagctcatccccccaggtagagggcgactttgccatggcccctcggggccctgagcaggaggaatgtgagggcctgctgcagcagtggcgagaagaagggttgagccaggtgctctcaactgcaagtgaggggccccttatagataaaggactagcccagagcagcctggcacttctgatggataatcctggagaagagaatgctgcttcagaggacaggtggtccagcaggcagctgagtgaccttcgggctgcagagaacctggatgagcctttccctgagatgctaggagaggagccactgctggaggtggagggggtggagggctccatgtgggcagctatccccatgcagtcggagccccagtatgcagactgtgctgccctcccagtgggtgccctggccacagagcagtgggaagaggacccagcggtgttggcctggagcatagcacctgagcctgtgccccaggaagaggcttccatctggccctttgagggcctggggcagttgcagcctcccgcagtggaaataccatatcatgaaattttgtggcgagaatgggaggatttctccacccagccagatgctcagggcctgaaggcaggagatggccctcagttccagttcactctgatgtcttataacatcctggctcaggacctgatgcagcagagctcagagctctatctacattgccatccagacatcctcaattggaactatcgcttcgtgaacctcatgcaggaattccagcactgggaccctgatatcctgtgtctccaggaagtccaggaagatcattactgggagcagctggaaccctctctgcgaatgatgggctttacctgtttctacaagaggaggactgggtgtaaaaccgatggctgtgctgtctgctacaagcctaccagattccgcctgctctgtgctagccctgtggagtacttccggcctggcttggagctacttaatcgggataatgtgggcttagtgttgctactgcaaccactcgtcccagaaggcctgggacaagtctcggtggccccgctgtgtgtggcaaatacccatatcctttacaacccacgccggggcgatgtcaagctggcccagatggccattctcctggcggaagtggacaaggtggccagactgtcagatggcagccactgccccatcatcttgtgcggggacctaaattctgtccctgattcacctctctacaacttcatcagggatggagagctccagtaccatgggatgccagcctggaaggtatctggacaggaagacttctcccatcagctttaccagaggaagctgcaggccccactgtggcccagctccctgggcatcactgattgctgtcagtatgtcacctcctgtcaccccaagagatcagagagacgcaagtatggccgagacttcctgctacgtttccgcttctgcagcatcgcttgtcagcgaccagtaggactggtccttatggaaggagtgacagatactaagccagagcgacctgcgggttgggctgagtctgtccttgaggaagatgcatcggagcttgagcctgccttctccaggactgtaggtaccatccagcactgcctccacctgacgtcagtatatacccacttcctgccccagcgtggccgcccagaggtcactacaatgccattgggtcttggaatgacagtagattacatcttcttctcagctgagtcctgtgagaatgggaacagaactgatcacaggctgtatcgagatggaactctcaagctcctgggtcgtctctcccttctctctgaagagatactctgggctgccaatggcttacccaaccccttctgctcttcagaccacctctgcctgctagccagcttcgggatggaagtcaccgccccatgacagggctcccaggggaagagagcttctcttccagaagagctcactggatcagagactgtggaaaaatcccatgcatctagaaacttagatccaagaaacttacatcccctcccttccccctcctcgttccctttttcccacggttagactttctccaggcctggctgcgttctctgcctgtggtccttgccccaccccagcctcttcctaatcctgtgccacacactcagtggccctgggagaggcagaaggggggctcccccttccttccatgtatccagcgctcccccttgatttttaattaccagggttatgggagttcttgatttcattggttatttgctttcaggccgtttcttgatgtaccttctgacctgaccttttccctgccttcaggacttctgggcccagccctcttgccaggcatgcatatgtgagatatgcatatcatgtatgtgtcctcttggggtgagacttctgcacagccatgcctgcctctgaccagtccacttttcatgttggggctgtaggcctggggcaggttcagagtctacccaagtacctatgtatgagcaggcagcagcagggcatggccccatctctccttttagcctctgtgtttcattaggcattcatcctgccaaccagggcaggcccggcgtctgggctctgggaacaaatggggcccacatcctggagtggcaaattttgggggatgcgctacctgtcccagctggccctgtgcctccaacccagagctccccacagacctggtgtaatttcacaagggccatccctttccccaggcttccctgagggaggcggaagtttgaacccttatgtggggttcattgggctagggtagtggtatgaggtttaaaactatttaaggattaggaggagaaagagtcttcaggaaactcttgtttcactggactctgcagcctgcagaactggggcaagggtaggagttccagtaggggaaggagcaggtagactcttcagctgcctcagctgggactgaagacctaagctgattctctttcctctccactcctaagaagcaattttctgttcctctccttccaccactttttactttctgctatctcccatctcccgcttcccttccatttcctttctagaaaaccctggtatttagctcaggccaaactgcctcagcagaaaggtggccttggacaaaactggtccaagaatttgaagtggcagtacttgcggattggctctgtccagcaaggcctcagctgcttgttgcgtctgctttccctcccctaacagaagggtaccctggcttattcaggggactccttagtccacactgtgtcacctgcatgccttaatctttcattgctggggtgtggccttgggagatcctgggccagcccctccacacatctccctaagtcagagtggctgctggccctggtagatttgacttgctcttgcctcactcgacctccaaagtgggactgaagacagtggtcaagagacttgagttcgggacagtaagccaggggttaaggttctttcctttttttgaaagccaaagacccagtttgcattgtgctgctgcattcatggttagaagctttccatgcctaggttctagggaatttatttttctatgtgtatatattttcaaactttgtttcctgggtactgggcatgtgcctgtctgagccccaggtctgtctacaccccaccattcattctgtctgtctgttccctggacactgcctaaaagggtctcaagacagtgccctgtgggttcctaggactagggcccatcactgttctcttctgctgggaaatgcagctttaaaatggctaaccacagcagagggcagatgcttgatagattatcttttccttgctttcttgtttctgttttgaaagtgaaatggggttttaaattgttatttaaactctttttccaaataaaggtttaccttttttccccccaatgttgttcattttattaggatcctgaagggattaggtccttgagagagggcctgaagaatgaggtgggcagaggaagagactaaggagcttttgatcttggggtggggtctcaagacatgaatctagattgagaaatgtgttgtaagatctccctctattagctgaggtaaattcccactgctgtgaggcctgggaggaacagggcttgagtgaagcctcctgccttgacactgctggggtacagctttcttctgtccttcccaagtgagagaatgattctttggactgcttttcattcttcctccatctgctccccccatgcctcctcctagtatcttctgcacttcaggagggtctgtgcaaagtgggataagatgtgtgttttcctgattaaagctatggcagctgcatgagacatgatgcgggtggcacatgcctcttgctgagcatctatttctgatctcttttgcattctggagccagggctgagcagtgggccatctgtcgctggaaaaatgtctcttccttcctaggcctacctctgttggtgcttttgtcttccaacctccctatgtagtaagaccagccaagcccacatgcccactgggagccctgaaaccagatctggttttctgtcttacctgaacaggttcccagaacccacaccaggcctctgaatcagtctctgagaatctgattgatttaaagccacttggttgcttccattgcactacctgggttgcgatcccctcaattgatttagtaaaaagaaaacttagcggccgggtgcggtggctcacacctgtaatcccagcactttgggaggctgaggcgggtggatcacctgaggtcgagagttccagaccagcctgaccaacatgaagaaatcccgtctctactaaaaatacaaaattagccgggcgtgatggcgcatgcctgtaatcccagctacttggaggctgaggcaggagaattgcttgaacctgggaagcggaggttgtggtgagccgagatcatgccattgcactccagcctggacaacaagagtgaaactccatctcaaa

SEQ ID NO: 107186 - DNA, 1427 bp, Homo sapiens
  Payload ID: 1038
  Gene Symbol: ANGEL1
  Gene Name: angel homolog 1 (Drosophila)
  ENST ID: ENST00000557179
  CDS Start-End: 449-1156
tacgttttgtccgttcccaggctgctcattggctttgaccgaggatggtgacgtagatacggtaaagtgctttggtgctttcccatttggtttgaccctgtggttacccagtaataggttcaggatattagaccttgatccagaagatccaaagatgaggataaacctttaaccattgcaacttaaagcccctgagagttgatattccctgtggaggagaattgtattgatttttcagaggtaaaatttagggaaccacatgttcatactattcgattccccttgattcagtctcttacccctcctcctgtttcatggacatttcagtgttgccagtgaaaaagtaatggttttaatttggtccttatttttaacctgcccctgagacttatatgcttgtttataccatgtacgtagtgtgtgattgtatgtgtttgtatttgtccacatgtcccaaaacatgggctgttacttcctttttctatcttggtttccttattcccacccttctttttccacccaggtatctggacaggaagacttctcccatcagctttaccagaggaagctgcaggccccactgtggcccagctccctgggcatcactgattgctgtcagtatgtcacctcctgtcaccccaagagatcagagagacgcaagtatggccgagacttcctgctacgtttccgcttctgcagcatcgcttgtcagcgaccagtaggactggtccttatggaaggagtgacagatactaagccagagcgacctgcgggttgggctgagtctgtccttgaggaagatgcatcggagcttgagcctgccttctccaggactgtaggtaccatccagcactgcctccacctgacgtcagtatatacccacttcctgccccagcgtggccgcccagaggtcactacaatgccattgggtcttggaatgacagtagattacatcttcttctcagctgagtcctgtgagaatgggaacagaactgatcacaggctgtatcgagatggaactctcaagctcctgggtcgtctctcccttctctctgaagagatactctgggctgccaatggcttacccaaccccttctgctcttcagaccacctctgcctgctagccagcttcgggatggaagtcaccgccccatgacagggctcccaggggaagagagcttctcttccagaagagctcactggatcagagactgtggaaaaatcccatgcatctagaaacttagatccaagaaacttacatcccctcccttccccctcctcgttccctttttcccacggttagactttctccaggcctggctgcgttctctgcctgtggtccttgccccaccccagcctcttcctaatcctgtgccacacactcagtggccctgggagaggcagaaggggggctcccccttccttcc

SEQ ID NO: 107187 - DNA, 727 bp, Homo sapiens
  Payload ID: 1038
  Gene Symbol: ANGEL1
  Gene Name: angel homolog 1 (Drosophila)
  ENST ID: ENST00000556298
  CDS Start-End: 339-727
agtgaggagcggaggcgggcgcgggcggccggccatgatcgcgtcgtgcttgtgttacctgctgctgccggccacgcgcctcttccgcgccctctcagagatgaagtttcgttatgttgcccaggctggtctctaactcctggcctcaagtgatcctgctgcctctgtctctgcctcccaaagtgctgggagccaccacgcctggcctcttgtccccattttacagtcaagagtaacttcatctgactaggggcattgttcaagatgctttcttcacatgtcgaaaaaatgtccttctggcgaacagctcatccccccaggtagagggcgactttgccatggcccctcggggccctgagcaggaggaatgtgagggcctgctgcagcagtggcgagaagaagggttgagccaggtgctctcaactgcaagtgaggggccccttatagataaaggactagcccagagcagcctggcacttctgatggataatcctggagaagagaatgctgcttcagaggacaggtggtccagcaggcagctgagtgaccttcgggctgcagagaacctggatgagcctttccctgagatgctaggagaggagccactgctggaggtggagggggtggagggctccatgtgggcagctatccccatgcagtcggagccccagtatgcagactgtgctgccctcccagtgggtgccctggccacagagcagtgggaaga

SEQ ID NO: 107188 - DNA, 553 bp, Homo sapiens
  Payload ID: 1038
  Gene Symbol: ANGEL1
  Gene Name: angel homolog 1 (Drosophila)
  ENST ID: ENST00000555079
  CDS Start-End: 352-553
catcatcttgtgcggggacctaaattctgtccctgattcacctctctacaacttcatcagggatggagagctccagtaccatgggatgccagcctggaaggctgctcattggctttgaccgaggatggtgacgtagatacggtatctggacaggaagacttctcccatcagctttaccagaggaagctgcaggccccactgtggcccagctccctgggcatcactgattgctgtcagtatgtcacctcctgtcaccccaagagatcagagagacgcaagtatggccgagacttcctgctacgtttccgcttctgcagcatcgcttgtcagcgaccagtaggactggtccttatggaaggagtgacagatactaagccagagcgacctgcgggttgggctgagtctgtccttgaggaagatgcatcggagcttgagcctgccttctccaggactgtaggtaccatccagcactgcctccacctgacgtcagtatatacccacttcctgccccagcgtggccgcccagaggtcactacaatgccattgggtcttg

SEQ ID NO: 107189 - DNA, 4323 bp, Homo sapiens
  Payload ID: 1039
  Gene Symbol: ANGEL2
  Gene Name: angel homolog 2 (Drosophila)
  Uniprot ID: Q5VTE6
  ENST ID: ENST00000360506
  CDS Start-End: 337-1464
cggcgagactgcacctcccagcatgccttgcagccaggactggagtcggtacttaagagtgatggggttccctagatactttaggccgtcgcatcgattatagagattgaggtggaacccggggcctgggaactggacgcacgcggagggcgaagatggaagcctggcgctgtgtgaggaagggctacggccactgtgtggtgggaagaggccggtgtgataaagcggaattgggaatatatatgtagccatgataaagaaaaaacgaagatcctaggagacaaaaatgttgatcccaaatgtgaagacagtgagaacaagtttgacttttcagtgatgtcctataatatactttcacaagatttactggaagataactctcacctttatagacattgccggcggccagtattacactggagttttaggtttcccaatattctgaaagaaattaaacattttgatgcagacgtactttgtttgcaagaagttcaagaagatcattatggagcagagatcaggccaagtttggaatcactgggttatcactgtgaatataagatgcggacaggaaggaaacctgatggctgtgctatttgcttcaaacattccaaattttcactcttgtcagtgaacccagtggaattcttccgccctgatatttctctgttggacagagacaatgttggattagttttactcttacagcccaaaattccatatgctgcctgccctgcaatctgcgtagcaaatacgcatctgttgtataatccaaggcgaggtgatattaagctgacgcaattggcaatgctactggcagagatttccagtgttgcccaccagaaagatggcagcttctgccctattgttatgtgtggtgactttaattctgttcctggttctccactatatagtttcataaaggaaggaaaattgaattatgaaggacttcccataggaaaggtatctggccaggaacagtcttcacggggacaaagaattttatctattccaatttggcccccaaacctaggtatctcacagaactgtgtgtatgaggtacagcaggtaccaaaagtagaaaagacagacagtgatctgacacaaacacagctgaagcaaacagaggtcctagtgacagctgaaaaattgtcttcaaatttacagcaccatttcagtttgtcatctgtttattcacattactttcctgacactggaattccagaagtgaccacctgtcattcccgaagtgccataactgtggattatattttctactctgcagaaaaggaagatgttgctgggcacccaggagctgaagttgctttggttggtggcttgaaacttctagctagactgtcacttcttacagaacaagacttatggactgttaatggacttccaaacgaaaataactcttcagatcatctgcctttattggcaaagttcagacttgagctctgactctctttgatcacatactaattttctttccaatttgtattgtttttcaaagaatgtaaagttcttaagtgtatgcatgttgtttatttttgcactgtggagattctgaagcggttatgttagatgctttgaaactccatatcagaagaaataactttataacaattttttttaataatgaaaaatattttcgtgacaagtgagctctaaattctctttattgtaaaagagatgtaaaggttttatattctaaatcctagtaaaattgacagtgatttttaaatataatgcatcttcctttgtctgcttagtaaaaaatttcatttcataattttggcaagctctgtagtggatccaaagtatctttgagttcttgcaaactacaagttgtttcctttccagaaggcttgatttcattaggagacccctctattgagttctaaatagtttatcttagaaagccttgggtcattcacaggtatccaaccagccattgtttagtttgtttttgaaggggtttgataatgctttttaagttgtacagaatgcttaatccatcttattactgtcctgagccatgtaatatgcctgcatcgtgttggggaaatgtttgggaaatataagccagcataacgtgtaaagctcactctttcaccctggaacagacaagaggtgggcttaatagaggcagagactggggatatacctttgtttccctagcatttttatttatttatttttattttattttattttttgagatggagtttcactcttgttgcccaggctgggggtgcaatggcgcaatctttgctcactgcaacccctgcctcccgggctcaagcgattctcctgcctcagcctctcgagtagctgggattacaggcatgcgtcaccactcccagctaattttgtattttcagtagagacagggtttccccatgttggttaggctggtctcgaactcccaacctcaggtgatccgcccacctcagctctcaaagtgctgggattacaggcgggagccactgcacatggcagcattttttaaaaattcagttttaagatctctggtttaggggagagattttattttactgaaccagttctatagaaatttattttattaggaaatttgtctttggaacaaagtggcagctataaaattatttttgttaagcctcagaaatatgaggaagcctgtaaaactctagtggggagatattaacttggagacctaatgctctgtaaatagtcatttaaactgttggttttagtggttttgtttctaaaatgttttcttttaccgtgatgcaccagtatgagatggtgctgacactttctatgaagtggttatgagcaggtttaataaatcctctatacaagtgtttgaatcaattttaaaacataaaaagtggaaatttccttttttgtagacagtaggaacaaggaattatatgcatttttactaagtagtaattttacactgaattgtaaatgtttttacagtgagttttattaatagaatgcttcaccttaaattggaaaacaataatagtcttggactaagtctttgtactaaagcatttgctataattatttttaaaaaaacaaacagatgaaaacctcagagaaggcatgtggattataagatttgtctagtaaaaattgtaattgaatatgtttaaatatttaatttctcattttggggggtttttatttttttattttttagatggtgtctcacgctatcgcccaggctggagtgcagtggcgcgaactcggctcactgcaacctccgcctcctgggttcaagcaattctccttcctcagcctcccaagtagctgggattacaggcatgcaccaccatgcccagctaatttttgtatttttagtagagatggaattttgccatgttggccaggctggtcttgaactcctgacctcaggggtgatccacccgcctcgggctcccaaagtgctgtgattacaggcatgagccaccatgcctggcctttggggggattttaattacagtattaattatagttctaggatttcccacattttatagtagtagtttgcaggatattatgtgccctaattagcagatatagacattatcaaattataatgatagtataattatccctttttaatattggggaaagaaaaatgaaaattcattagttaattactgctttgtgttgtgtgaatttattaacaaataacattattacatataggtcattgttaacaaacaaacatccctgaaaacctctgtgaaaatttaattttttatatcctgattaatatattgtgactttaggcccatttttcatgtgcttcactttgatagagttaatccataaaattgctctttactttagcttatcaaatgaagtattattttgtggactggaggccaaaaagtcaatgtgagcttctcacaggtttttaaagctccactaaaaataattatccacttgtctttacttttgttgaccagaatagttggtaactctgccagagcctgtacttacctgccaaaaacaattaaatctggttaatgcctgaaaccaaatctctcagtctcaagtgttatactatccaagttttaaatggaaaggtaaactgtggagtaatgaaattttggttttactgtaccttttgctatcaagataatattcatgtttgaaatcttgtctttatttggaatttagttactgtctgcttttaacctttgctttcctaaagaaagtttgagatccagagagttcaagggattggggaaagagaggcgtcaagtcatttgcactttgtacctgtaagttaggtaataaactattatactcgta

SEQ ID NO: 107190 - DNA, 4649 bp, Homo sapiens
  Payload ID: 1039
  Gene Symbol: ANGEL2
  Gene Name: angel homolog 2 (Drosophila)
  Uniprot ID: Q5VTE6
  ENST ID: ENST00000366962
  CDS Start-End: 156-1790
cggcgagactgcacctcccagcatgccttgcagccaggactggagtcggtacttaagagtgatggggttccctagatactttaggccgtcgcatcgattatagagattgaggtggaacccggggcctgggaactggacgcacgcggagggcgaagatggaagcctggcgctgtgtgaggaagggctacggccactgtgtggtgggaagaggccgataccccatgtttccccatcactcgaggagtctgggcagagactggactacaccgtgggagaatctgcaaaggtgttgctggaacagacatatttctagttgtatgaggtggcctggacattactctcgagctccttacccatacttcagtagtaggcatttttcactaaattggagaccaccctgtttgtttgagtctagaactcagttccagtactgtaactggagacctgacaacctgagccagacatctttgattcatctctctagttacgtcatgaacgctgagggagatgagccttcatcaaaacgaagaaaacaccaaggtgtgataaagcggaattgggaatatatatgtagccatgataaagaaaaaacgaagatcctaggagacaaaaatgttgatcccaaatgtgaagacagtgagaacaagtttgacttttcagtgatgtcctataatatactttcacaagatttactggaagataactctcacctttatagacattgccggcggccagtattacactggagttttaggtttcccaatattctgaaagaaattaaacattttgatgcagacgtactttgtttgcaagaagttcaagaagatcattatggagcagagatcaggccaagtttggaatcactgggttatcactgtgaatataagatgcggacaggaaggaaacctgatggctgtgctatttgcttcaaacattccaaattttcactcttgtcagtgaacccagtggaattcttccgccctgatatttctctgttggacagagacaatgttggattagttttactcttacagcccaaaattccatatgctgcctgccctgcaatctgcgtagcaaatacgcatctgttgtataatccaaggcgaggtgatattaagctgacgcaattggcaatgctactggcagagatttccagtgttgcccaccagaaagatggcagcttctgccctattgttatgtgtggtgactttaattctgttcctggttctccactatatagtttcataaaggaaggaaaattgaattatgaaggacttcccataggaaaggtatctggccaggaacagtcttcacggggacaaagaattttatctattccaatttggcccccaaacctaggtatctcacagaactgtgtgtatgaggtacagcaggtaccaaaagtagaaaagacagacagtgatctgacacaaacacagctgaagcaaacagaggtcctagtgacagctgaaaaattgtcttcaaatttacagcaccatttcagtttgtcatctgtttattcacattactttcctgacactggaattccagaagtgaccacctgtcattcccgaagtgccataactgtggattatattttctactctgcagaaaaggaagatgttgctgggcacccaggagctgaagttgctttggttggtggcttgaaacttctagctagactgtcacttcttacagaacaagacttatggactgttaatggacttccaaacgaaaataactcttcagatcatctgcctttattggcaaagttcagacttgagctctgactctctttgatcacatactaattttctttccaatttgtattgtttttcaaagaatgtaaagttcttaagtgtatgcatgttgtttatttttgcactgtggagattctgaagcggttatgttagatgctttgaaactccatatcagaagaaataactttataacaattttttttaataatgaaaaatattttcgtgacaagtgagctctaaattctctttattgtaaaagagatgtaaaggttttatattctaaatcctagtaaaattgacagtgatttttaaatataatgcatcttcctttgtctgcttagtaaaaaatttcatttcataattttggcaagctctgtagtggatccaaagtatctttgagttcttgcaaactacaagttgtttcctttccagaaggcttgatttcattaggagacccctctattgagttctaaatagtttatcttagaaagccttgggtcattcacaggtatccaaccagccattgtttagtttgtttttgaaggggtttgataatgctttttaagttgtacagaatgcttaatccatcttattactgtcctgagccatgtaatatgcctgcatcgtgttggggaaatgtttgggaaatataagccagcataacgtgtaaagctcactctttcaccctggaacagacaagaggtgggcttaatagaggcagagactggggatatacctttgtttccctagcatttttatttatttatttttattttattttattttttgagatggagtttcactcttgttgcccaggctgggggtgcaatggcgcaatctttgctcactgcaacccctgcctcccgggctcaagcgattctcctgcctcagcctctcgagtagctgggattacaggcatgcgtcaccactcccagctaattttgtattttcagtagagacagggtttccccatgttggttaggctggtctcgaactcccaacctcaggtgatccgcccacctcagctctcaaagtgctgggattacaggcgggagccactgcacatggcagcattttttaaaaattcagttttaagatctctggtttaggggagagattttattttactgaaccagttctatagaaatttattttattaggaaatttgtctttggaacaaagtggcagctataaaattatttttgttaagcctcagaaatatgaggaagcctgtaaaactctagtggggagatattaacttggagacctaatgctctgtaaatagtcatttaaactgttggttttagtggttttgtttctaaaatgttttcttttaccgtgatgcaccagtatgagatggtgctgacactttctatgaagtggttatgagcaggtttaataaatcctctatacaagtgtttgaatcaattttaaaacataaaaagtggaaatttccttttttgtagacagtaggaacaaggaattatatgcatttttactaagtagtaattttacactgaattgtaaatgtttttacagtgagttttattaatagaatgcttcaccttaaattggaaaacaataatagtcttggactaagtctttgtactaaagcatttgctataattatttttaaaaaaacaaacagatgaaaacctcagagaaggcatgtggattataagatttgtctagtaaaaattgtaattgaatatgtttaaatatttaatttctcattttggggggtttttatttttttattttttagatggtgtctcacgctatcgcccaggctggagtgcagtggcgcgaactcggctcactgcaacctccgcctcctgggttcaagcaattctccttcctcagcctcccaagtagctgggattacaggcatgcaccaccatgcccagctaatttttgtatttttagtagagatggaattttgccatgttggccaggctggtcttgaactcctgacctcaggggtgatccacccgcctcgggctcccaaagtgctgtgattacaggcatgagccaccatgcctggcctttggggggattttaattacagtattaattatagttctaggatttcccacattttatagtagtagtttgcaggatattatgtgccctaattagcagatatagacattatcaaattataatgatagtataattatccctttttaatattggggaaagaaaaatgaaaattcattagttaattactgctttgtgttgtgtgaatttattaacaaataacattattacatataggtcattgttaacaaacaaacatccctgaaaacctctgtgaaaatttaattttttatatcctgattaatatattgtgactttaggcccatttttcatgtgcttcactttgatagagttaatccataaaattgctctttactttagcttatcaaatgaagtattattttgtggactggaggccaaaaagtcaatgtgagcttctcacaggtttttaaagctccactaaaaataattatccacttgtctttacttttgttgaccagaatagttggtaactctgccagagcctgtacttacctgccaaaaacaattaaatctggttaatgcctgaaaccaaatctctcagtctcaagtgttatactatccaagttttaaatggaaaggtaaactgtggagtaatgaaattttggttttactgtaccttttgctatcaagataatattcatgtttgaaatcttgtctttatttggaatttagttactgtctgcttttaacctttgctttcctaaagaaagtttgagatccagagagttcaagggattggggaaagagaggcgtcaagtcatttgcactttgtacctgtaagttaggtaataaactattatactcgta

SEQ ID NO: 107191 - DNA, 2517 bp, Homo sapiens
  Payload ID: 1039
  Gene Symbol: ANGEL2
  Gene Name: angel homolog 2 (Drosophila)
  Uniprot ID: Q5VTE6
  ENST ID: ENST00000535388
  CDS Start-End: 341-1468
cggcgagactgcacctcccagcatgccttgcagccaggactggagtcggtacttaagagtgatggggttccctagatactttaggccgtcgcatcgattatagagattgaggtggaacccggggcctgggaactggacgcacgcggagggcgaagatggaagcctggcgctgtgtgaggaagggctacggccactgtgtggtgggaagaggccggtcagtgtgataaagcggaattgggaatatatatgtagccatgataaagaaaaaacgaagatcctaggagacaaaaatgttgatcccaaatgtgaagacagtgagaacaagtttgacttttcagtgatgtcctataatatactttcacaagatttactggaagataactctcacctttatagacattgccggcggccagtattacactggagttttaggtttcccaatattctgaaagaaattaaacattttgatgcagacgtactttgtttgcaagaagttcaagaagatcattatggagcagagatcaggccaagtttggaatcactgggttatcactgtgaatataagatgcggacaggaaggaaacctgatggctgtgctatttgcttcaaacattccaaattttcactcttgtcagtgaacccagtggaattcttccgccctgatatttctctgttggacagagacaatgttggattagttttactcttacagcccaaaattccatatgctgcctgccctgcaatctgcgtagcaaatacgcatctgttgtataatccaaggcgaggtgatattaagctgacgcaattggcaatgctactggcagagatttccagtgttgcccaccagaaagatggcagcttctgccctattgttatgtgtggtgactttaattctgttcctggttctccactatatagtttcataaaggaaggaaaattgaattatgaaggacttcccataggaaaggtatctggccaggaacagtcttcacggggacaaagaattttatctattccaatttggcccccaaacctaggtatctcacagaactgtgtgtatgaggtacagcaggtaccaaaagtagaaaagacagacagtgatctgacacaaacacagctgaagcaaacagaggtcctagtgacagctgaaaaattgtcttcaaatttacagcaccatttcagtttgtcatctgtttattcacattactttcctgacactggaattccagaagtgaccacctgtcattcccgaagtgccataactgtggattatattttctactctgcagaaaaggaagatgttgctgggcacccaggagctgaagttgctttggttggtggcttgaaacttctagctagactgtcacttcttacagaacaagacttatggactgttaatggacttccaaacgaaaataactcttcagatcatctgcctttattggcaaagttcagacttgagctctgactctctttgatcacatactaattttctttccaatttgtattgtttttcaaagaatgtaaagttcttaagtgtatgcatgttgtttatttttgcactgtggagattctgaagcggttatgttagatgctttgaaactccatatcagaagaaataactttataacaattttttttaataatgaaaaatattttcgtgacaagtgagctctaaattctctttattgtaaaagagatgtaaaggttttatattctaaatcctagtaaaattgacagtgatttttaaatataatgcatcttcctttgtctgcttagtaaaaaatttcatttcataattttggcaagctctgtagtggatccaaagtatctttgagttcttgcaaactacaagttgtttcctttccagaaggcttgatttcattaggagacccctctattgagttctaaatagtttatcttagaaagccttgggtcattcacaggtatccaaccagccattgtttagtttgtttttgaaggggtttgataatgctttttaagttgtacagaatgcttaatccatcttattactgtcctgagccatgtaatatgcctgcatcgtgttggggaaatgtttgggaaatataagccagcataacgtgtaaagctcactctttcaccctggaacagacaagaggtgggcttaatagaggcagagactggggatatacctttgtttccctagcatttttatttatttatttttattttattttattttttgagatggagtttcactcttgttgcccaggctgggggtgcaatggcgcaatctttgctcactgcaacccctgcctcccgggctcaagcgattctcctgcctcagcctctcgagtagctgggattacaggcatgcgtcaccactcccagctaattttgtattttcagtagagacagggtttccccatgttggttaggctggtctcgaactcccaacctcaggtgatccgcccacctcagctctcaaagtgctgggattacaggcgggagccactgcacatggcagcatttttt

SEQ ID NO: 107192 - DNA, 1244 bp, Homo sapiens
  Payload ID: 1039
  Gene Symbol: ANGEL2
  Gene Name: angel homolog 2 (Drosophila)
  ENST ID: ENST00000621746
  CDS Start-End: 11-799
tagataccccatgtttccccatcactcgaggagtctgggcagagactggactacaccgtgggagaatctgcaaaggtgttgctggaacagacatatttctagttgtatgaggtggcctggacattactctcgagctccttacccatacttcagtagtaggcatttttcactaaattggagaccaccctgtttgtttgagtctagaactcagttccagtactgtaactggagacctgacaacctgagccagacatctttgattcatctctctagttacgtcatgaacgctgagggagatgagccttcatcaaaacgaagaaaacaccaaggtgtgataaagcggaattgggaatatatatgtagccatgataaagaaaaaacgaagatcctaggagacaaaaatgttgatcccaaatgtgaagacagtgagaacaagtttgacttttcagtgatgtcctataatatactttcacaagatttactggaagataactctcacctttatagacattgccggcggccagtattacactggagttttaggtttcccaatattctgaaagaaattaaacattttgatgcagacgtactttgtttgcaagaagttcaagaagatcattatggagcagagatcaggccaagtttggaatcactgggtacaatgcaacttttttttttttttttcttttttgagacagggtctcactctgtcgcccaactggagtgcagtggcacaatcatggctcactacagcctcaacctactgggctcaagtaatcctctcatttcggcttcctgagtagctgggactagagatgtgtgccaccatgcccggccaattatttaattttttttatagagacaaggcaatgtaacttttagccaaatttacttttgaaaattcatgtgtcattaaagtataacttgctgacaaagatgtgtggcatattttggctaaaaatcttaattttaaaaacttaatttcaaagaggaaaagattgaggtactcactggaaacttttgtgttggtgtataattttaattcaaacagaaagatgtgtaagaatatcttagtagctccctttcctaggagttgttctgtccacctgtagacctataagcttctgagctccaggagaccattttgtctcgttcatcattataataccagtgcctgccagtgtctacctaatggatagatgccaaaaacctgtttgataaataaacactcctagaaacaagtt

SEQ ID NO: 107193 - DNA, 1886 bp, Homo sapiens
  Payload ID: 1040
  Gene Symbol: AAMP
  Gene Name: angio-associated, migratory cell protein
  Uniprot ID: Q13685
  ENST ID: ENST00000248450
  CDS Start-End: 172-1476
gcggccagccaaccttcgtagctattggccgaacggccgtcgctcttcctgctggggagtcgcctacgcctacttcctgccgggaggaggggctcgagttccgcgtcgtcgcgcagagctgactctgggaggcgtttgggcccagagaagtggatccgccgcttgcgccgcatggagtccgaatcggaaagcggggctgctgctgacacccccccactggagaccctaagcttccatggtgatgaagagattatcgaggtggtagaacttgatcccggtccgccggacccagatgacctggcccaggagatggaagatgtggactttgaggaagaagaggaggaagagggcaacgaagagggctgggttctagaaccccaggaaggggtggtcggcagcatggagggccccgacgatagcgaggtcacctttgcattgcactcagcatctgtgttttgtgtgagcctggaccccaagaccaataccttggcagtgaccgggggtgaagatgacaaagccttcgtatggcggctcagcgatggggagctgctctttgagtgtgcaggccataaagactctgtgacttgtgctggtttcagccatgactccactctagtggccacaggggacatgagtggcctcttgaaagtgtggcaggtggacactaaggaggaggtctggtcctttgaagcgggagacctggagtggatggagtggcatcctcgggcacctgtcctgttggcgggcacagctgacggcaacacctggatgtggaaagtcccgaatggtgactgcaagaccttccagggtcccaactgcccagccacctgtggccgagtcctccctgatgggaagagagctgtggtaggctatgaagatgggaccatcaggatttgggacctgaagcagggaagccctatccatgtactgaaagggactgagggtcaccagggcccactcacctgtgttgctgccaaccaggatggcagcttgatcctaactggctctgtggactgccaggccaagctggtcagtgccaccaccggcaaggtggtgggtgtttttagacctgagactgtggcctcccagcccagcctgggagaaggggaggagagtgagtccaactcggtggagtccttgggcttctgcagtgtgatgcccctggcagctgttggctacctggatgggaccttggccatctatgacctggctacgcagactcttaggcatcagtgtcagcaccagtcgggcatcgtgcagctgctgtgggaggcaggcactgccgtggtatatacctgcagcctggatggcatcgtgcgcctctgggacgcccggaccggccgcctgcttactgactaccggggccacacggctgagatcctggactttgccctcagcaaagatgcctccctggtggtgaccacgtcaggagaccacaaagcgaaagtattttgtgtccaaaggcctgaccgttaatggctgcagcccctgcctgtgtgtctggtgttgaggggacgaagggacccctgcccctgtctgccagcagaggcagtagggcacagagggaagaggagggtggggccctggatgactttccagcctcttcaactgacttgctcccctctccttttcttctctttagagacccagcccagggccctcccacccttgtccagacctggtgggcccttcagagggaggggtggacctgtttctctttcactttcatttgctggtgtgagccatggggtgtgtatttgtatgtggggagtaggtgtttgaggttcccgttctttcccttcccaagtctctgggggtggaaaggaggaagagatactagttaaagattttaaaaatgtaaataaaatatacttcccagagacaga

SEQ ID NO: 107194 - DNA, 671 bp, Homo sapiens
  Payload ID: 1040
  Gene Symbol: AAMP
  Gene Name: angio-associated, migratory cell protein
  ENST ID: ENST00000447885
  CDS Start-End: 70-671
ctggccagccgtggcctcccgtcctgtgtcccgcgcgcccccgcggaccccgatgacctggcccaggagatggaagatgtggactttgaggaagaagaggaggaagagggcaacgaagagggctgggttctagaaccccaggaaggggtggtcggcagcatggagggccccgacgatagcgaggtcacctttgcattgcactcagcatctgtgttttgtgtgagcctggaccccaagaccaataccttggcagtgaccgggggtgaagatgacaaagccttcgtatggcggctcagcgatggggagctgctctttgagtgtgcaggccataaagactctgtgacttgtgctggtttcagccatgactccactctagtggccacaggggacatgagtggcctcttgaaagtgtggcaggtggacactaaggaggaggtctggtcctttgaagcgggagacctggagtggatggagtggcatcctcgggcacctgtcctgttggcgggcacagctgacggcaacacctggatgtggaaagtcccgaatggtgactgcaagaccttccagggtcccaactgcccagccacctgtggccgagtcctccctgatgggaagagagctgtggtaggctatgaagatgggaccatcaggatttgggacctgaagcaggg

SEQ ID NO: 107195 - DNA, 742 bp, Homo sapiens
  Payload ID: 1040
  Gene Symbol: AAMP
  Gene Name: angio-associated, migratory cell protein
  ENST ID: ENST00000422731
  CDS Start-End: 1-569
ctatccatgtactgaaaggtatcagagggactgagggtcaccagggcccactcacctgtgttgctgccaaccaggatggcagcttgatcctaactggctctgtggactgccaggccaagctggtcagtgccaccaccggcaaggtggtgggtgtttttagacctgagactgtggcctcccagcccagcctgggagaaggggaggagagtgagtccaactcggtggagtccttgggcttctgcagtgtgatgcccctggcagctgttggctacctggatgggaccttggccatctatgacctggctacgcagactcttaggcatcagtgtcagcaccagtcgggcatcgtgcagctgctgtgggaggcaggcactgccgtggtatatacctgcagcctggatggcatcgtgcgcctctgggacgcccggaccggccgcctgcttactgactaccggggccacacggctgagatcctggactttgccctcagcaaagatgcctccctggtggtgaccacgtcaggagaccacaaagcgaaagtattttgtgtccaaaggcctgaccgttaatggctgcagcccctgcctgtgtgtctggtgttgaggggacgaagggacccctgcccctgtctgccagcagaggcagtagggcacagagggaagaggagggtggggccctggatgactttccagcctcttcaactgacttgctcccctctccttttcttctctttagagaccca

SEQ ID NO: 107196 - DNA, 1804 bp, Homo sapiens
  Payload ID: 1040
  Gene Symbol: AAMP
  Gene Name: angio-associated, migratory cell protein
  ENST ID: ENST00000444053
  CDS Start-End: 93-1400
ccgggaggaggggctcgagttccgcgtcgtcgcgcagagctgactctgggaggcgtttgggcccagagaagtggatccgccgcttgcgccgcatggagtccgaatcggaaagcggggctgctgctgacacccccccactggagaccctaagcttccatggtgatgaagagattatcgaggtggtagaacttgatcccggtccgccggacccagcagatgacctggcccaggagatggaagatgtggactttgaggaagaagaggaggaagagggcaacgaagagggctgggttctagaaccccaggaaggggtggtcggcagcatggagggccccgacgatagcgaggtcacctttgcattgcactcagcatctgtgttttgtgtgagcctggaccccaagaccaataccttggcagtgaccgggggtgaagatgacaaagccttcgtatggcggctcagcgatggggagctgctctttgagtgtgcaggccataaagactctgtgacttgtgctggtttcagccatgactccactctagtggccacaggggacatgagtggcctcttgaaagtgtggcaggtggacactaaggaggaggtctggtcctttgaagcgggagacctggagtggatggagtggcatcctcgggcacctgtcctgttggcgggcacagctgacggcaacacctggatgtggaaagtcccgaatggtgactgcaagaccttccagggtcccaactgcccagccacctgtggccgagtcctccctgatgggaagagagctgtggtaggctatgaagatgggaccatcaggatttgggacctgaagcagggaagccctatccatgtactgaaagggactgagggtcaccagggcccactcacctgtgttgctgccaaccaggatggcagcttgatcctaactggctctgtggactgccaggccaagctggtcagtgccaccaccggcaaggtggtgggtgtttttagacctgagactgtggcctcccagcccagcctgggagaaggggaggagagtgagtccaactcggtggagtccttgggcttctgcagtgtgatgcccctggcagctgttggctacctggatgggaccttggccatctatgacctggctacgcagactcttaggcatcagtgtcagcaccagtcgggcatcgtgcagctgctgtgggaggcaggcactgccgtggtatatacctgcagcctggatggcatcgtgcgcctctgggacgcccggaccggccgcctgcttactgactaccggggccacacggctgagatcctggactttgccctcagcaaagatgcctccctggtggtgaccacgtcaggagaccacaaagcgaaagtattttgtgtccaaaggcctgaccgttaatggctgcagcccctgcctgtgtgtctggtgttgaggggacgaagggacccctgcccctgtctgccagcagaggcagtagggcacagagggaagaggagggtggggccctggatgactttccagcctcttcaactgacttgctcccctctccttttcttctctttagagacccagcccagggccctcccacccttgtccagacctggtgggcccttcagagggaggggtggacctgtttctctttcactttcatttgctggtgtgagccatggggtgtgtatttgtatgtggggagtaggtgtttgaggttcccgttctttcccttcccaagtctctgggggtggaaaggaggaagagatactagttaaagattttaaaaatgtaaataaaatatacttcccaga

SEQ ID NO: 107197 - DNA, 1761 bp, Homo sapiens
  Payload ID: 1040
  Gene Symbol: AAMP
  Gene Name: angio-associated, migratory cell protein
  ENST ID: ENST00000420660
  CDS Start-End: 143-1390
tccccttggccctcccttaccgcacggtctctggccagccgtggcctcccgtcctgtgtcccgcgcgcccccgcggaccccggtgtgtctgactccaccttcccttctcgccacatgacccgccccagcctcaggcctcctcatgcttctctccgtacctcttaccgcctcccgagccccatcttctaaccctctccccaaagcagatgacctggcccaggagatggaagatgtggactttgaggaagaagaggaggaagagggcaacgaagagggctgggttctagaaccccaggaaggggtggtcggcagcatggagggccccgacgatagcgaggtcacctttgcattgcactcagcatctgtgttttgtgtgagcctggaccccaagaccaataccttggcagtgaccgggggtgaagatgacaaagccttcgtatggcggctcagcgatggggagctgctctttgagtgtgcaggccataaagactctgtgacttgtgctggtttcagccatgactccactctagtggccacaggggacatgagtggcctcttgaaagtgtggcaggtggacactaaggaggaggtctggtcctttgaagcgggagacctggagtggatggagtggcatcctcgggcacctgtcctgttggcgggcacagctgacggcaacacctggatgtggaaagtcccgaatggtgactgcaagaccttccagggtcccaactgcccagccacctgtggccgagtcctccctgatgggaagagagctgtggtaggctatgaagatgggaccatcaggatttgggacctgaagcagggaagccctatccatgtactgaaagggactgagggtcaccagggcccactcacctgtgttgctgccaaccaggatggcagcttgatcctaactggctctgtggactgccaggccaagctggtcagtgccaccaccggcaaggtggtgggtgtttttagacctgagactgtggcctcccagcccagcctgggagaaggggaggagagtgagtccaactcggtggagtccttgggcttctgcagtgtgatgcccctggcagctgttggctacctggatgggaccttggccatctatgacctggctacgcagactcttaggcatcagtgtcagcaccagtcgggcatcgtgcagctgctgtgggaggcaggcactgccgtggtatatacctgcagcctggatggcatcgtgcgcctctgggacgcccggaccggccgcctgcttactgactaccggggccacacggctgagatcctggactttgccctcagcaaagatgcctccctggtggtgaccacgtcaggagaccacaaagcgaaagtattttgtgtccaaaggcctgaccgttaatggctgcagcccctgcctgtgtgtctggtgttgaggggacgaagggacccctgcccctgtctgccagcagaggcagtagggcacagagggaagaggagggtggggccctggatgactttccagcctcttcaactgacttgctcccctctccttttcttctctttagagacccagcccagggccctcccacccttgtccagacctggtgggcccttcagagggaggggtggacctgtttctctttcactttcatttgctggtgtgagccatggggtgtgtatttgtatgtggggagtaggtgtttgaggttcccgttctttcccttcccaagtctctgggggtggaaaggaggaagagatactagttaaaga

SEQ ID NO: 107198 - DNA, 4509 bp, Homo sapiens
  Payload ID: 1041
  Gene Symbol: AGGF1
  Gene Name: angiogenic factor with G patch and FHA domains 1
  Uniprot ID: Q8N302
  ENST ID: ENST00000312916
  CDS Start-End: 383-2527
ggtcccgcctgccgctggcgccgttgtttccggctcaactggggagctgctggagctcttctggcctctggttttccgactgcttatccgacgctcctccctctgtctctgtagctggagaaggtagtttccaggaaagttttccggtttgcaggccgcgcacatcgggcaggggccatcctcggtccccttgctcgttgctcgcagccccgttcggctacaagtgagtttcagggcgtcatggccaggggccaccgcggccagccgggtgtgaggctgcctttcgctgcccgcgcgctccagtggtctctgggtccgccggcgtccgtttcggcctgaacgcagcccctccgcggcgacgagcagtctcgcgccggagctcatggcctcggaggcgccgtccccgccgcggtcgccgccgccgcccacctcccccgagcctgagctggcccagctaaggcggaaggtggagaagttggaacgtgaactgcggagctgcaagcggcaggtgcgggagatcgagaagctgctgcatcacacagaacggctgtaccagaacgcagaaagcaacaaccaggagctccgcacgcaggtggaagaactcagtaaaatactccaacgtgggagaaatgaagataataaaaagtctgatgtagaagtacaaacagagaaccatgctccttggtcaatctcagattatttttatcagacgtactacaatgacgttagtcttccaaataaagtgactgaactgtcagatcaacaagatcaagctatcgaaacttctattttgaattctaaagaccatttacaagtagaaaatgatgcttaccctggtaccgatagaacagaaaatgttaaatatagacaagtggaccattttgcctcaaattcacaggagccagcatctgcattagcaacagaagatacctccttagaaggctcatcattagctgaaagtttgagagctgcagcagaagcggctgtatcacagactggatttagttatgatgaaaatactggactgtattttgaccacagcactggtttctattatgattctgaaaatcaactctattatgatccttccactggaatttattactattgtgatgtggaaagtggtcgttatcagtttcattctcgagtagatttgcaaccttatccgacttctagcacaaaacaaagtaaagataaaaaattgaagaagaaaagaaaagatccagattcttctgcaacaaatgaggaaaaggatttgaactcagaggatcaaaaagccttcagtgttgaacatacaagctgcaatgaggaagaaaatttcgcaaatatgaaaaagaaggccaaaataggcattcatcacaaaaatagtccccccaaagtcactgttccaactagtggaaatactatagagtctcctcttcatgaaaacatctctaattcaacatcatttaaagatgagaaaatcatggagactgatagtgaaccagaggaaggtgaaattacagactctcagactgaggatagttatgacgaagccattaccagtgaaggcaatgtaactgcagaagatagtgaggatgaagatgaagacaaaatttggcccccatgtattagagtaattgtcattagatcacctgtgttgcagataggatcactctttatcattactgctgtaaaccctgctacaattggaagagaaaaggatatggaacatactctccgaatccctgaagttggtgtcagtaagtttcatgcagaaatttattttgaccatgacttacaaagttatgtccttgtggatcaaggcagtcaaaatggcacaattgttaatggaaaacagattcttcagccgaaaactaaatgtgacccttacgtacttgagcatggagatgaagtcaaaattggagaaactgtcttatcctttcacattcatcctggcagtgatacctgtgatggctgtgaaccagggcaggttagagcccaccttcgccttgataagaaagatgaatcttttgttggtccaacactaagtaaggaggaaaaagagttggaaagaagaaaagaattaaagaaaatacgagtaaaatatggtttacagaatacagaatacgaagatgaaaagacattgaagaatccaaaatataaagatagagctggaaaacgtagggagcaggttggaagtgaaggaactttccaaagagatgatgctcctgcatctgttcattctgaaattactgatagcaacaaaggtcggaagatgttggagaagatgggttggaagaaaggagagggcctggggaaggatggtggaggaatgaaaacgccgatccagcttcagcttcggcgaacacatgcaggcttggggacaggcaaaccatcctcatttgaagatgttcaccttctccaaaacaagaacaaaaaaaactgggacaaagcacgagagcggtttactgaaaacttcccagaaactaagcctcaaaaagatgacccagggaccatgccttgggtaaaagggactttagagtgaaggctaatcatagaaaaaaaacctctagtttttttaaaaatagaatttggaaacttattttttctccccaaaagaatcagcagcacaggggaactatgtcacagtttacctcttcctgattcagaaatgtgtatggtttgcagcttttaaaaaccatttttttaaaactaataaatagtgactgaaccaatttatgcagtaaatagactaaagttcacagggcacggatgagtttatcaaacttcgttattttatcttgtcatttacaacatccatataagcaactagccatataagcaaaattcatagaactactaatgacttaagtgtacatctgttcttgtctccatatattcatgtaagatgcacaacaaaagaaacatcagaagtttataaaaataaatctgactatatgcatcctcatttattccctttagaacctaggtaaaaaatgttgcgaaaacatgggtagtggcgcatacattttgttatccttgaaatagcctaagtaatgttattgaagaactaatgaacaggtaacatattgtagaaaattagtctttcattgttttcttctgtgaagaatctgttgctatgtactgtatattcagcatttatatttggtttgtttcatagctaatgaggtatttagatatgaacaactgaatacatattgaaatagtgtgctggcttttgtagttttgataaagaccattgcaggcaatggaattgtgccagagaaatctgatttctagtacaaaaggaatacttagccagggcctcaagctcaagatacttattgaaaacatcctcaattgcaataaaaacattataacatgaaaaagagtgattttttgaaccggtgatttaaatgtattgatctgctttgaattttcaagcagccagaattttctagtttaaattggcagagttataacaaaggagagcctcaaatattagacaattgcagtgcggctttctgggcacaggtgtcactgctctgccacctatcactattctttttctgttcagtttttctctcaggtgtttgctgggaaattaacactggaactgacccttttctggcagtgaatgtaagctctagctcccccatctactataaagaaatgtcttcgagatgtagaaataaggaatattctgaaaataaaaattatacagtagtaaagataattcagaaagaaaaagctacctgttagaatttccagtctaaatggcacagggtagttacggagaaaaggggatggagaaggagaaactatgactaaagatgagaggtatgaacgagttgtcaggttcctatgggcttaagctaggacaatcaggccctaaactccaaatttggataaaatatctctttgcattcttcttggccacctgcatagtctgacacatacgtatgtacagttagacttgcaggctgcaggagtgccctgcattgttttcttttaattagaaataaaaagtattagtctaaatgtggttctggtgctggtgccctgtatatatgtaacaatataggacccctccaaataggttttgcttctggtgaatcttggtcattgggttagtatatgactgtctataatattttccatttgtattattatattggggaaaacattttttatcattttctattaagaaaatggaaaacttaaatatggtgttaaaaatggaaatatatgtgatatttgcattattaaacccctttgcagatctaaagtctcagggttccactattagtggttaaagtactgaataatgtctgggtctatttccatctgtaaaataagaatatttgtctcacgtgtctgtcatgaatagcaaatgagaaaatgtatataaaagcactttgtaaattgtaaaagtagtacagatgtgagcttctatttgtttagaagcataaatgtgaattatatacagtttgaattttgcataaattttttgtgtctaattttaaa

SEQ ID NO: 107199 - DNA, 825 bp, Homo sapiens
  Payload ID: 1041
  Gene Symbol: AGGF1
  Gene Name: angiogenic factor with G patch and FHA domains 1
  ENST ID: ENST00000502408
  CDS Start-End: 1-262
gtttccggctcaactggggagctgctggagctcttctggcctctggttttccgactgcttatccgacgctcctccctctgtctctgtagctggagaaggtagtttccaggaaagttttccggtttgcaggccgcgcacatcgggcaggggccatcctcggtccccttgctcgttgctcgcagccccgttcggctacaagtggaagaactcagtaaaatactccaacgtgggagaaatgaagataataaaaagtctgatgtagaagtacaaacagagaaccatgctccttggtcaatctcagattatttttatcagacgtactacaatgacgttagtcttccaaataaagtgactgaactgtcagatcaacaagatcaagctatcgaaacttctattttgaattctaaagaccatttacaagtagaaaatgatgcttaccctggtaccgatagaacagaaaatgttaaatatagacaagtggaccattttgcctcaaattcacaggagccagcatctgcattagcaacagaagatacctccttagaaggctcatcattagctgaaagtttgagagctgcagcagaagcggctgtatcacagactggatttagttatgatgaaaatactggactgtattttgaccacagcactggtttctattatgattctgaaaatcaactctattatgatccttccactggaatttattactattgtgatgtggaaagtggtcgttatcagtttcattctcgagtagatttgcaaccttatccgacttctagcacaaaacaaagtaaagataaaaaattgaagaagaaaagaaaa

SEQ ID NO: 107200 - DNA, 1142 bp, Homo sapiens
  Payload ID: 1041
  Gene Symbol: AGGF1
  Gene Name: angiogenic factor with G patch and FHA domains 1
  Uniprot ID: Q8N302
  ENST ID: ENST00000506806
  CDS Start-End: 312-842
ttttccgactgcttatccgacgctcctccctctgtctctgtagctggagaaggtagtttccaggaaagttttccggtttgcaggccgcgcacatcgggcaggggccatcctcggtccccttgctcgttgctcgcagccccgttcggctacaagtgagtttcagggcgtcatggccaggggccaccgcggccagccgggtgtgaggctgcctttcgctgcccgcgcgctccagtggtctctgggtccgccggcgtccgtttcggcctgaacgcagcccctccgcggcgacgagcagtctcgcgccggagctcatggcctcggaggcgccgtccccgccgcggtcgccgccgccgcccacctcccccgagcctgagctggcccagctaaggcggaaggtggagaagttggaacgtgaactgcggagctgcaagcggcaggtgcgggagatcgagaagctgctgcatcacacagaacggctgtaccagaacgcagaaagcaacaaccaggagctccgcacgcaggtggaagaactcagtaaaatactccaacgtgggagaaatgaagataataaaaagtctgatgtagaagtacaaacagagaaccatgctccttggtcaatctcagattatttttatcagacgtactacaatgacgttagtcttccaaataaagtgactgaactgtcagatcaacaagatcaagctatcgaaacttctattttgaattctaaagaccatttacaagtagaaaatgatgcttaccctggtaccgatagaacagaaaatgttaaatatagacaagtggaccattttgcctcaaattcacaggtaataaaatgctaaacatgaaactgttgatgcccaagaacctgtccttctttgttgttattatgtggaaagatagacttctttggtccgtcacagcatatataagggttataaacattcttatgtgtaattatgcaaagaatgttgtagtttttccaaaaccagaattagaacttcttcatatatgtagtggttttcctactacattgtgttccaaaattttgtgatctacataaactaaaacaaaatttgtccagatattttgactgaacaaaagaactgtggacaacaataccacatttacacctaaaaaaa

SEQ ID NO: 107201 - DNA, 1222 bp, Homo sapiens
  Payload ID: 1042
  Gene Symbol: ANG
  Gene Name: angiogenin, ribonuclease, RNase A family, 5
  Uniprot ID: P03950
  ENST ID: ENST00000336811
  CDS Start-End: 601-1044
gtcctgccaaagaaagcagcagcgaataagtacgtggcagatggtgctgtcgaccagtgtcaagaccaagtttcatgggttcctggacgctcagccaggggtagtctctgaagggccgcctggcaattgggagcagaagccagtttcccgccatctgctctccgtggaggcagtgctctcgcggctgctgcccgttggggtccagctgaggaaggagcgcggatcccaggctcgttctttgcctgggctgcccctgcggcccctggggcgggtgctgctgcggcgccagctccaagggcggatccaggcgggaggggcctcctcggagaagcggggcgcggtcccaactacgcagaggctggcacgccgaccctccacacctcaccacgcccccatctccgtccgtgtacacacactcacacaaggacgccaaccccacctagatgcaaagcaggattcaaaagaacatctttgcgttttctaccggctccccatcatcgtactagggaggaagaagcgggtgagaaacaaaacttctttccattgtcctgcccgtttctgcggacttgttctgaggccgaggagcctgtgttggaagagatggtgatgggcctgggcgttttgttgttggtcttcgtgctgggtctgggtctgaccccaccgaccctggctcaggataactccaggtacacacacttcctgacccagcactatgatgccaaaccacagggccgggatgacagatactgtgaaagcatcatgaggagacggggcctgacctcaccctgcaaagacatcaacacatttattcatggcaacaagcgcagcatcaaggccatctgtgaaaacaagaatggaaaccctcacagagaaaacctaagaataagcaagtcttctttccaggtcaccacttgcaagctacatggaggttccccctggcctccatgccagtaccgagccacagcggggttcagaaacgttgttgttgcttgtgaaaatggcttacctgtccacttggatcagtcaattttccgtcgtccgtaaccagcgggcccctggtcaagtgctggctctgctgtccttgccttccatttcccctctgcacccagaacagtggtggcaacattcattgccaagggcccaaagaaagagctacctggaccttttgttttctgtttgacaacatgtttaataaataaaaatgtcttgatatcagtaagaa

SEQ ID NO: 107202 - DNA, 742 bp, Homo sapiens
  Payload ID: 1042
  Gene Symbol: ANG
  Gene Name: angiogenin, ribonuclease, RNase A family, 5
  Uniprot ID: P03950
  ENST ID: ENST00000397990
  CDS Start-End: 121-564
tccaggttcacacaactggaacccatctccaggaacaaacagctggaacccatctcccgttgaagggaaactgccagatttttgtaagattcttcctcctgggagcctgtgttggaagagatggtgatgggcctgggcgttttgttgttggtcttcgtgctgggtctgggtctgaccccaccgaccctggctcaggataactccaggtacacacacttcctgacccagcactatgatgccaaaccacagggccgggatgacagatactgtgaaagcatcatgaggagacggggcctgacctcaccctgcaaagacatcaacacatttattcatggcaacaagcgcagcatcaaggccatctgtgaaaacaagaatggaaaccctcacagagaaaacctaagaataagcaagtcttctttccaggtcaccacttgcaagctacatggaggttccccctggcctccatgccagtaccgagccacagcggggttcagaaacgttgttgttgcttgtgaaaatggcttacctgtccacttggatcagtcaattttccgtcgtccgtaaccagcgggcccctggtcaagtgctggctctgctgtccttgccttccatttcccctctgcacccagaacagtggtggcaacattcattgccaagggcccaaagaaagagctacctggaccttttgttttctgtttgacaacatgtttaataaataaaaatgtcttgatatcagtaagaa

SEQ ID NO: 107203 - DNA, 6888 bp, Homo sapiens
  Payload ID: 1043
  Gene Symbol: AMOT
  Gene Name: angiomotin
  Uniprot ID: Q4VCS5
  ENST ID: ENST00000304758
  CDS Start-End: 797-2824
ccaggagctgccttggcagtcacgccccttccttccgaggagctttctggctgcctaaactggtagaccccctgaattactcctccatctccgctctctttcgcctcctcttctcttagttctctccgcctccccctcaactaccaccacctccagtcagtctcgcctccggctatccgctgctccaccctctggcccggtatcctgcctgtccgctgccaccaaggagagcccggacggagcagcgaggaggggagcagccgggagttggggcttcccccctgcccatccctggccgctggcccgggaccgaagccacttgagcgagcagagagtcgtcaccttgtcttctttgccttcagggagctgctaagaaggacaaataagatagcagagtgaaagagcttttgtctccttagaaggaaggctgagaaactaaaggccagcgcaggacatctcattgccattgtcagccaggaactcgcagcctcacagccctacttcttctctgacctctggggggtccttgcccttgctacaatctccaccatccactagattgtctcctgcccgacaccccttggtcccaaaccagggagaccattcagctcacctgcctaggccgcagcagcatttccttcctaatcaggctcaccagggggatcattaccgtctctcccaacctggcctgagtcagcagcagcagcaacagcagcagcagcaccatcatcaccatcaccaccaacaacagcagcagcagcagccacagcagcagccaggagaagcctattcagctatgcctcgggctcagccatcctctgcttcttatcagccagtgccagcagacccttttgccattgtttccagagcccagcagatggttgagatcctctcagacgagaaccggaacttgaggcaagagttggaaggatgctatgagaaggtggcaagactgcagaaggtggagacagaaatccagcgcgtctcggaggcatatgagaacctcgtgaagtcatcctccaaaagagaggccctagagaaagccatgagaaacaagctagagggcgagattcggaggatgcatgatttcaacagggatctgagagagcgtctagagactgccaacaagcagcttgcagagaaggaatatgaggggtcagaggacaccagaaaaaccatctcgcagctctttgcaaaaaataaagaaagccagcgtgagaaggagaagctggaagcggagctggccactgcccgttctaccaatgaggaccaaagacgacacatcgaaatccgagatcaggccctgagtaatgcccaggccaaggtggtaaagctggaagaagagctgaaaaagaagcaagtgtacgttgacaaggtggagaagatgcagcaggcccttgtacagctccaggcagcatgtgaaaaacgtgagcagctagagcaccgtctccggacacgactggagagggaactggaatccctgagaatccagcagcgtcagggcaactgtcagcccaccaacgtttcagaatacaatgctgctgcactgatggagctccttcgggagaaagaggagaggattctggctctggaagctgatatgacaaagtgggagcagaaatatttggaggagaatgtgatgagacattttgctctggatgctgctgcaactgtggctgctcagagggacacaacagtcatcagtcactctcctaacaccagctatgacacagctctagaagctcgcatccagaaagaggaggaagaaatcttgatggccaataagcgttgccttgacatggagggcaggattaagaccctccatgcccagattattgagaaggatgccatgatcaaagtactccagcagcgttcccggaaggagccgagcaagacagagcagctgtcgtgcatgcggccagcgaagtctctgatgtccatttccaatgctggatcaggcttgctctcccactcatccaccctgactggctcccccatcatggaagaaaagcgagacgacaagagctggaaggggagcctaggcattctcctgggtggagactaccgtgctgaatatgtcccttccacaccctcgcctgtgccaccctcgactcccctgctctcggctcactccaagacaggcagccgagactgcagtacccaaactgaacgtgggacggaatcgaacaaaactgcagctgttgctcccatctctgttcctgctccagttgctgctgccgccactgctgccgccatcactgccactgctgccaccatcaccaccaccatggtagctgctgctccagttgctgttgctgctgctgctgctccagctgctgctgctgccccgtctccagccactgccgctgctactgctgctgctgtttctccagctgctgctggtcagattccagctgctgcctctgttgcctcagctgctgccgttgctccttctgctgctgctgctgctgctgttcaggttgctccagctgctccggctccagttccagctccggctctggttccggttccagctccagcagcggctcaggcttctgctcctgctcagactcaggcaccaacttcagctccggctgtggctccaactccagctccaactccaactccagctgtggctcaggctgaggttcctgcaagtccagctaccggtcctggaccacatcgtttgtctataccaagtttgacctgcaatccagacaaaacagatgggcctgtgttccactccaatactctggaaagaaaaactcccattcagatcctgggacaagagcctgatgcagagatggtggaatatctcatctaaacggccaaatcaagagctgcagattatcagcaaaaatgcttttaatcattttcccccttttattggttcttgttttgagggtgaggacaagggttgtggggaggggatgttttttaacaggactttttattggaacaatgtactacttgagtaataccatgtgaacaccagtctattttggtatgcttagggagtacctctaaagacagattaatcagaatgtgctctaaagcttattgtttgaatttatacgaatactgggactgttaacaggtggctatacatcgacgttttcaatgtgcttaaatttgtttaaattttccatattctagatcattttttattgaagagcacagtatgtgtggaagacagtgtataacacgtagtttggaagtgggaagctagagagaattgagtgtgtgctgttttgtatagttactatcctgtgcagcagctggagaaagcactcacctcaggcttacaaaagggaatagtttcaggagctatgtaagctggaaaaaaggtagggagttttggggtgcagaagggtactggagctaattttttcttccagtttcccagctaccctgccccagggaattgtgtttgtcttcatttcagtggtgctttggaaatggattcttttggttccctcctggaggttcatacattcatatatatgctctggagtaatttatgcatttggataattaatatattgctttcagatgctgggagagtacattaactgagtgatgcgcaacttcctctctcttagggaattagaccatcagaggccttgatggagagttgcatggggtgctatatgcagacttccatggtttgtgtgtagccatgaacacagcttgcttgcatttagtaagaccaatcagcttagtgtttatttcttctacagcacagattcactggctgggtctccagtctcaaattgccaatcatttgcaaagtgaggaaggatctttgttgacaggttgaatgctttgaatttctggtgactactttgaaataacttgttttgtttgtcaaattctaagcatatgtcttaaaaggcatttttgactatcacctccaagggaatagcttgagaaacccaaagtactatgctgcagtcgggggagaggtggattgcagcagtatcctcaactacctcttctcactgtcagtgacaccatcttggaatacctttgggaagcagcaggaaatgtgcatgtgggtagagatcaaaggaggcaatggctccaagccttgccatagggctgcctccaaggacacagaaggatgccagttgccacaggtccctgccctgtgtcacctgtctgcccttcattaaggtgagaaatctgcagatagcatcattaagatcagttttaaggggtatagggagggtgagggaagtggggggtgttaggtaagggttgggggtagaggttttgggatgtcttagttagaaaccagattaatagaagagtaggcctgatatattacatcatgagccatagtggtgggaaagaactttagcaatatagccctacctcctcattttagtgatgaggaatctgagaactggagaggttcagtgactttttgaaagtcatacaacacagctaaccattatgccaatcaccatgcttattttgggaaactctttatcttttttaaattccattttatgaaaaggcatcttcatggtccagggaatatgtatcttgtaaaatgtacctggttggagtagcttgtccagtcttgacaaactactgaatttctgtcttgcctctccttcagtgccttttaaaaggttttcccttttctgatctgcatttcaacatagagtcacataaatgtccccctgagaaaccaatcccacttctttctaggagattgggtatcttagataatcttttggggttcctctgtgagtataggaatggtatccttcctaattatcttccaaaggaattattttgtgtgtgtgcctgtgtgtgtgtagagacataaaggagggtgatgtgattttcagctagtcctttcacattttcaataatgaggtaatcatgttacatacacattagtcctcagttataaagtgaatctcagatagaaattaaaagtgcagttgtgttaagactctttcatactaccctttagtcataaggagaaaaaaacactcaaatagtagaagcagcaagtagcaaacttcaggagagctactttctatccaaataatttaaaaaacacttttcacctactcctttcatggttataacacattggcagactttttgctggctctgggagccatgattttaatcacattctgcaaggtgacaaatgtcatacattccacattgtgtggtagccatctctttagactcatgtgttttggggaaaggaagaagttcttggctgagtactattttgaactttccagaaccctctcacaccagagacagttcttctctgttcagtttccaatccccgataatttgctaaaataacattgtacatccaagagagggaagaagagtatgtcagtatattatgcagaagatagatacagccttttcagaagatctccactagtttttgttccaaaaattcaagtttatgggagaaatctcaattagccaccttttcacagttgtgtggatataacatttgggggatctttctggactcctacctatctgtgcattttaccggcacctcaggaaaggagggtgaccaggttgtcttagcttgtactgcttggtgatctctgaggaccttctaattcagttgtaccccagtgttccatgtatagaaaaacttcattagaacaaactttacttgatatgaaactcctattaacagtctttttttgaaataaaaagtagcttgagctttcttttaaaatcatgtatcttgattgttgatttaatgaaggatttccttttaatgctgcttttgagcttcaaggtaataggacagcaggaacctaaaatatctgccatcatctgccataggaaagatacccagagacccatcatgttctctttttgttgttacactgttgggtgggtataacaattggaaaatgaacaaactgattgattgtgcaaactactttttatgacaagcctaaaccctcataatgcggcagcttaaagtgtatacatatgcactaactttgatcaattatattctcatatctgttagctacacagtctcctattatctcaattgcttatgtgcatatggaatatgttacttaaaacgtgtgcattcttactgaaaatgttttcaaaggaaggtatcagctgtgggctaattgccaccaatttcagcctgccacgattcttggaaatatgtcttccaagtgccatccatcatcagtaggacaagtgtcgggagtttgtttatttttttccagtagcaacgatgggttacatggagccatgaaacctccttctggcctcccttgtgattaatggcatgtgtttgtaaaatggatagctggggttggcagatggctagagaagaatcgcctttggtttaaaatgtatgtggtcccctaatgattgtgaccccattctgtaatcaactgagctagttccaataaagttaagcaggtttaaatccactttgtgcctatcttttcactgacaataaagttagctattttaaaatgcagtaccgtgtggaaaatgctttggtgtttacccgacagaggctttatttgtgctgtatcagtgattactttcaattcagtatgcagtgaaattgcctttcaagggcagcgtgcagcagaatttgcatttgcttgaagtatggaatgtgattatagattataaagtattaagacaacaccacaggccgcatgctctaatcggtctctttatatactcaggcagcatatattaaaagctttgcatctttttatcttctggtttctagggataaaatgatggccacccaaagcagagaatttatcctttggttagcattttggaaggccccttgatattccttttgtacccttgttctgatgccaattcatcagtttt

SEQ ID NO: 107204 - DNA, 2462 bp, Homo sapiens
  Payload ID: 1043
  Gene Symbol: AMOT
  Gene Name: angiomotin
  ENST ID: ENST00000371958
  CDS Start-End: 155-1948
gtcactggccaccagtggagttaaggcccatccacctgttaccagtgctcccctctccccaccacaacccaatgacctctacaagaatcccacaagttccagtgaattctacaaggcccaagggccacttcctaaccagcatagcctgaagggcatggaacaccgaggccccccaccagaatatcccttcaagggcatgccaccccaatctgtagtgtgcaagccccaagagccagggcacttctatagtgagcatcgcctgaaccagccagggagaacagaggggcaactgatgaggtatcagcatccccctgagtatggagcagccaggccagcgcaggacatctcattgccattgtcagccaggaactcgcagcctcacagccctacttcttctctgacctctggggggtccttgcccttgctacaatctccaccatccactagattgtctcctgcccgacaccccttggtcccaaaccagggagaccattcagctcacctgcctaggccgcagcagcatttccttcctaatcaggctcaccagggggatcattaccgtctctcccaacctggcctgagtcagcagcagcagcaacagcagcagcagcaccatcatcaccatcaccaccaacaacagcagcagcagcagccacagcagcagccaggagaagcctattcagctatgcctcgggctcagccatcctctgcttcttatcagccagtgccagcagacccttttgccattgtttccagagcccagcagatggttgagatcctctcagacgagaaccggaacttgaggcaagagttggaaggatgctatgagaaggtggcaagactgcagaaggtggagacagaaatccagcgcgtctcggaggcatatgagaacctcgtgaagtcatcctccaaaagagaggccctagagaaagccatgagaaacaagctagagggcgagattcggaggatgcatgatttcaacagggatctgagagagcgtctagagactgccaacaagcagcttgcagagaaggaatatgaggggtcagaggacaccagaaaaaccatctcgcagctctttgcaaaaaataaagaaagccagcgtgagaaggagaagctggaagcggagctggccactgcccgttctaccaatgaggaccaaagacgacacatcgaaatccgagatcaggccctgagtaatgcccaggccaaggtggtaaagctggaagaagagctgaaaaagaagcaagtgtacgttgacaaggtggagaagatgcagcaggcccttgtacagctccaggcagcatgtgaaaaacgtgagcagctagagcaccgtctccggacacgactggagagggaactggaatccctgagaatccagcagcgtcagggcaactgtcagcccaccaacgtttcagaatacaatgctgctgcactgatggagctccttcgggagaaagaggagaggattctggctctggaagctgatatgacaaagtgggagcagaaatatttggaggagaatgtgatgagacattttgctctggatgctgctgcaactgtggctgctcagagggacacaacagtcatcagtcactctcctaacaccagctatgacacagctctagaagctcgcatccagaaagaggaggaagaaatcttgatggccaataagcgttgccttgacatggagggcaggattaagaccctccatgcccagattattgagaaggatgccatgatcaaagtactccagcagcgttcccggaaggagccgagcaagacagagcagctgtcgtgcatgcggccagcgaagtctctgatgtccatttccaatgctggatcaggcttgctctcccactcatccaccctgactggctcccccatcatggaagaaaagcgagacgacaagagctggaaggggagcctaggtaatgacagtaaataaggaagattatagtcacgtgttcaaagagagccctgagataagcacccatgcttaaggaaaagggatgatggtccaggttctagagaggaaggtgtaccagggttttggagtttttttttcctcctgagaccctagttccacattctggagctcctccacactttgaagtctcccggtgagaataccgattgaggccaaggcttagaggacaagaatcttgagtttcatttgggtgtcaaggaagataactctaatttcctctaaactattctcagatttggcctttgccatgtggcacctttatctttctccaaagcccatgtggcctttgtgtcgttccaaatgtcaaaattccggcatttctgtgttccttcctcctctataataggagaacccagagttttagttacactaaatcgtttgggtagcaggttttgttcccacagtgttgtgagatgagaacagaatgtactttttcattccgttcctgtccattccctcccctctaatcaaa

SEQ ID NO: 107205 - DNA, 7319 bp, Homo sapiens
  Payload ID: 1043
  Gene Symbol: AMOT
  Gene Name: angiomotin
  Uniprot ID: Q4VCS5
  ENST ID: ENST00000371959
  CDS Start-End: 1-3255
atgagaaattctgaagaacagccaagtggagggaccacggtattgcagcgtttgctacaagagcagcttcgctatggcaatcctagtgagaatcgcagcctgcttgccatacaccagcaagccacagggaatggccctcctttccccagtggcagtgggaacccgggccctcagagtgatgtgttgagtccccaagaccaccaccaacagcttgtggctcatgctgctcgacaagaaccccaggggcaggaaatccagtcagaaaacctcatcatggagaagcagctgtctcctcgaatgcaaaataatgaagaactcccgacctatgaagaagccaaggtccagtcccagtactttcggggccaacagcatgccagtgttggagctgccttctatgtcactggagtcaccaaccagaagatgaggactgagggacgcccatcagttcagcggctcaatcctggaaagatgcaccaagatgagggactcagagaccttaagcaagggcatgtccgttccttgagtgaacgactaatgcagatgtcactggccaccagtggagttaaggcccatccacctgttaccagtgctcccctctccccaccacaacccaatgacctctacaagaatcccacaagttccagtgaattctacaaggcccaagggccacttcctaaccagcatagcctgaagggcatggaacaccgaggccccccaccagaatatcccttcaagggcatgccaccccaatctgtagtgtgcaagccccaagagccagggcacttctatagtgagcatcgcctgaaccagccagggagaacagaggggcaactgatgaggtatcagcatccccctgagtatggagcagccaggccagcgcaggacatctcattgccattgtcagccaggaactcgcagcctcacagccctacttcttctctgacctctggggggtccttgcccttgctacaatctccaccatccactagattgtctcctgcccgacaccccttggtcccaaaccagggagaccattcagctcacctgcctaggccgcagcagcatttccttcctaatcaggctcaccagggggatcattaccgtctctcccaacctggcctgagtcagcagcagcagcaacagcagcagcagcaccatcatcaccatcaccaccaacaacagcagcagcagcagccacagcagcagccaggagaagcctattcagctatgcctcgggctcagccatcctctgcttcttatcagccagtgccagcagacccttttgccattgtttccagagcccagcagatggttgagatcctctcagacgagaaccggaacttgaggcaagagttggaaggatgctatgagaaggtggcaagactgcagaaggtggagacagaaatccagcgcgtctcggaggcatatgagaacctcgtgaagtcatcctccaaaagagaggccctagagaaagccatgagaaacaagctagagggcgagattcggaggatgcatgatttcaacagggatctgagagagcgtctagagactgccaacaagcagcttgcagagaaggaatatgaggggtcagaggacaccagaaaaaccatctcgcagctctttgcaaaaaataaagaaagccagcgtgagaaggagaagctggaagcggagctggccactgcccgttctaccaatgaggaccaaagacgacacatcgaaatccgagatcaggccctgagtaatgcccaggccaaggtggtaaagctggaagaagagctgaaaaagaagcaagtgtacgttgacaaggtggagaagatgcagcaggcccttgtacagctccaggcagcatgtgaaaaacgtgagcagctagagcaccgtctccggacacgactggagagggaactggaatccctgagaatccagcagcgtcagggcaactgtcagcccaccaacgtttcagaatacaatgctgctgcactgatggagctccttcgggagaaagaggagaggattctggctctggaagctgatatgacaaagtgggagcagaaatatttggaggagaatgtgatgagacattttgctctggatgctgctgcaactgtggctgctcagagggacacaacagtcatcagtcactctcctaacaccagctatgacacagctctagaagctcgcatccagaaagaggaggaagaaatcttgatggccaataagcgttgccttgacatggagggcaggattaagaccctccatgcccagattattgagaaggatgccatgatcaaagtactccagcagcgttcccggaaggagccgagcaagacagagcagctgtcgtgcatgcggccagcgaagtctctgatgtccatttccaatgctggatcaggcttgctctcccactcatccaccctgactggctcccccatcatggaagaaaagcgagacgacaagagctggaaggggagcctaggcattctcctgggtggagactaccgtgctgaatatgtcccttccacaccctcgcctgtgccaccctcgactcccctgctctcggctcactccaagacaggcagccgagactgcagtacccaaactgaacgtgggacggaatcgaacaaaactgcagctgttgctcccatctctgttcctgctccagttgctgctgccgccactgctgccgccatcactgccactgctgccaccatcaccaccaccatggtagctgctgctccagttgctgttgctgctgctgctgctccagctgctgctgctgccccgtctccagccactgccgctgctactgctgctgctgtttctccagctgctgctggtcagattccagctgctgcctctgttgcctcagctgctgccgttgctccttctgctgctgctgctgctgctgttcaggttgctccagctgctccggctccagttccagctccggctctggttccggttccagctccagcagcggctcaggcttctgctcctgctcagactcaggcaccaacttcagctccggctgtggctccaactccagctccaactccaactccagctgtggctcaggctgaggttcctgcaagtccagctaccggtcctggaccacatcgtttgtctataccaagtttgacctgcaatccagacaaaacagatgggcctgtgttccactccaatactctggaaagaaaaactcccattcagatcctgggacaagagcctgatgcagagatggtggaatatctcatctaaacggccaaatcaagagctgcagattatcagcaaaaatgcttttaatcattttcccccttttattggttcttgttttgagggtgaggacaagggttgtggggaggggatgttttttaacaggactttttattggaacaatgtactacttgagtaataccatgtgaacaccagtctattttggtatgcttagggagtacctctaaagacagattaatcagaatgtgctctaaagcttattgtttgaatttatacgaatactgggactgttaacaggtggctatacatcgacgttttcaatgtgcttaaatttgtttaaattttccatattctagatcattttttattgaagagcacagtatgtgtggaagacagtgtataacacgtagtttggaagtgggaagctagagagaattgagtgtgtgctgttttgtatagttactatcctgtgcagcagctggagaaagcactcacctcaggcttacaaaagggaatagtttcaggagctatgtaagctggaaaaaaggtagggagttttggggtgcagaagggtactggagctaattttttcttccagtttcccagctaccctgccccagggaattgtgtttgtcttcatttcagtggtgctttggaaatggattcttttggttccctcctggaggttcatacattcatatatatgctctggagtaatttatgcatttggataattaatatattgctttcagatgctgggagagtacattaactgagtgatgcgcaacttcctctctcttagggaattagaccatcagaggccttgatggagagttgcatggggtgctatatgcagacttccatggtttgtgtgtagccatgaacacagcttgcttgcatttagtaagaccaatcagcttagtgtttatttcttctacagcacagattcactggctgggtctccagtctcaaattgccaatcatttgcaaagtgaggaaggatctttgttgacaggttgaatgctttgaatttctggtgactactttgaaataacttgttttgtttgtcaaattctaagcatatgtcttaaaaggcatttttgactatcacctccaagggaatagcttgagaaacccaaagtactatgctgcagtcgggggagaggtggattgcagcagtatcctcaactacctcttctcactgtcagtgacaccatcttggaatacctttgggaagcagcaggaaatgtgcatgtgggtagagatcaaaggaggcaatggctccaagccttgccatagggctgcctccaaggacacagaaggatgccagttgccacaggtccctgccctgtgtcacctgtctgcccttcattaaggtgagaaatctgcagatagcatcattaagatcagttttaaggggtatagggagggtgagggaagtggggggtgttaggtaagggttgggggtagaggttttgggatgtcttagttagaaaccagattaatagaagagtaggcctgatatattacatcatgagccatagtggtgggaaagaactttagcaatatagccctacctcctcattttagtgatgaggaatctgagaactggagaggttcagtgactttttgaaagtcatacaacacagctaaccattatgccaatcaccatgcttattttgggaaactctttatcttttttaaattccattttatgaaaaggcatcttcatggtccagggaatatgtatcttgtaaaatgtacctggttggagtagcttgtccagtcttgacaaactactgaatttctgtcttgcctctccttcagtgccttttaaaaggttttcccttttctgatctgcatttcaacatagagtcacataaatgtccccctgagaaaccaatcccacttctttctaggagattgggtatcttagataatcttttggggttcctctgtgagtataggaatggtatccttcctaattatcttccaaaggaattattttgtgtgtgtgcctgtgtgtgtgtagagacataaaggagggtgatgtgattttcagctagtcctttcacattttcaataatgaggtaatcatgttacatacacattagtcctcagttataaagtgaatctcagatagaaattaaaagtgcagttgtgttaagactctttcatactaccctttagtcataaggagaaaaaaacactcaaatagtagaagcagcaagtagcaaacttcaggagagctactttctatccaaataatttaaaaaacacttttcacctactcctttcatggttataacacattggcagactttttgctggctctgggagccatgattttaatcacattctgcaaggtgacaaatgtcatacattccacattgtgtggtagccatctctttagactcatgtgttttggggaaaggaagaagttcttggctgagtactattttgaactttccagaaccctctcacaccagagacagttcttctctgttcagtttccaatccccgataatttgctaaaataacattgtacatccaagagagggaagaagagtatgtcagtatattatgcagaagatagatacagccttttcagaagatctccactagtttttgttccaaaaattcaagtttatgggagaaatctcaattagccaccttttcacagttgtgtggatataacatttgggggatctttctggactcctacctatctgtgcattttaccggcacctcaggaaaggagggtgaccaggttgtcttagcttgtactgcttggtgatctctgaggaccttctaattcagttgtaccccagtgttccatgtatagaaaaacttcattagaacaaactttacttgatatgaaactcctattaacagtctttttttgaaataaaaagtagcttgagctttcttttaaaatcatgtatcttgattgttgatttaatgaaggatttccttttaatgctgcttttgagcttcaaggtaataggacagcaggaacctaaaatatctgccatcatctgccataggaaagatacccagagacccatcatgttctctttttgttgttacactgttgggtgggtataacaattggaaaatgaacaaactgattgattgtgcaaactactttttatgacaagcctaaaccctcataatgcggcagcttaaagtgtatacatatgcactaactttgatcaattatattctcatatctgttagctacacagtctcctattatctcaattgcttatgtgcatatggaatatgttacttaaaacgtgtgcattcttactgaaaatgttttcaaaggaaggtatcagctgtgggctaattgccaccaatttcagcctgccacgattcttggaaatatgtcttccaagtgccatccatcatcagtaggacaagtgtcgggagtttgtttatttttttccagtagcaacgatgggttacatggagccatgaaacctccttctggcctcccttgtgattaatggcatgtgtttgtaaaatggatagctggggttggcagatggctagagaagaatcgcctttggtttaaaatgtatgtggtcccctaatgattgtgaccccattctgtaatcaactgagctagttccaataaagttaagcaggtttaaatccactttgtgcctatcttttcactgacaataaagttagctattttaaaatgcagtaccgtgtggaaaatgctttggtgtttacccgacagaggctttatttgtgctgtatcagtgattactttcaattcagtatgcagtgaaattgcctttcaagggcagcgtgcagcagaatttgcatttgcttgaagtatggaatgtgattatagattataaagtattaagacaacaccacaggccgcatgctctaatcggtctctttatatactcaggcagcatatattaaaagctttgcatctttttatcttctggtttctagggataaaatgatggccacccaaagcagagaatttatcctttggttagcattttggaaggccccttgatattccttttgtacccttgttctgatgccaattcatcagtttt

SEQ ID NO: 107206 - DNA, 2720 bp, Homo sapiens
  Payload ID: 1043
  Gene Symbol: AMOT
  Gene Name: angiomotin
  ENST ID: ENST00000371962
  CDS Start-End: 107-2665
tcccctctccccaccacaacccaatgacctctacaagaatcccacaagttccagtgaattctacaaggcccaagggccacttcctaaccagcatagcctgaagggcatggaacaccgaggccccccaccagaatatcccttcaagggcatgccaccccaatctgtagtgtgcaagccccaagagccagggcacttctatagtgagcatcgcctgaaccagccagggagaacagaggggcaactgatgaggtatcagcatccccctgagtatggagcagccaggccagcgcaggacatctcattgccattgtcagccaggaactcgcagcctcacagccctacttcttctctgacctctggggggtccttgcccttgctacaatctccaccatccactagattgtctcctgcccgacaccccttggtcccaaaccagggagaccattcagctcacctgcctaggccgcagcagcatttccttcctaatcaggctcaccagggggatcattaccgtctctcccaacctggcctgagtcagcagcagcagcaacagcagcagcagcaccatcatcaccatcaccaccaacaacagcagcagcagcagccacagcagcagccaggagaagcctattcagctatgcctcgggctcagccatcctctgcttcttatcagccagtgccagcagacccttttgccattgtttccagagcccagcagatggttgagatcctctcagacgagaaccggaacttgaggcaagagttggaaggatgctatgagaaggtggcaagactgcagaaggtggagacagaaatccagcgcgtctcggaggcatatgagaacctcgtgaagtcatcctccaaaagagaggccctagagaaagccatgagaaacaagctagagggcgagattcggaggatgcatgatttcaacagggatctgagagagcgtctagagactgccaacaagcagcttgcagagaaggaatatgaggggtcagaggacaccagaaaaaccatctcgcagctctttgcaaaaaataaagaaagccagcgtgagaaggagaagctggaagcggagctggccactgcccgttctaccaatgaggaccaaagacgacacatcgaaatccgagatcaggccctgagtaatgcccaggccaaggtggtaaagctggaagaagagctgaaaaagaagcaagtgtacgttgacaaggtggagaagatgcagcaggcccttgtacagctccaggcagcatgtgaaaaacgtgagcagctagagcaccgtctccggacacgactggagagggaactggaatccctgagaatccagcagcgtcagggcaactgtcagcccaccaacgtttcagaatacaatgctgctgcactgatggagctccttcgggagaaagaggagaggattctggctctggaagctgatatgacaaagtgggagcagaaatatttggaggagaatgtgatgagacattttgctctggatgctgctgcaactgtggctgctcagagggacacaacagtcatcagtcactctcctaacaccagctatgacacagctctagaagctcgcatccagaaagaggaggaagaaatcttgatggccaataagcgttgccttgacatggagggcaggattaagaccctccatgcccagattattgagaaggatgccatgatcaaagtactccagcagcgttcccggaaggagccgagcaagacagagcagctgtcgtgcatgcggccagcgaagtctctgatgtccatttccaatgctggatcaggcttgctctcccactcatccaccctgactggctcccccatcatggaagaaaagcgagacgacaagagctggaaggggagcctaggcattctcctgggtggagactaccgtgctgaatatgtcccttccacaccctcgcctgtgccaccctcgactcccctgctctcggctcactccaagacaggcagccgagactgcagtacccaaactgaacgtgggacggaatcgaacaaaactgcagctgttgctcccatctctgttcctgctccagttgctgctgccgccactgctgccgccatcactgccactgctgccaccatcaccaccaccatggtagctgctgctccagttgctgttgctgctgctgctgctccagctgctgctgctgccccgtctccagccactgccgctgctactgctgctgctgtttctccagctgctgctggtcagattccagctgctgcctctgttgcctcagctgctgccgttgctccttctgctgctgctgctgctgctgttcaggttgctccagctgctccggctccagttccagctccggctctggttccggttccagctccagcagcggctcaggcttctgctcctgctcagactcaggcaccaacttcagctccggctgtggctccaactccagctccaactccaactccagctgtggctcaggctgaggttcctgcaagtccagctaccggtcctggaccacatcgtttgtctataccaagtttgacctgcaatccagacaaaacagatgggcctgtgttccactccaatactctggaaagaaaaactcccattcagatcctgggacaagagcctgatgcagagatggtggaatatctcatctaaacggccaaatcaagagctgcagattatcagcaaaaatgcttttaatcattttccc

SEQ ID NO: 107207 - DNA, 3330 bp, Homo sapiens
  Payload ID: 1043
  Gene Symbol: AMOT
  Gene Name: angiomotin
  Uniprot ID: Q4VCS5
  ENST ID: ENST00000524145
  CDS Start-End: 76-3330
taagcaagaattccctatcctgatcaaggctttaagcctaaaagaaagcagaaataggcaccaccagcaatagagatgagaaattctgaagaacagccaagtggagggaccacggtattgcagcgtttgctacaagagcagcttcgctatggcaatcctagtgagaatcgcagcctgcttgccatacaccagcaagccacagggaatggccctcctttccccagtggcagtgggaacccgggccctcagagtgatgtgttgagtccccaagaccaccaccaacagcttgtggctcatgctgctcgacaagaaccccaggggcaggaaatccagtcagaaaacctcatcatggagaagcagctgtctcctcgaatgcaaaataatgaagaactcccgacctatgaagaagccaaggtccagtcccagtactttcggggccaacagcatgccagtgttggagctgccttctatgtcactggagtcaccaaccagaagatgaggactgagggacgcccatcagttcagcggctcaatcctggaaagatgcaccaagatgagggactcagagaccttaagcaagggcatgtccgttccttgagtgaacgactaatgcagatgtcactggccaccagtggagttaaggcccatccacctgttaccagtgctcccctctccccaccacaacccaatgacctctacaagaatcccacaagttccagtgaattctacaaggcccaagggccacttcctaaccagcatagcctgaagggcatggaacaccgaggccccccaccagaatatcccttcaagggcatgccaccccaatctgtagtgtgcaagccccaagagccagggcacttctatagtgagcatcgcctgaaccagccagggagaacagaggggcaactgatgaggtatcagcatccccctgagtatggagcagccaggccagcgcaggacatctcattgccattgtcagccaggaactcgcagcctcacagccctacttcttctctgacctctggggggtccttgcccttgctacaatctccaccatccactagattgtctcctgcccgacaccccttggtcccaaaccagggagaccattcagctcacctgcctaggccgcagcagcatttccttcctaatcaggctcaccagggggatcattaccgtctctcccaacctggcctgagtcagcagcagcagcaacagcagcagcagcaccatcatcaccatcaccaccaacaacagcagcagcagcagccacagcagcagccaggagaagcctattcagctatgcctcgggctcagccatcctctgcttcttatcagccagtgccagcagacccttttgccattgtttccagagcccagcagatggttgagatcctctcagacgagaaccggaacttgaggcaagagttggaaggatgctatgagaaggtggcaagactgcagaaggtggagacagaaatccagcgcgtctcggaggcatatgagaacctcgtgaagtcatcctccaaaagagaggccctagagaaagccatgagaaacaagctagagggcgagattcggaggatgcatgatttcaacagggatctgagagagcgtctagagactgccaacaagcagcttgcagagaaggaatatgaggggtcagaggacaccagaaaaaccatctcgcagctctttgcaaaaaataaagaaagccagcgtgagaaggagaagctggaagcggagctggccactgcccgttctaccaatgaggaccaaagacgacacatcgaaatccgagatcaggccctgagtaatgcccaggccaaggtggtaaagctggaagaagagctgaaaaagaagcaagtgtacgttgacaaggtggagaagatgcagcaggcccttgtacagctccaggcagcatgtgaaaaacgtgagcagctagagcaccgtctccggacacgactggagagggaactggaatccctgagaatccagcagcgtcagggcaactgtcagcccaccaacgtttcagaatacaatgctgctgcactgatggagctccttcgggagaaagaggagaggattctggctctggaagctgatatgacaaagtgggagcagaaatatttggaggagaatgtgatgagacattttgctctggatgctgctgcaactgtggctgctcagagggacacaacagtcatcagtcactctcctaacaccagctatgacacagctctagaagctcgcatccagaaagaggaggaagaaatcttgatggccaataagcgttgccttgacatggagggcaggattaagaccctccatgcccagattattgagaaggatgccatgatcaaagtactccagcagcgttcccggaaggagccgagcaagacagagcagctgtcgtgcatgcggccagcgaagtctctgatgtccatttccaatgctggatcaggcttgctctcccactcatccaccctgactggctcccccatcatggaagaaaagcgagacgacaagagctggaaggggagcctaggcattctcctgggtggagactaccgtgctgaatatgtcccttccacaccctcgcctgtgccaccctcgactcccctgctctcggctcactccaagacaggcagccgagactgcagtacccaaactgaacgtgggacggaatcgaacaaaactgcagctgttgctcccatctctgttcctgctccagttgctgctgccgccactgctgccgccatcactgccactgctgccaccatcaccaccaccatggtagctgctgctccagttgctgttgctgctgctgctgctccagctgctgctgctgccccgtctccagccactgccgctgctactgctgctgctgtttctccagctgctgctggtcagattccagctgctgcctctgttgcctcagctgctgccgttgctccttctgctgctgctgctgctgctgttcaggttgctccagctgctccggctccagttccagctccggctctggttccggttccagctccagcagcggctcaggcttctgctcctgctcagactcaggcaccaacttcagctccggctgtggctccaactccagctccaactccaactccagctgtggctcaggctgaggttcctgcaagtccagctaccggtcctggaccacatcgtttgtctataccaagtttgacctgcaatccagacaaaacagatgggcctgtgttccactccaatactctggaaagaaaaactcccattcagatcctgggacaagagcctgatgcagagatggtggaatatctcatctaa

SEQ ID NO: 107208 - DNA, 653 bp, Homo sapiens
  Payload ID: 1044
  Gene Symbol: AMOTL1
  Gene Name: angiomotin like 1
  ENST ID: ENST00000299004
  CDS Start-End: 218-653
agagttggctcagccaggcagcactcgttgctctttttaaactccacggcaccagggatgaagtcacctttcttcttttaaaacgaacacatttgctctgtgagtccctgtcacttctgttagaacttagtattttttccactgccggtcaccaggacttctcacaggagattgcttccatttgatctgaaagctatacatacaaggggctagaagcatggacctcagtgaaaaatggactttggaggaaggagcctggttatcccatgctggaattcatcattttgccagcaccagagcggacagtgagtttgtggaagcctcgcccgcatcctacagcccagacgagttagggtccccttctgcttgttatagccccagtagtcctgtccaggttctagaagactccacctacttttccccagactttcagctctattctgggaggcatgaaacatctgctttgacggtggaggcaaccagtagcatcagggaaaaagttgttgaagatcctctttgtaacttccactccccaaacttcctgaggatctcagaggtggaaatgagaggttccgaggatgcggcagctggaacagtattgcagcggctgatccaggaacaactgcggtatggcaccccaaccgagaacatga

SEQ ID NO: 107209 - DNA, 8844 bp, Homo sapiens
  Payload ID: 1044
  Gene Symbol: AMOTL1
  Gene Name: angiomotin like 1
  Uniprot ID: Q8IY63
  ENST ID: ENST00000317829
  CDS Start-End: 171-2891
cggacggcggcgggagcgcgcgagaagctctaggacccagcagcggttgtcgggtttggggctggaggtgaagccctgtgtgaatggggttgattgtccggcgccacttccccgcgctgcccggcagccgtcttccccagccgagggactgaactagccatgatcgcctcatgtggagggcaaagttgcgccggggaacttgtgagcctgcggtgaaagttgaagatcctctttgtaacttccactccccaaacttcctgaggatctcagaggtggaaatgagaggttccgaggatgcggcagctggaacagtattgcagcggctgatccaggaacaactgcggtatggcaccccaaccgagaacatgaacttgctggccattcagcaccaggccacagggagtgcaggaccagcccatcctacaaacaacttttcttccacggaaaacctcactcaagaagacccacaaatggtctaccagtcagcacgccaagaaccgcagggtcaagaacaccaggtggacaatacggtgatggagaaacaggtccggtccacgcagcctcagcagaacaacgaggaactgcccacttacgaggaggccaaagcacagtcgcagttcttcagggggcagcagcagcagcaacagcagcagggggcggtgggccatggttactacatggcagggggcaccagtcagaagtcccgaactgaggggaggcccactgtgaaccgtgccaacagtggacaggcgcataaggacgaggcgctgaaggaactgaagcagggccacgtccgctcgctcagcgagagaatcatgcagctgtccctggagaggaatggggccaagcaacaccttcccggctcggggaatggaaagggcttcaaagtaggaggggggccctcccctgcccagcctgcaggtaaagtgctggaccctcggggtcctccacctgagtaccccttcaagaccaagcaaatgatgtccccagtcagcaagacccaggagcacggacttttttatggtgaccagcaccccgggatgctccacgagatggtcaagccctaccctgctcctcagcctgtgagaacagatgtggccgtcctgcggtaccagccaccccctgagtatggggtaacgagccgcccatgccaacttccgttcccatcaaccatgcagcagcacagccccatgtcctcccagacctcttccgccagcgggccactgcactctgtctccctgccgcttccactcccgatggccctgggtgctccacagcccccgcctgccgcctcccccagccagcagcttggtccagatgcctttgcgattgtggagcgagcccagcaaatggtggagatattaacagaggagaaccgggtgcttcaccaggaacttcagggttactacgacaatgccgacaagctccacaagtttgaaaaagaacttcagagaatttcggaagcctatgaaagtctggtcaagtctaccaccaagcgagaatcgctggacaaggccatgagaaacaaattggaaggcgagattagaagacttcatgatttcaacagagacctccgagatcgactagagactgctaacaggcaactatccagcagggaatacgaagggcatgaagacaaagctgcagaggggcattatgcttcccagaacaaagaattcttgaaggaaaaggagaaattagaaatggagttagcagcagtgcggactgcaagtgaggaccatcggagacacatcgagatcctggaccaggctttgagcaacgcccaggccagggtcatcaagctggaagaggagttacgagagaagcaagcatatgttgagaaagttgagaagctgcagcaggccctgacccagctgcagtctgcatgtgagaagcgagaacagatggagcggagactgcggacttggctggagagagagctggatgcactgagaacccagcagaaacatggaaatggccagccagccaacatgccggaatacaatgccccagccctcctggaacttgtgcgggagaaggaggagcggatcctggccctggaggccgacatgacaaagtgggagcagaagtacctggaggagagcaccatccgacactttgccatgaatgccgcagccactgcagcagctgagagggacaccacgatcatcaaccactcacggaatggcagctacggagagagctcgctggaggcccacatctggcaagaggaggaggaggtggtgcaggccaacagaaggtgtcaggacatggaatacactattaaaaatctccatgccaaaatcatagagaaagatgctatgattaaggtcctgcagcagcgatctcgtaaagatgccgggaagacagactcctccagcctacgtcctgcccgctccgttccatccatagcagcagctactgggacacactctcgccagacctctcttaccagcagccagctggctgaggaaaagaaggaagagaagacctggaaggggagcataggattgctgctggggaaggagcaccatgagcatgcctctgccccactgctgccacccccacccacctcagcactgtcctccatagcctccactacggcagccagcagtgcccacgccaagacaggcagcaaggacagcagcacacagactgacaagagtgccgagctcttctggcccagcatggcctcccttcccagccgcggccggctgagcacgacccctgctcacagccccgtcctgaaacacccagcggccaaagggaccgcagagaaactggagaactctcctggccatgggaagtcgcctgaccacagaggccgggtcagcagcttgctgcacaagcccgagttccctgatggagagatgatggaagtcctcatctaactgccatccctgtggaatttcagtacagaacactgacaaacaaggaaagcggcagagaaagaagaaagacctagaaggttgtagatgggaaatcaggaatgatttgaactgataaagatttcagactcataagaacacattttataaatgttaaacacaaaaactacatgactgaagatagaagagaatgcgatggattttattacacatggtggaagagagaagaggcgtgtaggtttgcaaacaaagttaagaaataggaaactgaatttttcattgtacagaaaatgtatctcttggggagggcctgtgtacccccattctctgattataaacagataaacccaaatgtggatcatccttggaatacccccattctccttgcctcttagcatgtttgatttaagaaaagcctccaggaaatcttgagagcctgtcttggcataatgcagtgtcacctgtgccaaccatggggtgtcccgtgagtgtgagtgtggcagtgagaagaagcatcgagggcgaggggaatatgaaagttggtcttcacctaattacctgtttggtttggattttcaagagatgattgggcttcttagcttttctgaattctgcagtattttctaaacaggatagattatgatctcggtccccatccatcctaacttctgagttcatctctgtctctgctttacagtctttaattttttgttgttccttcatttttttctttttaataagacatagcagaattccttaggtatgggatttatgagaccagtacctgaactgtcatcattcctactgtgtttgatagtgaccagtaggacaaagccacgtgccgacttcctggctgcttcacctttgcatagctgggttgcagctgcgaacctcattctgactgtgaactaagcaagctttgaggaggcaggagattccgtgggtccctgtgacatattgcattaagatcgtggcacttgcttttttgtctttcacatcggctgtcttgcaaggagcttgacatttccaaattccattgctctgtttggggaagacttaggacagcactccaggaaacagatgacaatttacagacagttgtctcagtggtttccagaatctcaccagcctcccgtatagcttcttgtattgaggctcatgagcgtattcacactctttcctcccccgcgcacgcctctgcttgctctcgatcagcatccagacctccgtggcaccaggttgcctctgttgtgaacttcttttgtaacctaccaggccagttgtatatacagtgttgtcaggtttttccgggtttcagttttgaggcagtttattcaaagtgagacagaagtgccacggaaaagaggcaggagtgtgttaggtggtgggtccattagacctctgctgtgacattgcatattcagctctgcagacactggcttcctttacaaatctaagagatgctggattagaaaagaggagaagctcatcgggccatcagagagatgctcctacagggtcctgatgtttttgtacctccaggtcagctggatcgctgttttcccagttccctttgctcatgcttacttagaggaagaaagaaaggggggtacctcttccaagtaccttctaaatgaaacactcaagagagtgctactcaggaaactttgcttggatcctaaaatggactggtcttgggtgtgtaaccccggtgaagttatagcctccccaaattgaggtgacagaaggaagacaagaggtgtaagctggagagggaagggaagaaatcagtggctttggccagcctctgtgccacccagtacgacagaggagtgggaactggccctctggggctctgcttggccataggcactgcacattgtgccacctgctcatcacctcctctagtctcacactgagcatcggagtacctgttgtgcagacaggaaaactgaggagctctgagaggctgagcatggagctcaccccatgccatagggtgtgggaagagggcacaggaggcctcatccatgggggaaagggttgaggatggacatgggtggggagagggcatagacatcccttcctaatctctgttcccaccacatttcataggagatgagttaggagatgacagctaactctcttaaggacattttgaccccagtttatgttggggatggaccagaaaggaaaatgtctagagataggaaggtaaatcaactctgccagcccctaccatcaggtctgggccaccccaaacttgggctgcctcccttagacataggttagagtgagagacccagctgtttctcccgaagcctcgtcttcatgccccagacacctgattgccccaatcaggtgtcagacttgcttgctcttcgaggtccccctgagctgccaagtgttttcattgtaaacagacacatcgccatgtttcagggcttcaacggcattgtattttggactttgaccgtattttttttctcttaacctactgagactcttccttaagaacaggatctatagctttaaaatgtcttcttctatgggaaatttcctgccaagccagggcactaaattctttcatcattagagctttcctgaagtccggccatatactgagtacctgctctgagttctgggcagcttacaatatcttaaacagattttcagaaaaataatgcaactatattttctagtgtcaactgtatgcaaacagtgtggtaaataccttttaattagtcctccacccacctggagtacagggggtgcgtttattattctgatttcactgatgaggaaatgggctcagaaaggttaagtcccttcctgaaatctcacagccaggagaagctaggatgatttaaaacaaagtttggagaggcactgggcatagaccctggctgtacagcctctaacatgcggcactgcatcttggcagtctctatgcctgtctgtgatgtgtgtgtgcacgtgtaactacacacacacacacacacacacacacacacacacacagctatcacacatctcagagcctaagaaataggactaagcccagaactcctagaatcacctataaatgctaggcatagatggaaattattgtgttccaccagaagcacagctccaaactatacctaaaaaatatttctgcacttcccagagacctggacttcaaactttcccagtggagcctgattatagaacttgagggtcctatctcaggatgaaggggagaggccctggcttcacgggaaggtattccagcattgttctgcttcacccttgactgcgttgtctggcagtttctgtgtgctgccaggatattatatggaactggagaagttggagtcaggtctctgaagctagagtttcactaattagatgcctctgtacatgagaactattactgtctgcaggtccatatagctaagctgccaggaaaaacacattatcttccaaaactttcagagcatgtgcagaaccctttcttagcgttttcttctcagcattttctctgcctcccagaggctggcagccagtgacactgcagagttcagcatgttctaaccatgcacgcagggcaggggctgccttggccctcctcaggctttcgttgggagagcaggcagtggtggagcccttctgggtgcagtcctctggggttgctctttggaactcatgtatgagtttgactccacaaggcttggcatggataccaaaacagttgcaacaaattagttctgaacctggaacagagaattcagtgcttctgttactcaggaaggaggtgttcagaatgccccgtgcagagcagccagtcattactcttgtttgttctcacctgggtgcgcaccctcatgatgcagtggctgtagcaccttcatgccaggtgctgagagaatgggaaattcttcctccccattgacctgagtcccagagacttagggacacagacttcaggtgaggctgcggacctcagaagcagtggataatagattggggcattaaaagcttttgaggcagggggctcatgttttgactgcagggagttatgctgagcaaagagatgtgtttttcaaaaccagggttcaaaaccagtgtccacgctggagtaagtggagcatgcttctctgtgttctctgaatgatcttgcactcctcttaagcaaaggagtaccatgaccatagtcagtgggatcccacaaatgttcttaaatgggtaaggctttaagtagccagagagtatccagcctaccattggcttctccacatcctaaaacctgagacagccttggtatatgctttataaatgtttcttttcttgttgtttaagtaattaaagtgtttaaaatgtcttcattagatgtgacgattgtttaatgagtttgcctctgacgtgtggctccatgggagataggcaaagtaattaagaagttaccagaaattggtcggctggggaaatgcaaaagttagcatttcagtagtgaatttctcctggaacaaatgagcaatttttcctctttctcttaagtagtatacccttttctcacttagtaatttaatggtatataaagacatgtgtataagtgagtgcatacatatgaggtatgactatagggttgtttgtgggaatttcttttcctaacatacagaagatcaaagtgttcatctcaccccgccctccttaaaaggtgtcttttgggagactatgtgctcattgactatagtgctgccaagtaaaaatatcttgggaactcttctactagaatggccttcagggcttggcatgttcctttggtttacccttagagatgagaaatcctcctcctttgaggatggatttaagttctggaaataatctcaagtgcttgatagcacagttggatgaaaaaagatggcaattaaggtaagttacaccatttttgtttctaaaaaaatccctaagaaatttcttggaatgagtctttggcctcagagcctctcaaagtgtccacttcaaggggggatcatcctcattagcacacagatttttaaaaatcaattctcttgccatgcctcctatgtgttcacatctctgcatacactacagatataagtgcataatcattcatataaacatctggtaggtattctgtaaaactgtgtttactttagtgcatgttattgtcatgttatgatgtgactggggtgtttctttgtcatgaaactttgcttcttcacagaattagaatactgctctctctatattgaactacatatacagcgttttcttgtatcagcccccaaagtctggatgcccggtgttgtgtttacatgtgattgtgcctaggagtctgttcacatagagacacctgtaagtatttattacaaaacggaatgtaagcaaatatatccacattggttttatttgaatcaaggtgtttttttgttttttgttttttttccttttgaggaggaacagggagcctcctcctccatgagcacttacagaattgtgtaaaattctgtgaaacagtggtaagcatgggcacccgatttcagctgtcctgctgccgctgccctccaacctgctctgtgtgtgtgtgtcgctgtgcttggtggcagtgtgccgtgctcgtgccggctcttcccagcagactggtatctggctgtaacgtttgacgtcttcatattgccagtctgtattgaggggtgatgtacatggccatacagccaaatgggtctgtgtaccagtgtggggattccaagaacactgcctgtcccccacagcaaatattgatgctgttggtcagccaaagattttcctctcctttgctgcttaaacttgtgccttaatattgtacataataaatggataaaatggcaaaatgactcttttctctcgcttgctcctttcttccttaaagaacttataaactgatgctcaataaatgtttcatttcattgta

SEQ ID NO: 107210 - DNA, 8970 bp, Homo sapiens
  Payload ID: 1044
  Gene Symbol: AMOTL1
  Gene Name: angiomotin like 1
  Uniprot ID: Q8IY63
  ENST ID: ENST00000433060
  CDS Start-End: 142-3012
ctaggacccagcagcggttgtcgggtttggggctggaggtgaagccctgtgtgaatggggttgattgtccggcgccacttccccgcgctgcccggcagccgtcttccccagccgagggactgaactagccatgatcgcctcatgtggagggcaaagttgcgccggggaacttgtgagcctgcggtgaaagggtccccttctgcttgttatagccccagtagtcctgtccaggttctagaagactccacctacttttccccagactttcagctctattctgggaggcatgaaacatctgctttgacggtggaggcaaccagtagcatcagggaaaaagttgttgaagatcctctttgtaacttccactccccaaacttcctgaggatctcagaggtggaaatgagaggttccgaggatgcggcagctggaacagtattgcagcggctgatccaggaacaactgcggtatggcaccccaaccgagaacatgaacttgctggccattcagcaccaggccacagggagtgcaggaccagcccatcctacaaacaacttttcttccacggaaaacctcactcaagaagacccacaaatggtctaccagtcagcacgccaagaaccgcagggtcaagaacaccaggtggacaatacggtgatggagaaacaggtccggtccacgcagcctcagcagaacaacgaggaactgcccacttacgaggaggccaaagcacagtcgcagttcttcagggggcagcagcagcagcaacagcagcagggggcggtgggccatggttactacatggcagggggcaccagtcagaagtcccgaactgaggggaggcccactgtgaaccgtgccaacagtggacaggcgcataaggacgaggcgctgaaggaactgaagcagggccacgtccgctcgctcagcgagagaatcatgcagctgtccctggagaggaatggggccaagcaacaccttcccggctcggggaatggaaagggcttcaaagtaggaggggggccctcccctgcccagcctgcaggtaaagtgctggaccctcggggtcctccacctgagtaccccttcaagaccaagcaaatgatgtccccagtcagcaagacccaggagcacggacttttttatggtgaccagcaccccgggatgctccacgagatggtcaagccctaccctgctcctcagcctgtgagaacagatgtggccgtcctgcggtaccagccaccccctgagtatggggtaacgagccgcccatgccaacttccgttcccatcaaccatgcagcagcacagccccatgtcctcccagacctcttccgccagcgggccactgcactctgtctccctgccgcttccactcccgatggccctgggtgctccacagcccccgcctgccgcctcccccagccagcagcttggtccagatgcctttgcgattgtggagcgagcccagcaaatggtggagatattaacagaggagaaccgggtgcttcaccaggaacttcagggttactacgacaatgccgacaagctccacaagtttgaaaaagaacttcagagaatttcggaagcctatgaaagtctggtcaagtctaccaccaagcgagaatcgctggacaaggccatgagaaacaaattggaaggcgagattagaagacttcatgatttcaacagagacctccgagatcgactagagactgctaacaggcaactatccagcagggaatacgaagggcatgaagacaaagctgcagaggggcattatgcttcccagaacaaagaattcttgaaggaaaaggagaaattagaaatggagttagcagcagtgcggactgcaagtgaggaccatcggagacacatcgagatcctggaccaggctttgagcaacgcccaggccagggtcatcaagctggaagaggagttacgagagaagcaagcatatgttgagaaagttgagaagctgcagcaggccctgacccagctgcagtctgcatgtgagaagcgagaacagatggagcggagactgcggacttggctggagagagagctggatgcactgagaacccagcagaaacatggaaatggccagccagccaacatgccggaatacaatgccccagccctcctggaacttgtgcgggagaaggaggagcggatcctggccctggaggccgacatgacaaagtgggagcagaagtacctggaggagagcaccatccgacactttgccatgaatgccgcagccactgcagcagctgagagggacaccacgatcatcaaccactcacggaatggcagctacggagagagctcgctggaggcccacatctggcaagaggaggaggaggtggtgcaggccaacagaaggtgtcaggacatggaatacactattaaaaatctccatgccaaaatcatagagaaagatgctatgattaaggtcctgcagcagcgatctcgtaaagatgccgggaagacagactcctccagcctacgtcctgcccgctccgttccatccatagcagcagctactgggacacactctcgccagacctctcttaccagcagccagctggctgaggaaaagaaggaagagaagacctggaaggggagcataggattgctgctggggaaggagcaccatgagcatgcctctgccccactgctgccacccccacccacctcagcactgtcctccatagcctccactacggcagccagcagtgcccacgccaagacaggcagcaaggacagcagcacacagactgacaagagtgccgagctcttctggcccagcatggcctcccttcccagccgcggccggctgagcacgacccctgctcacagccccgtcctgaaacacccagcggccaaagggaccgcagagaaactggagaactctcctggccatgggaagtcgcctgaccacagaggccgggtcagcagcttgctgcacaagcccgagttccctgatggagagatgatggaagtcctcatctaactgccatccctgtggaatttcagtacagaacactgacaaacaaggaaagcggcagagaaagaagaaagacctagaaggttgtagatgggaaatcaggaatgatttgaactgataaagatttcagactcataagaacacattttataaatgttaaacacaaaaactacatgactgaagatagaagagaatgcgatggattttattacacatggtggaagagagaagaggcgtgtaggtttgcaaacaaagttaagaaataggaaactgaatttttcattgtacagaaaatgtatctcttggggagggcctgtgtacccccattctctgattataaacagataaacccaaatgtggatcatccttggaatacccccattctccttgcctcttagcatgtttgatttaagaaaagcctccaggaaatcttgagagcctgtcttggcataatgcagtgtcacctgtgccaaccatggggtgtcccgtgagtgtgagtgtggcagtgagaagaagcatcgagggcgaggggaatatgaaagttggtcttcacctaattacctgtttggtttggattttcaagagatgattgggcttcttagcttttctgaattctgcagtattttctaaacaggatagattatgatctcggtccccatccatcctaacttctgagttcatctctgtctctgctttacagtctttaattttttgttgttccttcatttttttctttttaataagacatagcagaattccttaggtatgggatttatgagaccagtacctgaactgtcatcattcctactgtgtttgatagtgaccagtaggacaaagccacgtgccgacttcctggctgcttcacctttgcatagctgggttgcagctgcgaacctcattctgactgtgaactaagcaagctttgaggaggcaggagattccgtgggtccctgtgacatattgcattaagatcgtggcacttgcttttttgtctttcacatcggctgtcttgcaaggagcttgacatttccaaattccattgctctgtttggggaagacttaggacagcactccaggaaacagatgacaatttacagacagttgtctcagtggtttccagaatctcaccagcctcccgtatagcttcttgtattgaggctcatgagcgtattcacactctttcctcccccgcgcacgcctctgcttgctctcgatcagcatccagacctccgtggcaccaggttgcctctgttgtgaacttcttttgtaacctaccaggccagttgtatatacagtgttgtcaggtttttccgggtttcagttttgaggcagtttattcaaagtgagacagaagtgccacggaaaagaggcaggagtgtgttaggtggtgggtccattagacctctgctgtgacattgcatattcagctctgcagacactggcttcctttacaaatctaagagatgctggattagaaaagaggagaagctcatcgggccatcagagagatgctcctacagggtcctgatgtttttgtacctccaggtcagctggatcgctgttttcccagttccctttgctcatgcttacttagaggaagaaagaaaggggggtacctcttccaagtaccttctaaatgaaacactcaagagagtgctactcaggaaactttgcttggatcctaaaatggactggtcttgggtgtgtaaccccggtgaagttatagcctccccaaattgaggtgacagaaggaagacaagaggtgtaagctggagagggaagggaagaaatcagtggctttggccagcctctgtgccacccagtacgacagaggagtgggaactggccctctggggctctgcttggccataggcactgcacattgtgccacctgctcatcacctcctctagtctcacactgagcatcggagtacctgttgtgcagacaggaaaactgaggagctctgagaggctgagcatggagctcaccccatgccatagggtgtgggaagagggcacaggaggcctcatccatgggggaaagggttgaggatggacatgggtggggagagggcatagacatcccttcctaatctctgttcccaccacatttcataggagatgagttaggagatgacagctaactctcttaaggacattttgaccccagtttatgttggggatggaccagaaaggaaaatgtctagagataggaaggtaaatcaactctgccagcccctaccatcaggtctgggccaccccaaacttgggctgcctcccttagacataggttagagtgagagacccagctgtttctcccgaagcctcgtcttcatgccccagacacctgattgccccaatcaggtgtcagacttgcttgctcttcgaggtccccctgagctgccaagtgttttcattgtaaacagacacatcgccatgtttcagggcttcaacggcattgtattttggactttgaccgtattttttttctcttaacctactgagactcttccttaagaacaggatctatagctttaaaatgtcttcttctatgggaaatttcctgccaagccagggcactaaattctttcatcattagagctttcctgaagtccggccatatactgagtacctgctctgagttctgggcagcttacaatatcttaaacagattttcagaaaaataatgcaactatattttctagtgtcaactgtatgcaaacagtgtggtaaataccttttaattagtcctccacccacctggagtacagggggtgcgtttattattctgatttcactgatgaggaaatgggctcagaaaggttaagtcccttcctgaaatctcacagccaggagaagctaggatgatttaaaacaaagtttggagaggcactgggcatagaccctggctgtacagcctctaacatgcggcactgcatcttggcagtctctatgcctgtctgtgatgtgtgtgtgcacgtgtaactacacacacacacacacacacacacacacacacacacagctatcacacatctcagagcctaagaaataggactaagcccagaactcctagaatcacctataaatgctaggcatagatggaaattattgtgttccaccagaagcacagctccaaactatacctaaaaaatatttctgcacttcccagagacctggacttcaaactttcccagtggagcctgattatagaacttgagggtcctatctcaggatgaaggggagaggccctggcttcacgggaaggtattccagcattgttctgcttcacccttgactgcgttgtctggcagtttctgtgtgctgccaggatattatatggaactggagaagttggagtcaggtctctgaagctagagtttcactaattagatgcctctgtacatgagaactattactgtctgcaggtccatatagctaagctgccaggaaaaacacattatcttccaaaactttcagagcatgtgcagaaccctttcttagcgttttcttctcagcattttctctgcctcccagaggctggcagccagtgacactgcagagttcagcatgttctaaccatgcacgcagggcaggggctgccttggccctcctcaggctttcgttgggagagcaggcagtggtggagcccttctgggtgcagtcctctggggttgctctttggaactcatgtatgagtttgactccacaaggcttggcatggataccaaaacagttgcaacaaattagttctgaacctggaacagagaattcagtgcttctgttactcaggaaggaggtgttcagaatgccccgtgcagagcagccagtcattactcttgtttgttctcacctgggtgcgcaccctcatgatgcagtggctgtagcaccttcatgccaggtgctgagagaatgggaaattcttcctccccattgacctgagtcccagagacttagggacacagacttcaggtgaggctgcggacctcagaagcagtggataatagattggggcattaaaagcttttgaggcagggggctcatgttttgactgcagggagttatgctgagcaaagagatgtgtttttcaaaaccagggttcaaaaccagtgtccacgctggagtaagtggagcatgcttctctgtgttctctgaatgatcttgcactcctcttaagcaaaggagtaccatgaccatagtcagtgggatcccacaaatgttcttaaatgggtaaggctttaagtagccagagagtatccagcctaccattggcttctccacatcctaaaacctgagacagccttggtatatgctttataaatgtttcttttcttgttgtttaagtaattaaagtgtttaaaatgtcttcattagatgtgacgattgtttaatgagtttgcctctgacgtgtggctccatgggagataggcaaagtaattaagaagttaccagaaattggtcggctggggaaatgcaaaagttagcatttcagtagtgaatttctcctggaacaaatgagcaatttttcctctttctcttaagtagtatacccttttctcacttagtaatttaatggtatataaagacatgtgtataagtgagtgcatacatatgaggtatgactatagggttgtttgtgggaatttcttttcctaacatacagaagatcaaagtgttcatctcaccccgccctccttaaaaggtgtcttttgggagactatgtgctcattgactatagtgctgccaagtaaaaatatcttgggaactcttctactagaatggccttcagggcttggcatgttcctttggtttacccttagagatgagaaatcctcctcctttgaggatggatttaagttctggaaataatctcaagtgcttgatagcacagttggatgaaaaaagatggcaattaaggtaagttacaccatttttgtttctaaaaaaatccctaagaaatttcttggaatgagtctttggcctcagagcctctcaaagtgtccacttcaaggggggatcatcctcattagcacacagatttttaaaaatcaattctcttgccatgcctcctatgtgttcacatctctgcatacactacagatataagtgcataatcattcatataaacatctggtaggtattctgtaaaactgtgtttactttagtgcatgttattgtcatgttatgatgtgactggggtgtttctttgtcatgaaactttgcttcttcacagaattagaatactgctctctctatattgaactacatatacagcgttttcttgtatcagcccccaaagtctggatgcccggtgttgtgtttacatgtgattgtgcctaggagtctgttcacatagagacacctgtaagtatttattacaaaacggaatgtaagcaaatatatccacattggttttatttgaatcaaggtgtttttttgttttttgttttttttccttttgaggaggaacagggagcctcctcctccatgagcacttacagaattgtgtaaaattctgtgaaacagtggtaagcatgggcacccgatttcagctgtcctgctgccgctgccctccaacctgctctgtgtgtgtgtgtcgctgtgcttggtggcagtgtgccgtgctcgtgccggctcttcccagcagactggtatctggctgtaacgtttgacgtcttcatattgccagtctgtattgaggggtgatgtacatggccatacagccaaatgggtctgtgtaccagtgtggggattccaagaacactgcctgtcccccacagcaaatattgatgctgttggtcagccaaagattttcctctcctttgctgcttaaacttgtgccttaatattgtacataataaatggataaaatggcaaaatgactcttttctctcgcttgctcctttcttccttaaagaacttataaactgatgctcaataaatgtttcatttcattgtacccca

SEQ ID NO: 107211 - DNA, 4488 bp, Homo sapiens
  Payload ID: 1045
  Gene Symbol: AMOTL2
  Gene Name: angiomotin like 2
  Uniprot ID: Q9Y2J4
  ENST ID: ENST00000249883
  CDS Start-End: 315-2657
cggagggcggaggagggcggtgcgctgagaggttatttgtggttcgctttgatcccgagggggaacctgaaactctcacattcctggcatagcagccgcctccggcgcgggccgaccctggggctgcgcgctggggcgcgaacagccagagcgtcggcgccacggccgagaacacatcttcgccgccgagctgagctgggccgagccggaggttgtggtgtctgactgcgctgggcaccctcgggccgcagcggtgctctggggccaggtgccaccggccattgtccaggcagctgtgtgcaagccaaagaagcatgaggacactggaagactcctcggggacagtcctgcaccgcctcatccaggagcagctgcgctacggcaacctgactgagacgcgcacgctgctagccatccagcagcaggccctgaggggtggggctggaactgggggtacagggagcccccaggcctccctggagatcctggccccagaggacagtcaggtgctgcagcaggccaccaggcaggagccccagggccaggagcaccagggcggtgagaaccacctggcagagaacaccctctaccggctatgcccacagcccagcaagggagaggagctgcccacctatgaggaggccaaagcccactcgcagtactatgcggcccagcaggcagggacccggccacatgcgggggaccgagatccccgtggggccccgggaggcagtcggaggcaggacgaggccctgcgggagctgaggcatgggcacgtgcgctcgttgagtgaacggctccttcagttgtccctggagaggaacggcgcccgggcccccagccacatgagctcctcccacagcttcccacagctggcccgcaaccagcagggccccccactgaggggcccccctgctgagggcccagagtcccgaggacccccacctcagtaccctcatgttgtactagctcatgagaccaccactgctgtcactgacccacggtaccgtgcccgcggcagcccgcacttccagcatgctgaagtcaggatcctgcaggcccaggtgcctcctgtgttcctccaacagcagcagcagtaccagtacctgcagcaatctcaggagcacccccctcccccacatccagctgctctcggccatggccccctgagctccctcagtccacctgctgtggaggggccagtgagtgcccaggcctcctcagccacctcgggcagtgcccacctggcccagatggaggccgtgctgagggagaatgccaggctgcagagagacaatgagcggctgcagagggagctggagagctctgcggagaaggctggccgcattgagaagctggaaagcgaaatccagcggctctctgaggcccatgagagcctgaccagagcctcctccaagcgtgaggccctggagaagaccatgcggaacaagatggacagtgaaatgaggaggctgcaagacttcaaccgggatcttagagagagattggaatctgcaaatcgccgcctggcaagcaagacacaggaggcccaggccggcagtcaggacatggtggccaagctgcttgctcagagctacgaacagcagcaggagcaagagaagctggagcgagagatggcactgctgcgcggcgccatcgaggaccagcggcggcgtgccgagctgctggagcaggctctgggcaatgcgcagggccgggcagctcgagccgaagaggagctgcgcaagaagcaggcctatgtggagaaagtggagcggctgcagcaggcgctcgggcagctgcaggcagcctgtgagaagcgggagcagctggagctgcgtctgcggactcgcctggagcaggaactcaaggccctgcgtgcacagcagagacaggcaggtgccccaggtggtagcagtggcagtggtgggtctccagagctcagcgccctgcgactgtcagaacaactgcgagagaaggaggagcagatcctggcgctggaggccgacatgaccaagtgggagcagaagtatttggaggaacgtgccatgaggcagtttgccatggatgcggctgccacggctgctgctcagcgtgacaccactctcatccgacattccccccagccctcacccagcagcagcttcaatgagggtctgctcactggtggccacaggcatcaggagatggaaagcaggttaaaggtgctccatgcccagatcctggagaaggatgcagtgatcaaggtccttcagcagcgctccaggagagaccctggcaaggccatccagggctccctgcggcctgccaagtcggtgccatctgttttcgcggctgcggcagcaggaacccagggctggcaagggctctcttctagtgagcgacaaacagcagacgcccctgctcggctgactacagcagacagagcacccacagaggagccagtggtcacagctccccctgctgcccatgccaaacacgggagcagagatgggagcacccagactgagggccccccagacagcacctccacctgcctgccaccggagcctgacagccttctggggtgcagcagtagccagagagcagcctctctggactctgtagctacatccagagtccaggacttgtcagacatggtggagatactgatctgaaggaggtggtgcttcaggactctgagccattctctcccctcctctgccctgtgccactctcagccatttcagcagccccgtcaaccgctgctccgtccctttccccagccagacactcattcccattgaccatctggtcccaggagctcaggaggaggaccccaggggagaggagagctgtgagagcaccggcacccccagaagactctgcttcttagcccacattcctccgggccttatggagaatgaggattcagccttgacttcttgcccaaggcctgctactggggtagcaactgacagctcagaaaggagctgagctccctctgccctgccagttgtcagtcaggcagggagggagtggctgtgttggtttggggaactaatttccacggacggctgcccgtggacaccaggtggactggttcactaatcaagtcagccatattgttctctggctaagtttggttccagccaacgtcatctgctcttcagttcctcactgccttcttgggatactaagacttgaattttttggggactattaagggtgttagtcttggagaagacacagcctcaccttctcacttgctgtgggtgaggggccatttaagtggactgggagacagtgcgcagtttgtatataattccctttcttgtggaacagaagactgaggcctgcaggttccgatgtgtctccatgggctgtgctcccctcttcctactgtcagtttctgaaacttctgactggcctcccagttatgcctcctcctcaagttcctggcccgtggatgttaaagctgctcgattcccaggatctcggctgccttttcctctatcttgagccctataaatgcccacgggacccccaccaccagcctcttgaagtggctccacagctcctgtccctggaacatcctgtcagtttggtcataaaccctgagccagatgaaatgagccaccgtgaacagacatctgccatgcccccaggtgggcttcggtggccctacccggtaccagttctttctgagaaactggagatgtcttgttagcataagtgtcttcattcccacctggagggtttgggagaggagcaaagcagttgaaaactagttaatgagctacaagagtcaaatagtcctctgaatggagcccccatcacaaaacagtgcccaggaggctggctcctcaagctacccatgcccagcgccctaaagcagcaccagatgctttggaattggggtgaaacacccacatggcagcctgctagcagcagtgactttgacttctggtcttaaagagtccctcacttcagccccaggagctattggtgggttttagcagttttgtctttaccgtttttagttctccttgattctttgttttcttcctttatcgtttttaggtttggtatgtgttgttttatttccatggttcctcaagtttcctttttaaacatttgcatttgctggacaattgcaattttttttaaaaaattcccctacccctgtttaaagctgaaaaatacatttggttcatgtgcattgtttacaaagcaaaaagaaaaaagaggaaaaaaaggcaaaaaatattgtgaaagaaaaaaaacaacttaatatattttggattaatatttggtatttcttttaaagtattttttgtgctgtgaacattttctgccaaagaccatgatgtgtgtctgtatgtttaagttatcgtaaatatttaaaatgtaaacatggctgttttgttatgccaccctgtaccaggattgctgccgcattccactgggtataacagtattttaattaaaaaaaaataattaaaagtg

SEQ ID NO: 107212 - DNA, 4335 bp, Homo sapiens
  Payload ID: 1045
  Gene Symbol: AMOTL2
  Gene Name: angiomotin like 2
  Uniprot ID: Q9Y2J4
  ENST ID: ENST00000422605
  CDS Start-End: 168-2507
agagcgtcggcgccacggccgagaacacatcttcgccgccgagctgagctgggccgagccggaggttgtggtgtctgactgcgctgggcaccctcgggccgcagcggtgctctggggccaggtgccaccggccattgtccaggcagctgtgtgcaagccaaagaagcatgaggacactggaagactcctcggggacagtcctgcaccgcctcatccaggagcagctgcgctacggcaacctgactgagacgcgcacgctgctagccatccagcagcaggccctgaggggtggggctggaactgggggtacagggagcccccaggcctccctggagatcctggccccagaggacagtcaggtgctgcagcaggccaccaggcaggagccccagggccaggagcaccagggcggtgagaaccacctggcagagaacaccctctaccggctatgcccacagcccagcaagggagaggagctgcccacctatgaggaggccaaagcccactcgcagtactatgcggcccagcaggcagggacccggccacatgcgggggaccgagatccccgtggggccccgggaggcagtcggaggcaggacgaggccctgcgggagctgaggcatgggcacgtgcgctcgttgagtgaacggctccttcagttgtccctggagaggaacggcgcccgggcccccagccacatgagctcctcccacagcttcccacagctggcccgcaaccagcagggccccccactgaggggcccccctgctgagggcccagagtcccgaggacccccacctcagtaccctcatgttgtactagctcatgagaccaccactgctgtcactgacccacggtaccgtgcccgcggcagcccgcacttccagcatgctgaagtcaggatcctgcaggcccaggtgcctcctgtgttcctccaacagcagcagcagtaccagtacctgcagcaatctcaggagcacccccctcccccacatccagctgctctcggccatggccccctgagctccctcagtccacctgctgtggaggggccagtgagtgcccaggcctcctcagccacctcgggcagtgcccacctggcccagatggaggccgtgctgagggagaatgccaggctgcagagagacaatgagcggctgcagagggagctggagagctctgcggagaaggctggccgcattgagaagctggaaagcgaaatccagcggctctctgaggcccatgagagcctgaccagagcctcctccaagcgtgaggccctggagaagaccatgcggaacaagatggacagtgaaatgaggaggctgcaagacttcaaccgggatcttagagagagattggaatctgcaaatcgccgcctggcaagcaagacacaggaggcccaggccggcagtcaggacatggtggccaagctgcttgctcagagctacgaacagcagcaggagcaagagaagctggagcgagagatggcactgctgcgcggcgccatcgaggaccagcggcggcgtgccgagctgctggagcaggctctgggcaatgcgcagggccgggcagctcgagccgaagaggagctgcgcaagaagcaggcctatgtggagaaagtggagcggctgcagcaggcgctcgggcagctgcaggcagcctgtgagaagcgggagcagctggagctgcgtctgcggactcgcctggagcaggaactcaaggccctgcgtgcacagcagagacaggcaggtgccccaggtggtagcagtggcagtggtgggtctccagagctcagcgccctgcgactgtcagaacaactgcgagagaaggaggagcagatcctggcgctggaggccgacatgaccaagtgggagcagaagtatttggaggaacgtgccatgaggcagtttgccatggatgcggctgccacggctgctgctcagcgtgacaccactctcatccgacattccccccagccctcacccagcagcagcttcaatgagggtctgctcactggtggccacaggcatcaggagatggaaagcaggttaaaggtgctccatgcccagatcctggagaaggatgcagtgatcaaggtccttcagcagcgctccaggagagaccctggcaaggccatccagggctccctgcggcctgccaagtcggtgccatctgttttcgcggctgcggcagcaggaacccagggctggcaagggctctcttctagtgagcgacaaacagcagacgcccctgctcggctgactacagacagagcacccacagaggagccagtggtcacagctccccctgctgcccatgccaaacacgggagcagagatgggagcacccagactgagggccccccagacagcacctccacctgcctgccaccggagcctgacagccttctggggtgcagcagtagccagagagcagcctctctggactctgtagctacatccagagtccaggacttgtcagacatggtggagatactgatctgaaggaggtggtgcttcaggactctgagccattctctcccctcctctgccctgtgccactctcagccatttcagcagccccgtcaaccgctgctccgtccctttccccagccagacactcattcccattgaccatctggtcccaggagctcaggaggaggaccccaggggagaggagagctgtgagagcaccggcacccccagaagactctgcttcttagcccacattcctccgggccttatggagaatgaggattcagccttgacttcttgcccaaggcctgctactggggtagcaactgacagctcagaaaggagctgagctccctctgccctgccagttgtcagtcaggcagggagggagtggctgtgttggtttggggaactaatttccacggacggctgcccgtggacaccaggtggactggttcactaatcaagtcagccatattgttctctggctaagtttggttccagccaacgtcatctgctcttcagttcctcactgccttcttgggatactaagacttgaattttttggggactattaagggtgttagtcttggagaagacacagcctcaccttctcacttgctgtgggtgaggggccatttaagtggactgggagacagtgcgcagtttgtatataattccctttcttgtggaacagaagactgaggcctgcaggttccgatgtgtctccatgggctgtgctcccctcttcctactgtcagtttctgaaacttctgactggcctcccagttatgcctcctcctcaagttcctggcccgtggatgttaaagctgctcgattcccaggatctcggctgccttttcctctatcttgagccctataaatgcccacgggacccccaccaccagcctcttgaagtggctccacagctcctgtccctggaacatcctgtcagtttggtcataaaccctgagccagatgaaatgagccaccgtgaacagacatctgccatgcccccaggtgggcttcggtggccctacccggtaccagttctttctgagaaactggagatgtcttgttagcataagtgtcttcattcccacctggagggtttgggagaggagcaaagcagttgaaaactagttaatgagctacaagagtcaaatagtcctctgaatggagcccccatcacaaaacagtgcccaggaggctggctcctcaagctacccatgcccagcgccctaaagcagcaccagatgctttggaattggggtgaaacacccacatggcagcctgctagcagcagtgactttgacttctggtcttaaagagtccctcacttcagccccaggagctattggtgggttttagcagttttgtctttaccgtttttagttctccttgattctttgttttcttcctttatcgtttttaggtttggtatgtgttgttttatttccatggttcctcaagtttcctttttaaacatttgcatttgctggacaattgcaattttttttaaaaaattcccctacccctgtttaaagctgaaaaatacatttggttcatgtgcattgtttacaaagcaaaaagaaaaaagaggaaaaaaaggcaaaaaatattgtgaaagaaaaaaaacaacttaatatattttggattaatatttggtatttcttttaaagtattttttgtgctgtgaacattttctgccaaagaccatgatgtgtgtctgtatgtttaagttatcgtaaatatttaaaatgtaaacatggctgttttgttatgccaccctgtaccaggattgctgccgcattccactgggtataacagtattttaattaaaaaaaaataattaaaa

SEQ ID NO: 107213 - DNA, 535 bp, Homo sapiens
  Payload ID: 1045
  Gene Symbol: AMOTL2
  Gene Name: angiomotin like 2
  ENST ID: ENST00000502491
  CDS Start-End: 437-535
cttttccgggagtcggagcctcgaggatcgagcgtcctcggggcgcagtgcgccctttcgaggcagccgcagtgcctggcaagggccgctctgcccagggagcgcagcgcgctgggctttgcggggctctagaaacgcgcgggtctcttggggctgggggagaggggagagggccgactccggagacaacagccacagtgtttcgggttgcaggaatagtaagtctccatgaatgttatcattagtaatcgtttaccaggattttcactgtgccaggagctcgcaggccactgcctctttttttttcctcatctccatgagtcaagcagaattctttgcatttttctggtggagaaactgaggctcagagattaggtgctctggggccaggtgccaccggccattgtccaggcagctgtgtgcaagccaaagaagcatgaggacactggaagactcctcggggacagtcctgcaccgcctcatccaggagcagctgcgctacggcaacctgactgagacgcgcacgctgctagcc

SEQ ID NO: 107214 - DNA, 544 bp, Homo sapiens
  Payload ID: 1045
  Gene Symbol: AMOTL2
  Gene Name: angiomotin like 2
  ENST ID: ENST00000506107
  CDS Start-End: 163-544
acacacacacacacacagccggagtcccctcccgcagcaaccccaggacacgcgtggtacagcccttgctgtcgtcccgtcgatgggtttagggatgaagggtgctctggggccaggtgccaccggccattgtccaggcagctgtgtgcaagccaaagaagcatgaggacactggaagactcctcggggacagtcctgcaccgcctcatccaggagcagctgcgctacggcaacctgactgagacgcgcacgctgctagccatccagcagcaggccctgaggggtggggctggaactgggggtacagggagcccccaggcctccctggagatcctggccccagaggacagtcaggtgctgcagcaggccaccaggcaggagccccagggccaggagcaccagggcggtgagaaccacctggcagagaacaccctctaccggctatgcccacagcccagcaagggagaggagctgcccacctatgaggaggccaaagcccactcgcagtactatgcggcccagcaggcagggacccggccacatg

SEQ ID NO: 107215 - DNA, 4521 bp, Homo sapiens
  Payload ID: 1045
  Gene Symbol: AMOTL2
  Gene Name: angiomotin like 2
  Uniprot ID: Q9Y2J4
  ENST ID: ENST00000514516
  CDS Start-End: 180-2693
gatagccagggaggggttttgagaatgagaaaccaagcagcccagtggttgattacctggttctcactgtgtgtgactctgggcacgctgcttaagctctctgagccctggtgtcctcatttacaacacagggatgataacagaactccgttggagggtgcttggcagggctgaatcggatgactgggcgaaaagccagcggtggcacaccttgcactctgcgtaaaggggcgcctattatcaccttggggaagaactggacagagcgcctggcggcgggtgattcagttgggtgctctggggccaggtgccaccggccattgtccaggcagctgtgtgcaagccaaagaagcatgaggacactggaagactcctcggggacagtcctgcaccgcctcatccaggagcagctgcgctacggcaacctgactgagacgcgcacgctgctagccatccagcagcaggccctgaggggtggggctggaactgggggtacagggagcccccaggcctccctggagatcctggccccagaggacagtcaggtgctgcagcaggccaccaggcaggagccccagggccaggagcaccagggcggtgagaaccacctggcagagaacaccctctaccggctatgcccacagcccagcaagggagaggagctgcccacctatgaggaggccaaagcccactcgcagtactatgcggcccagcaggcagggacccggccacatgcgggggaccgagatccccgtggggccccgggaggcagtcggaggcaggacgaggccctgcgggagctgaggcatgggcacgtgcgctcgttgagtgaacggctccttcagttgtccctggagaggaacggcgcccgggcccccagccacatgagctcctcccacagcttcccacagctggcccgcaaccagcagggccccccactgaggggcccccctgctgagggcccagagtcccgaggacccccacctcagtaccctcatgttgtactagctcatgagaccaccactgctgtcactgacccacggtaccgtgcccgcggcagcccgcacttccagcatgctgaagtcaggatcctgcaggcccaggtgcctcctgtgttcctccaacagcagcagcagtaccagtacctgcagcaatctcaggagcacccccctcccccacatccagctgctctcggccatggccccctgagctccctcagtccacctgctgtggaggggccagtgagtgcccaggcctcctcagccacctcgggcagtgcccacctggcccagatggaggccgtgctgagggagaatgccaggctgcagagagacaatgagcggctgcagagggagctggagagctctgcggagaaggctggccgcattgagaagctggaaagcgaaatccagcggctctctgaggcccatgagagcctgaccagagcctcctccaagcgtgaggccctggagaagaccatgcggaacaagatggacagtgaaatgaggaggctgcaagacttcaaccgggatcttagagagagattggaatctgcaaatcgccgcctggcaagcaagacacaggaggcccaggccggcagtcaggacatggtggccaagctgcttgctcagagctacgaacagcagcaggagcaagagaagctggagcgagagatggcactgctgcgcggcgccatcgaggaccagcggcggcgtgccgagctgctggagcaggctctgggcaatgcgcagggccgggcagctcgagccgaagaggagctgcgcaagaagcaggcctatgtggagaaagtggagcggctgcagcaggcgctcgggcagctgcaggcagcctgtgagaagcgggagcagctggagctgcgtctgcggactcgcctggagcaggaactcaaggccctgcgtgcacagcagagacaggcaggtgccccaggtggtagcagtggcagtggtgggtctccagagctcagcgccctgcgactgtcagaacaactgcgagagaaggaggagcagatcctggcgctggaggccgacatgaccaagtgggagcagaagtatttggaggaacgtgccatgaggcagtttgccatggatgcggctgccacggctgctgctcagcgtgacaccactctcatccgacattccccccagccctcacccagcagcagcttcaatgagggtctgctcactggtggccacaggcatcaggagatggaaagcaggttaaaggtgctccatgcccagatcctggagaaggatgcagtgatcaaggtccttcagcagcgctccaggagagaccctggcaaggccatccagggctccctgcggcctgccaagtcggtgccatctgttttcgcggctgcggcagcaggaacccagggctggcaagggctctcttctagtgagcgacaaacagcagacgcccctgctcggctgactacagacagagcacccacagaggagccagtggtcacagctccccctgctgcccatgccaaacacgggagcagagatgggagcacccagactgagggccccccagacagcacctccacctgcctgccaccggagcctgacagccttctggggtgcagcagtagccagagagcagcctctctggactctgtagctacatccagagtccaggacttgtcagacatggtggagatactgatctgaaggaggtggtgcttcaggactctgagccattctctcccctcctctgccctgtgccactctcagccatttcagcagccccgtcaaccgctgctccgtccctttccccagccagacactcattcccattgaccatctggtcccaggagctcaggaggaggaccccaggggagaggagagctgtgagagcaccggcacccccagaagactctgcttcttagcccacattcctccgggccttatggagaatgaggattcagccttgacttcttgcccaaggcctgctactggggtagcaactgacagctcagaaaggagctgagctccctctgccctgccagttgtcagtcaggcagggagggagtggctgtgttggtttggggaactaatttccacggacggctgcccgtggacaccaggtggactggttcactaatcaagtcagccatattgttctctggctaagtttggttccagccaacgtcatctgctcttcagttcctcactgccttcttgggatactaagacttgaattttttggggactattaagggtgttagtcttggagaagacacagcctcaccttctcacttgctgtgggtgaggggccatttaagtggactgggagacagtgcgcagtttgtatataattccctttcttgtggaacagaagactgaggcctgcaggttccgatgtgtctccatgggctgtgctcccctcttcctactgtcagtttctgaaacttctgactggcctcccagttatgcctcctcctcaagttcctggcccgtggatgttaaagctgctcgattcccaggatctcggctgccttttcctctatcttgagccctataaatgcccacgggacccccaccaccagcctcttgaagtggctccacagctcctgtccctggaacatcctgtcagtttggtcataaaccctgagccagatgaaatgagccaccgtgaacagacatctgccatgcccccaggtgggcttcggtggccctacccggtaccagttctttctgagaaactggagatgtcttgttagcataagtgtcttcattcccacctggagggtttgggagaggagcaaagcagttgaaaactagttaatgagctacaagagtcaaatagtcctctgaatggagcccccatcacaaaacagtgcccaggaggctggctcctcaagctacccatgcccagcgccctaaagcagcaccagatgctttggaattggggtgaaacacccacatggcagcctgctagcagcagtgactttgacttctggtcttaaagagtccctcacttcagccccaggagctattggtgggttttagcagttttgtctttaccgtttttagttctccttgattctttgttttcttcctttatcgtttttaggtttggtatgtgttgttttatttccatggttcctcaagtttcctttttaaacatttgcatttgctggacaattgcaattttttttaaaaaattcccctacccctgtttaaagctgaaaaatacatttggttcatgtgcattgtttacaaagcaaaaagaaaaaagaggaaaaaaaggcaaaaaatattgtgaaagaaaaaaaacaacttaatatattttggattaatatttggtatttcttttaaagtattttttgtgctgtgaacattttctgccaaagaccatgatgtgtgtctgtatgtttaagttatcgtaaatatttaaaatgtaaacatggctgttttgttatgccaccctgtaccaggattgctgccgcattccactgggtataacagtattttaattaaaaaaaaataattaaaa

SEQ ID NO: 107216 - DNA, 623 bp, Homo sapiens
  Payload ID: 1045
  Gene Symbol: AMOTL2
  Gene Name: angiomotin like 2
  ENST ID: ENST00000504234
  CDS Start-End: 171-623
agggctcgagagggagggaggcggacccgcgatgcttaaagacctctccgggcctcgggctaccctcaccggctcgccccaggcgtaccagcggccaccggtgctccaggtgctctggggccaggtgccaccggccattgtccaggcagctgtgtgcaagccaaagaagcatgaggacactggaagactcctcggggacagtcctgcaccgcctcatccaggagcagctgcgctacggcaacctgactgagacgcgcacgctgctagccatccagcagcaggccctgaggggtggggctggaactgggggtacagggagcccccaggcctccctggagatcctggccccagaggacagtcaggtgctgcagcaggccaccaggcaggagccccagggccaggagcaccagggcggtgagaaccacctggcagagaacaccctctaccggctatgcccacagcccagcaagggagaggagctgcccacctatgaggaggccaaagcccactcgcagtactatgcggcccagcaggcagggacccggccacatgcgggggaccgagatccccgtggggccccgggaggcagtcggaggcaggacgaggccctgcgggagctgagg

SEQ ID NO: 107217 - DNA, 2653 bp, Homo sapiens
  Payload ID: 1045
  Gene Symbol: AMOTL2
  Gene Name: angiomotin like 2
  Uniprot ID: Q9Y2J4
  ENST ID: ENST00000513145
  CDS Start-End: 166-2499
agcgtcggcgccacggccgagaacacatcttcgccgccgagctgagctgggccgagccggaggttgtggtgtctgactgcgctgggcaccctcgggccgcagcggtgctctggggccaggtgccaccggccattgtccaggcagctgtgtgcaagccaaagaagcatgaggacactggaagactcctcggggacagtcctgcaccgcctcatccaggagcagctgcgctacggcaacctgactgagacgcgcacgctgctagccatccagcagcaggccctgaggggtggggctggaactgggggtacagggagcccccaggcctccctggagatcctggccccagaggacagtcaggtgctgcagcaggccaccaggcaggagccccagggccaggagcaccagggcggtgagaaccacctggcagagaacaccctctaccggctatgcccacagcccagcaagggagaggagctgcccacctatgaggaggccaaagcccactcgcagtactatgcggcccagcaggcagggacccggccacatgcgggggaccgagatccccgtggggccccgggaggcagtcggaggcaggacgaggccctgcgggagctgaggcatgggcacgtgcgctcgttgagtgaacggctccttcagttgtccctggagaggaacggcgcccgggcccccagccacatgagctcctcccacagcttcccacagctggcccgcaaccagcagggccccccactgaggggcccccctgctgagggcccagagtcccgaggacccccacctcagtaccctcatgttgtactagctcatgagaccaccactgctgtcactgacccacggtaccgtgcccgcggcagcccgcacttccagcatgctgaagtcaggatcctgcaggcccaggtgcctcctgtgttcctccaacagcagcagcagtaccagtacctgcagcaatctcaggagcacccccctcccccacatccagctgctctcggccatggccccctgagctccctcagtccacctgctgtggaggggccagtgagtgcccaggcctcctcagccacctcgggcagtgcccacctggcccagatggaggccgtgctgagggagaatgccaggctgcagagagacaatgagcggctgcagagggagctggagagctctgcggagaaggctggccgcattgagaagctggaaagcgaaatccagcggctctctgaggcccatgagagcctgaccagagcctcctccaagcgtgaggccctggagaagaccatgcggaacaagatggacagtgaaatgaggaggctgcaagacttcaaccgggatcttagagagagattggaatctgcaaatcgccgcctggcaagcaagacacaggaggcccaggccggcagtcaggacatggtggccaagctgcttgctcagagctacgaacagcagcaggagcaagagaagctggagcgagagatggcactgctgcgcggcgccatcgaggaccagcggcggcgtgccgagctgctggagcaggctctgggcaatgcgcagggccgggcagctcgagccgaagaggagctgcgcaagaagcaggcctatgtggagaaagtggagcggctgcagcaggcgctcgggcagctgcaggcagcctgtgagaagcgggagcagctggagctgcgtctgcggactcgcctggagcaggaactcaaggccctgcgtgcacagcaggcaggtgccccaggtggtagcagtggcagtggtgggtctccagagctcagcgccctgcgactgtcagaacaactgcgagagaaggaggagcagatcctggcgctggaggccgacatgaccaagtgggagcagaagtatttggaggaacgtgccatgaggcagtttgccatggatgcggctgccacggctgctgctcagcgtgacaccactctcatccgacattccccccagccctcacccagcagcagcttcaatgagggtctgctcactggtggccacaggcatcaggagatggaaagcaggttaaaggtgctccatgcccagatcctggagaaggatgcagtgatcaaggtccttcagcagcgctccaggagagaccctggcaaggccatccagggctccctgcggcctgccaagtcggtgccatctgttttcgcggctgcggcagcaggaacccagggctggcaagggctctcttctagtgagcgacaaacagcagacgcccctgctcggctgactacagacagagcacccacagaggagccagtggtcacagctccccctgctgcccatgccaaacacgggagcagagatgggagcacccagactgagggccccccagacagcacctccacctgcctgccaccggagcctgacagccttctggggtgcagcagtagccagagagcagcctctctggactctgtagctacatccagagtccaggacttgtcagacatggtggagatactgatctgaaggaggtggtgcttcaggactctgagccattctctcccctcctctgccctgtgccactctcagccatttcagcagccccgtcaaccgctgctccgtccctttccccagccagacactcattcccattgaccatctggtcccaggagctcaggag

SEQ ID NO: 107218 - DNA, 845 bp, Homo sapiens
  Payload ID: 1045
  Gene Symbol: AMOTL2
  Gene Name: angiomotin like 2
  ENST ID: ENST00000510560
  CDS Start-End: 252-845
cgagagggagggaggcggacccgcgatgcttaaagacctctccgggcctcgggctaccctcaccggctcgccccaggcgtaccagcggccaccggtgctccaggcgagcaggagcccaggccaaggctggagacgcgcgctggcttagaaaggcggccttcagagagcgcagcgggcgagtgcagcagaggtgctctggggccaggtgccaccggccattgtccaggcagctgtgtgcaagccaaagaagcatgaggacactggaagactcctcggggacagtcctgcaccgcctcatccaggagcagctgcgctacggcaacctgactgagacgcgcacgctgctagccatccagcagcaggccctgaggggtggggctggaactgggggtacagggagcccccaggcctccctggagatcctggccccagaggacagtcaggtgctgcagcaggccaccaggcaggagccccagggccaggagcaccagggcggtgagaaccacctggcagagaacaccctctaccggctatgcccacagcccagcaagggagaggagctgcccacctatgaggaggccaaagcccactcgcagtactatgcggcccagcaggcagggacccggccacatgcgggggaccgagatccccgtggggccccgggaggcagtcggaggcaggacgaggccctgcgggagctgaggcatgggcacgtgcgctcgttgagtgaacggctccttcagttgtccctggagaggaacggcgcccgggcccccagccacatgagctcctcccacagcttcccacagctggcccgcaaccagcagggccccccactgaggggc

SEQ ID NO: 107219 - DNA, 527 bp, Homo sapiens
  Payload ID: 1045
  Gene Symbol: AMOTL2
  Gene Name: angiomotin like 2
  ENST ID: ENST00000505596
  CDS Start-End: 94-527
tgtgtagctggctgtacgggtggtggttcctggtgctctggggccaggtgccaccggccattgtccaggcagctgtgtgcaagccaaagaagcatgaggacactggaagactcctcggggacagtcctgcaccgcctcatccaggagcagctgcgctacggcaacctgactgagacgcgcacgctgctagccatccagcagcaggccctgaggggtggggctggaactgggggtacagggagcccccaggcctccctggagatcctggccccagaggacagtcaggtgctgcagcaggccaccaggcaggagccccagggccaggagcaccagggcggtgagaaccacctggcagagaacaccctctaccggctatgcccacagcccagcaagggagaggagctgcccacctatgaggaggccaaagcccactcgcagtactatgcggcccagcaggcagggacccggccacatgcgggggaccgagatccccgtggggccccgggaggcagtcggaggcaggacga

SEQ ID NO: 107220 - DNA, 713 bp, Homo sapiens
  Payload ID: 1045
  Gene Symbol: AMOTL2
  Gene Name: angiomotin like 2
  ENST ID: ENST00000515172
  CDS Start-End: 344-713
aagagggctcgagagggagggaggcggacccgcgatgcttaaagacctctccgggcctcgggctaccctcaccggctcgccccaggcgtaccagcggccaccggtgctccaggtccgcccgggctcgtggtggggcgggagccctggctggggtgccagaacctcctagcttggagactgtctttggttccttaggcgagcaggagcccaggccaaggctggagacgcgcgctggcttagaaaggcggccttcagagagcgcagcgggcgagtgcagcagaggtgctctggggccaggtgccaccggccattgtccaggcagctgtgtgcaagccaaagaagcatgaggacactggaagactcctcggggacagtcctgcaccgcctcatccaggagcagctgcgctacggcaacctgactgagacgcgcacgctgctagccatccagcagcaggccctgaggggtggggctggaactgggggtacagggagcccccaggcctccctggagatcctggccccagaggacagtcaggtgctgcagcaggccaccaggcaggagccccagggccaggagcaccagggcggtgagaaccacctggcagagaacaccctctaccggctatgcccacagcccagcaagggagaggagctgcccacctatgaggaggccaaagcccactcgcagtactatgcggcccagcaggcaggga

SEQ ID NO: 107221 - DNA, 4353 bp, Homo sapiens
  Payload ID: 1046
  Gene Symbol: ANGPT1
  Gene Name: angiopoietin 1
  Uniprot ID: Q15389
  ENST ID: ENST00000297450
  CDS Start-End: 498-1991
gccctaagccatcagcaatccttagtataggggcacactcatgcattcctgtcaagtcatcttgtgaaaggctgcctgcttccagcttggcttggatgtgcaaccttaataaaactcactgaggtctgggagaaaatagcagatctgcagcagatagggtagaggaaagggtctagaatatgtacacgcagctgactcaggcaggctccatgctgaacggtcacacagagaggaaacaataaatctcagctactatgcaataaatatctcaagttttaacgaagaaaaacatcattgcagtgaaataaaaaattttaaaattttagaacaaagctaacaaatggctagttttctatgattcttcttcaaacgctttctttgagggggaaagagtcaaacaaacaagcagttttacctgaaataaagaactagttttagaggtcagaagaaaggagcaagttttgcgagaggcacggaaggagtgtgctggcagtacaatgacagttttcctttcctttgctttcctcgctgccattctgactcacatagggtgcagcaatcagcgccgaagtccagaaaacagtgggagaagatataaccggattcaacatgggcaatgtgcctacactttcattcttccagaacacgatggcaactgtcgtgagagtacgacagaccagtacaacacaaacgctctgcagagagatgctccacacgtggaaccggatttctcttcccagaaacttcaacatctggaacatgtgatggaaaattatactcagtggctgcaaaaacttgagaattacattgtggaaaacatgaagtcggagatggcccagatacagcagaatgcagttcagaaccacacggctaccatgctggagataggaaccagcctcctctctcagactgcagagcagaccagaaagctgacagatgttgagacccaggtactaaatcaaacttctcgacttgagatacagctgctggagaattcattatccacctacaagctagagaagcaacttcttcaacagacaaatgaaatcttgaagatccatgaaaaaaacagtttattagaacataaaatcttagaaatggaaggaaaacacaaggaagagttggacaccttaaaggaagagaaagagaaccttcaaggcttggttactcgtcaaacatatataatccaggagctggaaaagcaattaaacagagctaccaccaacaacagtgtccttcagaagcagcaactggagctgatggacacagtccacaaccttgtcaatctttgcactaaagaagttttactaaagggaggaaaaagagaggaagagaaaccatttagagactgtgcagatgtatatcaagctggttttaataaaagtggaatctacactatttatattaataatatgccagaacccaaaaaggtgttttgcaatatggatgtcaatgggggaggttggactgtaatacaacatcgtgaagatggaagtctagatttccaaagaggctggaaggaatataaaatgggttttggaaatccctccggtgaatattggctggggaatgagtttatttttgccattaccagtcagaggcagtacatgctaagaattgagttaatggactgggaagggaaccgagcctattcacagtatgacagattccacataggaaatgaaaagcaaaactataggttgtatttaaaaggtcacactgggacagcaggaaaacagagcagcctgatcttacacggtgctgatttcagcactaaagatgctgataatgacaactgtatgtgcaaatgtgccctcatgttaacaggaggatggtggtttgatgcttgtggcccctccaatctaaatggaatgttctatactgcgggacaaaaccatggaaaactgaatgggataaagtggcactacttcaaagggcccagttactccttacgttccacaactatgatgattcgacctttagatttttgaaagcgcaatgtcagaagcgattatgaaagcaacaaagaaatccggagaagctgccaggtgagaaactgtttgaaaacttcagaagcaaacaatattgtctcccttccagcaataagtggtagttatgtgaagtcaccaaggttcttgaccgtgaatctggagccgtttgagttcacaagagtctctacttggggtgacagtgctcacgtggctcgactatagaaaactccactgactgtcgggctttaaaaagggaagaaactgctgagcttgctgtgcttcaaactactactggaccttattttggaactatggtagccagatgataaatatggttaatttcatgtaaaacagaaaaaaagagtgaaaaagagaatatacatgaagaatagaaacaagcctgccataatcctttggaaaagatgtattataccagtgaaaaggtgttatatctatgcaaacctactaacaaattatactgttgcacaattttgataaaaatttagaacagcattgtcctctgagttggttaaatgttaatggatttcagaagcctaattccagtatcatacttactagttgatttctgcttacccatcttcaaatgaaaattccatttttgtaagccataatgaactgtagtacatggacaataagtgtgtggtagaaacaaactccattactctgatttttgatacagttttcagaaaaagaaatgaacataatcaagtaaggatgtatgtggtgaaaacttaccacccccatactatggttttcatttactctaaaaactgattgaatgatatataaatatatttatagcctgagtaaagttaaaagaatgtaaaatatatcatcaagttcttaaaataatatacatgcatttaatatttcctttgatattatacaggaaagcaatattttggagtatgttaagttgaagtaaaagcaagtactctggagcagttcattttacagtatctacttgcatgtgtatacatacatgtaacttcattattttaaaaatatttttagaactccaatactcaccctgttatgtcttgctaatttaaattttgctaattaactgaaacatgcttaccagattcacactgttccagtgtctataaaagaaacactttgaagtctataaaaaataaaataattataaatatcattgtacatagcatgtttatatctgcaaaaaacctaatagctaattaatctggaatatgcaacattgtccttaattgatgcaaataacacaaatgctcaaagaaatctactatatcccttaatgaaatacatcattcttcatatatttctccttcagtccattcccttaggcaatttttaatttttaaaaattattatcaggggagaaaaattggcaaaactattatatgtaagggaaatatatacaaaaagaaaattaatcatagtcacctgactaagaaattctgactgctagttgccataaataactcaatggaaatattcctatgggataatgtattttaagtgaatttttggggtgcttgaagttactgcattattttatcaagaagtcttctctgcctgtaagtgtccaaggttatgacagtaaacagtttttattaaaacatgagtcactatgggatgagaaaattgaaataaagctactgggcctcctctcataaaagagacagttgttggcaaggtagcaataccagtttcaaacttggtgacttgatccactatgccttaatggtttcctccatttgagaaaataaagctattcacattgttaagaaaaatactttttaaagtttaccatcaagtcttttttatatttatgtgtctgtattctacccctttttgccttacaagtgatatttgcaggtattataccatttttctattcttggtggcttcttcatagcaggtaagcctctccttctaaaaacttctcaactgttttcatttaagggaaagaaaatgagtattttgtccttttgtgttcctacagacactttcttaaaccagtttttggataaagaatactatttccaaactcatattacaaaaacaaaataaaataataaaaaaagaaagcatgatatttactgttttgttgtctgggtttgagaaatgaaatattgtttccaattatttataataaatcagtataaaatgttttatgattgttatgtgtattatgtaatacgtacatgtttatggcaatttaacatgtgtattcttttaattgtttcagaataggataattaggtattcgaattttgtctttaaaattcatgtggtttctatgcaaagttcttcatatcatcacaacattatttgatttaaataaaattgaaagtaa

SEQ ID NO: 107222 - DNA, 4322 bp, Homo sapiens
  Payload ID: 1046
  Gene Symbol: ANGPT1
  Gene Name: angiopoietin 1
  Uniprot ID: Q15389
  ENST ID: ENST00000517746
  CDS Start-End: 453-1949
ttcctgtcaagtcatcttgtgaaaggctgcctgcttccagcttggcttggatgtgcaaccttaataaaactcactgaggtctgggagaaaatagcagatctgcagcagatagggtagaggaaagggtctagaatatgtacacgcagctgactcaggcaggctccatgctgaacggtcacacagagaggaaacaataaatctcagctactatgcaataaatatctcaagttttaacgaagaaaaacatcattgcagtgaaataaaaaattttaaaattttagaacaaagctaacaaatggctagttttctatgattcttcttcaaacgctttctttgagggggaaagagtcaaacaaacaagcagttttacctgaaataaagaactagttttagaggtcagaagaaaggagcaagttttgcgagaggcacggaaggagtgtgctggcagtacaatgacagttttcctttcctttgctttcctcgctgccattctgactcacatagggtgcagcaatcagcgccgaagtccagaaaacagtgggagaagatataaccggattcaacatgggcaatgtgcctacactttcattcttccagaacacgatggcaactgtcgtgagagtacgacagaccagtacaacacaaacgctctgcagagagatgctccacacgtggaaccggatttctcttcccagaaacttcaacatctggaacatgtgatggaaaattatactcagtggctgcaaaaacttgagaattacattgtggaaaacatgaagtcggagatggcccagatacagcagaatgcagttcagaaccacacggctaccatgctggagataggaaccagcctcctctctcagactgcagagcagaccagaaagctgacagatgttgagacccaggtactaaatcaaacttctcgacttgagatacagctgctggagaattcattatccacctacaagctagagaagcaacttcttcaacagacaaatgaaatcttgaagatccatgaaaaaaacagtttattagaacataaaatcttagaaatggaaggaaaacacaaggaagagttggacaccttaaaggaagagaaagagaaccttcaaggcttggttactcgtcaaacatatataatccaggagctggaaaagcaattaaacagagctaccaccaacaacagtgtccttcagaagcagcaactggagctgatggacacagtccacaaccttgtcaatctttgcactaaagaaggtgttttactaaagggaggaaaaagagaggaagagaaaccatttagagactgtgcagatgtatatcaagctggttttaataaaagtggaatctacactatttatattaataatatgccagaacccaaaaaggtgttttgcaatatggatgtcaatgggggaggttggactgtaatacaacatcgtgaagatggaagtctagatttccaaagaggctggaaggaatataaaatgggttttggaaatccctccggtgaatattggctggggaatgagtttatttttgccattaccagtcagaggcagtacatgctaagaattgagttaatggactgggaagggaaccgagcctattcacagtatgacagattccacataggaaatgaaaagcaaaactataggttgtatttaaaaggtcacactgggacagcaggaaaacagagcagcctgatcttacacggtgctgatttcagcactaaagatgctgataatgacaactgtatgtgcaaatgtgccctcatgttaacaggaggatggtggtttgatgcttgtggcccctccaatctaaatggaatgttctatactgcgggacaaaaccatggaaaactgaatgggataaagtggcactacttcaaagggcccagttactccttacgttccacaactatgatgattcgacctttagatttttgaaagcgcaatgtcagaagcgattatgaaagcaacaaagaaatccggagaagctgccaggtgagaaactgtttgaaaacttcagaagcaaacaatattgtctcccttccagcaataagtggtagttatgtgaagtcaccaaggttcttgaccgtgaatctggagccgtttgagttcacaagagtctctacttggggtgacagtgctcacgtggctcgactatagaaaactccactgactgtcgggctttaaaaagggaagaaactgctgagcttgctgtgcttcaaactactactggaccttattttggaactatggtagccagatgataaatatggttaatttcatgtaaaacagaaaaaaagagtgaaaaagagaatatacatgaagaatagaaacaagcctgccataatcctttggaaaagatgtattataccagtgaaaaggtgttatatctatgcaaacctactaacaaattatactgttgcacaattttgataaaaatttagaacagcattgtcctctgagttggttaaatgttaatggatttcagaagcctaattccagtatcatacttactagttgatttctgcttacccatcttcaaatgaaaattccatttttgtaagccataatgaactgtagtacatggacaataagtgtgtggtagaaacaaactccattactctgatttttgatacagttttcagaaaaagaaatgaacataatcaagtaaggatgtatgtggtgaaaacttaccacccccatactatggttttcatttactctaaaaactgattgaatgatatataaatatatttatagcctgagtaaagttaaaagaatgtaaaatatatcatcaagttcttaaaataatatacatgcatttaatatttcctttgatattatacaggaaagcaatattttggagtatgttaagttgaagtaaaagcaagtactctggagcagttcattttacagtatctacttgcatgtgtatacatacatgtaacttcattattttaaaaatatttttagaactccaatactcaccctgttatgtcttgctaatttaaattttgctaattaactgaaacatgcttaccagattcacactgttccagtgtctataaaagaaacactttgaagtctataaaaaataaaataattataaatatcattgtacatagcatgtttatatctgcaaaaaacctaatagctaattaatctggaatatgcaacattgtccttaattgatgcaaataacacaaatgctcaaagaaatctactatatcccttaatgaaatacatcattcttcatatatttctccttcagtccattcccttaggcaatttttaatttttaaaaattattatcaggggagaaaaattggcaaaactattatatgtaagggaaatatatacaaaaagaaaattaatcatagtcacctgactaagaaattctgactgctagttgccataaataactcaatggaaatattcctatgggataatgtattttaagtgaatttttggggtgcttgaagttactgcattattttatcaagaagtcttctctgcctgtaagtgtccaaggttatgacagtaaacagtttttattaaaacatgagtcactatgggatgagaaaattgaaataaagctactgggcctcctctcataaaagagacagttgttggcaaggtagcaataccagtttcaaacttggtgacttgatccactatgccttaatggtttcctccatttgagaaaataaagctattcacattgttaagaaaaatactttttaaagtttaccatcaagtcttttttatatttatgtgtctgtattctacccctttttgccttacaagtgatatttgcaggtattataccatttttctattcttggtggcttcttcatagcaggtaagcctctccttctaaaaacttctcaactgttttcatttaagggaaagaaaatgagtattttgtccttttgtgttcctacagacactttcttaaaccagtttttggataaagaatactatttccaaactcatattacaaaaacaaaataaaataataaaaaaagaaagcatgatatttactgttttgttgtctgggtttgagaaatgaaatattgtttccaattatttataataaatcagtataaaatgttttatgattgttatgtgtattatgtaatacgtacatgtttatggcaatttaacatgtgtattcttttaattgtttcagaataggataattaggtattcgaattttgtctttaaaattcatgtggtttctatgcaaagttcttcatatcatcacaacattatttgatttaaataaaattgaaagtaatatttgtgcaa

SEQ ID NO: 107223 - DNA, 548 bp, Homo sapiens
  Payload ID: 1046
  Gene Symbol: ANGPT1
  Gene Name: angiopoietin 1
  ENST ID: ENST00000520033
  CDS Start-End: 458-548
tattacttctattttgattccaagtagttgccataggaagaagcaacaccctgcagaaactgaggctatcagtgtatgtaggtgaaattaatttatccatttatttggcaaaataattaatcaaagcatagtgattattatgcagctcatggcatcgctatcaggaaaggttttgaggcagaatagatgtgttatcaactctaaatgaagctatatgataattatgttaatccatcaccttccatgaagggaaacctccttcctcaacttttctggtcttgcaactgaacaggatgagaagcaaggcatgcaagggggcaaatgatttgtgggtcaccataaatactggaactgttatggcactgctttcttgatgtgatggatttaattcaaagaaatcaactttccataatcacttgtcgattaaaatgagcttgagaattacattgtggaaaacatgaagtcggagatggcccagatacagcagaatgcagttcagaaccacacggctaccatgctggagataggaaccagcctcctctctcaga

SEQ ID NO: 107224 - DNA, 1523 bp, Homo sapiens
  Payload ID: 1046
  Gene Symbol: ANGPT1
  Gene Name: angiopoietin 1
  ENST ID: ENST00000520052
  CDS Start-End: 287-1180
cggctaagtttttgtatttttagtagagacggggtttcaccatgtttgccaggatggtctcgatctcttgacctcgtgatccacccgccttggcctcccaaagtgctgggattacaggcgtgagccactgcgcccggcggtactaaatcaaacttctcgacttgagatacagctgctggagaattcattatccacctacaagctagagaagcaacttcttcaacagacaaatgaaatcttgaagatccatgaaaaaaacagtttattagaacataaaatcttagaaatggaaggaaaacacaaggaagagttggacaccttaaaggaagagaaagagaaccttcaaggcttggttactcgtcaaacatatataatccaggagctggaaaagcaattaaacagagctaccaccaacaacagtgtccttcagaagcagcaactggagctgatggacacagtccacaaccttgtcaatctttgcactaaagaagttttactaaagggaggaaaaagagaggaagagaaaccatttagagactgtgcagatgtatatcaagctggttttaataaaagtggaatctacactatttatattaataatatgccagaacccaaaaaggtgttttgcaatatggatgtcaatgggggaggttggactgtaatacaacatcgtgaagatggaagtctagatttccaaagaggctggaaggaatataaaatgggttttggaaatccctccggtgaatattggctggggaatgagtttatttttgccattaccagtcagaggcagtacatgctaagaattgagttaatggactgggaagggaaccgagcctattcacagtatgacagattccacataggaaatgaaaagcaaaactataggttgtatttaaaaggtcacactgggacagcaggaaaacagagcagcctgatcttacacggtgctgatttcagcactaaagatgctgataatgacaactgtatgtgcaaatgtgccctcatgttaacaggaggatggtggtttgatgcttgtggcccctccaatctaaatggaatgttctatactgcgggacaaaaccatggaaaactgaatgggataaagtggcactacttcaaagggcccagttactccttacgttccacaactatgatgattcgacctttagatttttgaaagcgcaatgtcagaagcgattatgaaagcaacaaagaaatccggagaagctgccaggtgagaaactgtttgaaaacttcagaagcaaacaatattgtctcccttccagcaataagtggtagttatgtgaagtcaccaaggttcttgaccgtgaatctggagccgtttgagttcacaagagtctctacttggggtgacagtgctcacgtggctcgactatagaaaactccactgactgtcgggctttaaaaagggaagaaactgctgagcttgctgtgcttcaaactactactggaccttattttggaactatggtagccagatgataaatatggttaatttc

SEQ ID NO: 107225 - DNA, 1526 bp, Homo sapiens
  Payload ID: 1046
  Gene Symbol: ANGPT1
  Gene Name: angiopoietin 1
  ENST ID: ENST00000520734
  CDS Start-End: 287-1183
cggctaagtttttgtatttttagtagagacggggtttcaccatgtttgccaggatggtctcgatctcttgacctcgtgatccacccgccttggcctcccaaagtgctgggattacaggcgtgagccactgcgcccggcggtactaaatcaaacttctcgacttgagatacagctgctggagaattcattatccacctacaagctagagaagcaacttcttcaacagacaaatgaaatcttgaagatccatgaaaaaaacagtttattagaacataaaatcttagaaatggaaggaaaacacaaggaagagttggacaccttaaaggaagagaaagagaaccttcaaggcttggttactcgtcaaacatatataatccaggagctggaaaagcaattaaacagagctaccaccaacaacagtgtccttcagaagcagcaactggagctgatggacacagtccacaaccttgtcaatctttgcactaaagaaggtgttttactaaagggaggaaaaagagaggaagagaaaccatttagagactgtgcagatgtatatcaagctggttttaataaaagtggaatctacactatttatattaataatatgccagaacccaaaaaggtgttttgcaatatggatgtcaatgggggaggttggactgtaatacaacatcgtgaagatggaagtctagatttccaaagaggctggaaggaatataaaatgggttttggaaatccctccggtgaatattggctggggaatgagtttatttttgccattaccagtcagaggcagtacatgctaagaattgagttaatggactgggaagggaaccgagcctattcacagtatgacagattccacataggaaatgaaaagcaaaactataggttgtatttaaaaggtcacactgggacagcaggaaaacagagcagcctgatcttacacggtgctgatttcagcactaaagatgctgataatgacaactgtatgtgcaaatgtgccctcatgttaacaggaggatggtggtttgatgcttgtggcccctccaatctaaatggaatgttctatactgcgggacaaaaccatggaaaactgaatgggataaagtggcactacttcaaagggcccagttactccttacgttccacaactatgatgattcgacctttagatttttgaaagcgcaatgtcagaagcgattatgaaagcaacaaagaaatccggagaagctgccaggtgagaaactgtttgaaaacttcagaagcaaacaatattgtctcccttccagcaataagtggtagttatgtgaagtcaccaaggttcttgaccgtgaatctggagccgtttgagttcacaagagtctctacttggggtgacagtgctcacgtggctcgactatagaaaactccactgactgtcgggctttaaaaagggaagaaactgctgagcttgctgtgcttcaaactactactggaccttattttggaactatggtagccagatgataaatatggttaatttc

SEQ ID NO: 107226 - DNA, 5416 bp, Homo sapiens
  Payload ID: 1047
  Gene Symbol: ANGPT2
  Gene Name: angiopoietin 2
  Uniprot ID: O15123
  ENST ID: ENST00000325203
  CDS Start-End: 476-1966
ctggttggagggcaggcattctgctctgatttttcctgttgcctggctagtgaccccctacaggaagataacggctaagccaggagggcggagcagcccactacacatgtctggctgctcttatcaacttatcatataaggaaaggaaagtgattgattcggatactgacactgtaggatctggggagagaggaacaaaggaccgtgaaagctgctctgtaaaagctgacacagccctcccaagtgagcaggactgttcttcccactgcaatctgacagtttactgcatgcctggagagaacacagcagtaaaaaccaggtttgctactggaaaaagaggaaagagaagactttcattgacggacccagccatggcagcgtagcagccctgcgttttagacggcagcagctcgggactctggacgtgtgtttgccctcaagtttgctaagctgctggtttattactgaagaaagaatgtggcagattgttttctttactctgagctgtgatcttgtcttggccgcagcctataacaactttcggaagagcatggacagcataggaaagaagcaatatcaggtccagcatgggtcctgcagctacactttcctcctgccagagatggacaactgccgctcttcctccagcccctacgtgtccaatgctgtgcagagggacgcgccgctcgaatacgatgactcggtgcagaggctgcaagtgctggagaacatcatggaaaacaacactcagtggctaatgaagcttgagaattatatccaggacaacatgaagaaagaaatggtagagatacagcagaatgcagtacagaaccagacggctgtgatgatagaaatagggacaaacctgttgaaccaaacagcggagcaaacgcggaagttaactgatgtggaagcccaagtattaaatcagaccacgagacttgaacttcagctcttggaacactccctctcgacaaacaaattggaaaaacagattttggaccagaccagtgaaataaacaaattgcaagataagaacagtttcctagaaaagaaggtgctagctatggaagacaagcacatcatccaactacagtcaataaaagaagagaaagatcagctacaggtgttagtatccaagcaaaattccatcattgaagaactagaaaaaaaaatagtgactgccacggtgaataattcagttcttcagaagcagcaacatgatctcatggagacagttaataacttactgactatgatgtccacatcaaactcagctaaggaccccactgttgctaaagaagaacaaatcagcttcagagactgtgctgaagtattcaaatcaggacacaccacgaatggcatctacacgttaacattccctaattctacagaagagatcaaggcctactgtgacatggaagctggaggaggcgggtggacaattattcagcgacgtgaggatggcagcgttgattttcagaggacttggaaagaatataaagtgggatttggtaacccttcaggagaatattggctgggaaatgagtttgtttcgcaactgactaatcagcaacgctatgtgcttaaaatacaccttaaagactgggaagggaatgaggcttactcattgtatgaacatttctatctctcaagtgaagaactcaattataggattcaccttaaaggacttacagggacagccggcaaaataagcagcatcagccaaccaggaaatgattttagcacaaaggatggagacaacgacaaatgtatttgcaaatgttcacaaatgctaacaggaggctggtggtttgatgcatgtggtccttccaacttgaacggaatgtactatccacagaggcagaacacaaataagttcaacggcattaaatggtactactggaaaggctcaggctattcgctcaaggccacaaccatgatgatccgaccagcagatttctaaacatcccagtccacctgaggaactgtctcgaactattttcaaagacttaagcccagtgcactgaaagtcacggctgcgcactgtgtcctcttccaccacagagggcgtgtgctcggtgctgacgggacccacatgctccagattagagcctgtaaactttatcacttaaacttgcatcacttaacggaccaaagcaagaccctaaacatccataattgtgattagacagaacacctatgcaaagatgaacccgaggctgagaatcagactgacagtttacagacgctgctgtcacaaccaagaatgttatgtgcaagtttatcagtaaataactggaaaacagaacacttatgttatacaatacagatcatcttggaactgcattcttctgagcactgtttatacactgtgtaaatacccatatgtcctgaattcaccatcactatcacaattaaaaggaagaaaaaaactctctaagccataaaaagacatattcagggatattctgagaaggggttactagaagtttaatatttggaaaaacagttagtgcatttttactccatctcttaggtgctttaaatttttatttcaaaaacagcgtatttacatttatgttgacagcttagttataagttaatgctcaaatacgtatttcaaatttatatggtagaaacttccagaatctctgaaattatcaacagaaacgtgccattttagtttatatgcagaccgtactatttttttctgcctgattgttaaatatgaaggtatttttagtaattaaatataacttattaggggatatgcctatgtttaacttttatgataatatttacaattttataatttgtttccaaaagacctaattgtgccttgtgataaggaaacttcttacttttaatgatgaggaaaattatacatttcattctatgacaaagaaactttactatcttctcactattctaaaacagaggtctgttttctttcctagtaagatatatttttatagaactagactacaatttaatttctggttgagaaaagccttctatttaagaaatttacaaagctatatgtctcaagattcacccttaaatttacttaaggaaaaaaataattgacactagtaagtttttttatgtcaatcagcaaactgaaaaaaaaaaaagggtttcaaagtgcaaaaacaaaatctgatgttcataatatatttaaatatttaccaaaaatttgagaacacagggctgggcgcagtggctcacacctataatcccagtacattggtaggcaaggtgggcagatcacctgaggtcaggagttcaagaccagcctggacaacatggtgaaaccctgtctctactaaataatacaaaaattagccaggcgtgctggcgggcacctgtaatcccagctactcgggaggctgaggcagggagaattgcttgcaccagggaggtagaggttgcagtgagccaagatcgcaccactgcactccagccggggcaacagagcaagactccatctcaaaaaaaaaaaaaaaaaaagaaagaaaagaaaatttgagaacacagctttatactcgggactacaaaaccataaactcctggagttttaactccttttgaaattttcatagtacaattaatactaatgaacatttgtgtaaagctttataatttaaaggcaatttctcatatattcttttctgaatcatttgcaaggaagttcagagtccagtctgtaactagcatctactatatgtctgtcttcaccttacagtgttctaccattattttttctttattccatttcaaaatctaatttattttaccccaacttctccccaccacttgacgtagttttagaacacacaggtgttgctacatatttggagtcaatgatggactctggcaaagtcaaggctctgttttatttccaccaaggtgcacttttccaacaactatttaactagttaagaacctccctatcttagaactgtatctactttatatttaagaaggttttatgaattcaacaacggtatcatggccttgtatcaagttgaaaaacaactgaaaataagaaaatttcacagcctcgaaagacaacaacaagtttctaggatatctcaatgacaagagtgatggatacttaggtagggaaacgctaatgcaggaaaaactggcaacaacacaatttatatcaattctctttgtaggcaggtgataaaaaattcaaggacaaatctcattatgtcattgtgcatcatatataatctcttatgagcgagaatggggggaatttgtgtttttactttacacttcaattccttacacggtatttcaaacaaacagttttgctgagaggagcttttgtctctccttaagaaaatgtttataaagctgaaaggaaatcaaacagtaatcttaaaaatgaaaacaaaacaacccaacaacctagataactacagtgatcagggagcacagttcaactccttgttatgttttagtcatatggcctactcaaacagctaaataacaacaccagtggcagataaaaatcaccatttatctttcagctattaatcttttgaatgaataaactgtgacaaacaaattaacatttttgaacatgaaaggcaacttctgcacaatcctgtatccaagcaaactttaaattatccacttaattattacttaatcttaaaaaaaattagaacccagaacttttcaatgaagcatttgaaagttgaagtggaatttaggaaagccataaaaatataaatactgttatcacagcaccagcaagccataatctttatacctatcagttctatttctattaacagtaaaaacattaagcaagatataagactacctgcccaagaattcagtcttttttcatttttgtttttctcagttctgaggatgttaatcgtcaaattttctttggactgcattcctcactactttttgcacaatggtctcacgttctcacatttgttctcgcgaataaattgataaaaggtgttaagttctgtgaatgtctttttaattatgggcataattgtgcttgactggataaaaacttaagtccacccttatgtttataataatttcttgagaacagcaaactgcatttaccatcgtaaaacaacatctgacttacgggagctgcagggaagtggtgagacagttcgaacggctcctcagaaatccagtgacccaattctaaagaccatagcacctgcaagtgacacaacaagcagatttattatacatttattagccttagcaggcaataaaccaagaatcactttgaagacacagcaaaaagtgatacactccgcagatctgaaatagatgtgttctcagacaacaaagtcccttcagaatcttcatgttgcataaatgttatgaatattaataaaaagttgattgagaaaaa

SEQ ID NO: 107227 - DNA, 1466 bp, Homo sapiens
  Payload ID: 1047
  Gene Symbol: ANGPT2
  Gene Name: angiopoietin 2
  Uniprot ID: O15123
  ENST ID: ENST00000338312
  CDS Start-End: 111-1445
ccagccatggcagcgtagcagccctgcgttttagacggcagcagctcgggactctggacgtgtgtttgccctcaagtttgctaagctgctggtttattactgaagaaagaatgtggcagattgttttctttactctgagctgtgatcttgtcttggccgcagcctataacaactttcggaagagcatggacagcataggaaagaagcaatatcaggtccagcatgggtcctgcagctacactttcctcctgccagagatggacaactgccgctcttcctccagcccctacgtgtccaatgctgtgcagagggacgcgccgctcgaatacgatgactcggtgcagaggctgcaagtgctggagaacatcatggaaaacaacactcagtggctaatgaaggtattaaatcagaccacgagacttgaacttcagctcttggaacactccctctcgacaaacaaattggaaaaacagattttggaccagaccagtgaaataaacaaattgcaagataagaacagtttcctagaaaagaaggtgctagctatggaagacaagcacatcatccaactacagtcaataaaagaagagaaagatcagctacaggtgttagtatccaagcaaaattccatcattgaagaactagaaaaaaaaatagtgactgccacggtgaataattcagttcttcagaagcagcaacatgatctcatggagacagttaataacttactgactatgatgtccacatcaaactcagctaaggaccccactgttgctaaagaagaacaaatcagcttcagagactgtgctgaagtattcaaatcaggacacaccacgaatggcatctacacgttaacattccctaattctacagaagagatcaaggcctactgtgacatggaagctggaggaggcgggtggacaattattcagcgacgtgaggatggcagcgttgattttcagaggacttggaaagaatataaagtgggatttggtaacccttcaggagaatattggctgggaaatgagtttgtttcgcaactgactaatcagcaacgctatgtgcttaaaatacaccttaaagactgggaagggaatgaggcttactcattgtatgaacatttctatctctcaagtgaagaactcaattataggattcaccttaaaggacttacagggacagccggcaaaataagcagcatcagccaaccaggaaatgattttagcacaaaggatggagacaacgacaaatgtatttgcaaatgttcacaaatgctaacaggaggctggtggtttgatgcatgtggtccttccaacttgaacggaatgtactatccacagaggcagaacacaaataagttcaacggcattaaatggtactactggaaaggctcaggctattcgctcaaggccacaaccatgatgatccgaccagcagatttctaaacatcccagtccacctgagga

SEQ ID NO: 107228 - DNA, 2997 bp, Homo sapiens
  Payload ID: 1047
  Gene Symbol: ANGPT2
  Gene Name: angiopoietin 2
  ENST ID: ENST00000523120
  CDS Start-End: 312-1691
actgacactgtaggatctggggagagaggaacaaaggaccgtgaaagctgctctgtaaaagctgacacagccctcccaagtgagcaggactgttcttcccactgcaatctgacagtttactgcatgcctggagagaacacagcagtaaaaaccaggtttgctactggaaaaagaggaaagagaagactttcattgacggacccagccatggcagcgtagcagccctgcgttttagacggcagcagctcgggactctggacgtgtgtttgccctcaagtttgctaagctgctggtttattactgaagaaagaatgtggcagattgttttctttactctgagctgtgatcttgtcttggccgcagcctataacaactttcggaagagcatggacagcataggaaagaagcaatatcaggtccagcatgggtcctgcagctacactttcctcctgccagagatggacaactgccgctcttcctccagcccctacgtgtccaatgctgtgcagagggacgcgccgctcgaatacgatgactcggtgcagaggctgcaagtgctggagaacatcatggaaaacaacactcagtggctaatgaagcttgagaattatatccaggacaacatgaagaaagaaatggtagagatacagcagaatgcagtacagaaccagacggctgtgatgatagaaatagggacaaacctgttgaaccaaacagcggagcaaacgcggaagttaactgatgtggaagcccaagtattaaatcagaccacgagacttgaacttcagctcttggaacactccctctcgacaaacaaattggaaaaacagattttggaccagaccagtgaaataaacaaattgcaagataagaacagtttcctagaaaagaaggtgctagctatggaagacaagcacatcatccaactacagtcaataaaagaagagaaagatcagctacaggtgttagtatccaagcaaaattccatcattgaagaactagaaaaaaaaatagtgactgccacggtgaataattcagttcttcagaagcagcaacatgatctcatggagacagttaataacttactgactatgatgtccacatcaaactctaaggaccccactgttgctaaagaagaacaaatcagcttcagagactgtgctgaagtattcaaatcaggacacaccacgaatggcatctacacgttaacattccctaattctacagaagagatcaaggcctactgtgacatggaagctggaggaggcgggtggacaattattcagcgacgtgaggatggcagcgttgattttcagaggacttggaaagaatataaagtgggatttggtaacccttcaggagaatattggctgggaaatgagtttgtttcgcaactgactaatcagcaacgctatgtgcttaaaatacaccttaaagactgggaagggaatgaggcttactcattgtatgaacatttctatctctcaagtgaagaactcaattataggattcaccttaaaggacttacagggacagccggcaaaataagcagcatcagccaaccaggaaatgattttagcacaaaggatggagacaacgacaaatgtatttgcaaatgttcacaaatgctaacaggaggtagggatgactttctgtcttcctatttgtattggcaaggaatgatttcatagagggaaaggctggcaatttggactacaaattgtgatttgtaacgatgtccacaatttcatacgtagacacactagcttgatataggtaaatgtgtttttcactttttttagactaagttttaagtgagaatatgatatggagctagacttgtcagcaagccaactgtgtctcctcaggacctagccctggcaaggagaggggatatttgattcttagcaagctctcctgcgtttgtgcttgctggatactagagagatggtttaattacattttgctttatgtaaaaagttaaaaattccaagtagcaaccacaacagtaatatagattatagaaatatttccaactaataatttaatgttcaaagaaggaatttccagctgtcatttattatttatttatttacagacacagtctccagttgtttatttatttattttgagacagagtcttactttgttgtccagaagggagtgtgatcgcagctcactgcaacccctgcctcccaggctcaagcgattctcctgcctcagcctccccagtgctgggattataggcgcccaccagtgcacccggctaattttgtatttttagtagagggagggtttcaccatgtttgccaggctggtctcgaactgctgacctcaagtgatctgcccgccgcagcctccagaagtgttgagattacaggtgtgagccaccacacccggccccagctgtctttttaaaaaagattccattaatatatagcaacacctataaacacaaatgagttaatccaccttttttagtaaatcaaattaaaatgagtcatcttctactttgagacctttcttgtattgtaggtttggtattacactgccataaaacagacaatgaaaaccacactcataagccaaaaaccattgtagtagtcacttaaaacagatgggttggtattcagaaacatttgagagttcaaacataggaataaagttttagaaaatgttatttttctggccgggcccggtggctcacgcctgtaatgccagcactttgggaggccaaggagggcggatcacctgaagttaggagttcaagaccagcctggccaacatgttgaaaccccatctctactaaaaatacaaaaattacctgggcatggtggctggcacctgtaatcccagctactcctactcaggaggctcaggcaggagaatggcttgaacctgggaggcagaggttgcagtaacccaagatcgtgccactgcactccagcctgggggacagagcaagaattcactcaaaaaaaaaaaaaaaaaaaaaaa

SEQ ID NO: 107229 - DNA, 2602 bp, Homo sapiens
  Payload ID: 1047
  Gene Symbol: ANGPT2
  Gene Name: angiopoietin 2
  Uniprot ID: O15123
  ENST ID: ENST00000629816
  CDS Start-End: 312-1799
actgacactgtaggatctggggagagaggaacaaaggaccgtgaaagctgctctgtaaaagctgacacagccctcccaagtgagcaggactgttcttcccactgcaatctgacagtttactgcatgcctggagagaacacagcagtaaaaaccaggtttgctactggaaaaagaggaaagagaagactttcattgacggacccagccatggcagcgtagcagccctgcgttttagacggcagcagctcgggactctggacgtgtgtttgccctcaagtttgctaagctgctggtttattactgaagaaagaatgtggcagattgttttctttactctgagctgtgatcttgtcttggccgcagcctataacaactttcggaagagcatggacagcataggaaagaagcaatatcaggtccagcatgggtcctgcagctacactttcctcctgccagagatggacaactgccgctcttcctccagcccctacgtgtccaatgctgtgcagagggacgcgccgctcgaatacgatgactcggtgcagaggctgcaagtgctggagaacatcatggaaaacaacactcagtggctaatgaagcttgagaattatatccaggacaacatgaagaaagaaatggtagagatacagcagaatgcagtacagaaccagacggctgtgatgatagaaatagggacaaacctgttgaaccaaacagcggagcaaacgcggaagttaactgatgtggaagcccaagtattaaatcagaccacgagacttgaacttcagctcttggaacactccctctcgacaaacaaattggaaaaacagattttggaccagaccagtgaaataaacaaattgcaagataagaacagtttcctagaaaagaaggtgctagctatggaagacaagcacatcatccaactacagtcaataaaagaagagaaagatcagctacaggtgttagtatccaagcaaaattccatcattgaagaactagaaaaaaaaatagtgactgccacggtgaataattcagttcttcagaagcagcaacatgatctcatggagacagttaataacttactgactatgatgtccacatcaaactctaaggaccccactgttgctaaagaagaacaaatcagcttcagagactgtgctgaagtattcaaatcaggacacaccacgaatggcatctacacgttaacattccctaattctacagaagagatcaaggcctactgtgacatggaagctggaggaggcgggtggacaattattcagcgacgtgaggatggcagcgttgattttcagaggacttggaaagaatataaagtgggatttggtaacccttcaggagaatattggctgggaaatgagtttgtttcgcaactgactaatcagcaacgctatgtgcttaaaatacaccttaaagactgggaagggaatgaggcttactcattgtatgaacatttctatctctcaagtgaagaactcaattataggattcaccttaaaggacttacagggacagccggcaaaataagcagcatcagccaaccaggaaatgattttagcacaaaggatggagacaacgacaaatgtatttgcaaatgttcacaaatgctaacaggaggctggtggtttgatgcatgtggtccttccaacttgaacggaatgtactatccacagaggcagaacacaaataagttcaacggcattaaatggtactactggaaaggctcaggctattcgctcaaggccacaaccatgatgatccgaccagcagatttctaaacatcccagtccacctgaggaactgtctcgaactattttcaaagacttaagcccagtgcactgaaagtcacggctgcgcactgtgtcctcttccaccacagagggcgtgtgctcggtgctgacgggacccacatgctccagattagagcctgtaaactttatcacttaaacttgcatcacttaacggaccaaagcaagaccctaaacatccataattgtgattagacagaacacctatgcaaagatgaacccgaggctgagaatcagactgacagtttacagacgctgctgtcacaaccaagaatgttatgtgcaagtttatcagtaaataactggaaaacagaacacttatgttatacaatacagatcatcttggaactgcattcttctgagcactgtttatacactgtgtaaatacccatatgtcctgaattcaccatcactatcacaattaaaaggaagaaaaaaactctctaagccataaaaagacatattcagggatattctgagaaggggttactagaagtttaatatttggaaaaacagttagtgcatttttactccatctcttaggtgctttaaatttttatttcaaaaacagcgtatttacatttatgttgacagcttagttataagttaatgctcaaatacgtatttcaaatttatatggtagaaacttccagaatctctgaaattatcaacagaaacgtgccattttagtttatatgcagaccgtactatttttttctgcctgattgttaaatatgaaggtatttttagtaattaaatataacttattaggg

SEQ ID NO: 107230 - DNA, 4676 bp, Homo sapiens
  Payload ID: 1048
  Gene Symbol: ANGPT4
  Gene Name: angiopoietin 4
  Uniprot ID: Q9Y264
  ENST ID: ENST00000381922
  CDS Start-End: 104-1615
tgcagctgcaggcaagcctggccactgttggctgcagcaggacatcccaggcacagcccctagggctctgagcagacatccctcgccattgacacatcttcagatgctctcccagctagccatgctgcagggcagcctcctccttgtggttgccaccatgtctgtggctcaacagacaaggcaggaggcggataggggctgcgagacacttgtagtccagcacggccactgtagctacaccttcttgctgcccaagtctgagccctgccctccggggcctgaggtctccagggactccaacaccctccagagagaatcactggccaacccactgcacctggggaagttgcccacccagcaggtgaaacagctggagcaggcactgcagaacaacacgcagtggctgaagaagctagagagggccatcaagacgatcttgaggtcgaagctggagcaggtccagcagcaaatggcccagaatcagacggcccccatgctagagctgggcaccagcctcctgaaccagaccactgcccagatccgcaagctgaccgacatggaggctcagctcctgaaccagacatcaagaatggatgcccagatgccagagacctttctgtccaccaacaagctggagaaccagctgctgctacagaggcagaagctccagcagcttcagggccaaaacagcgcgctcgagaagcggttgcaggccctggagaccaagcagcaggaggagctggccagcatcctcagcaagaaggcgaagctgctgaacacgctgagccgccagagcgccgccctcaccaacatcgagcgcggcctgcgcggtgtcaggcacaactccagcctcctgcaggaccagcagcacagcctgcgccagctgctggtgttgttgcggcacctggtgcaagaaagggctaacgcctcggccccggccttcataatggcaggtgagcaggtgttccaggactgtgcagagatccagcgctctggggccagtgccagtggtgtctacaccatccaggtgtccaatgcaacgaagcccaggaaggtgttctgtgacctgcagagcagtggaggcaggtggaccctcatccagcgccgtgagaatggcaccgtgaattttcagcggaactggaaggattacaaacagggcttcggagacccagctggggagcactggctgggcaatgaagtggtgcaccagctcaccagaagggcagcctactctctgcgtgtggagctgcaagactgggaaggccacgaggcctatgcccagtacgaacatttccacctgggcagtgagaaccagctatacaggctttctgtggtcgggtacagcggctcagcagggcgccagagcagcctggtcctgcagaacaccagctttagcacccttgactcagacaacgaccactgtctctgcaagtgtgcccaagtgatgtctggagggtggtggtttgacgcctgtggcctgtcaaacctcaacggcgtctactaccacgctcccgacaacaagtacaagatggacggcatccgctggcactacttcaagggccccagctactcactgcgtgcctctcgcatgatgatacggcctttggacatctaacgagcagctgtgccagaggctggaccacacaggagaagctcggacttggcactcctggacaacctggacccagatgcaagacactgtgccaccgccttccctgacaccctgggcttcctgagccagccctccttgacccagaagtccagaagggtcatctgccccccaactcccctccgtctgtgacatggagggtgttcggggcccatccctctgatgtagtcctcgcccctcttctctccctcccccttcaggggctccctgcctgagggtcacagtaccttgaatgggctgagaacagaccaaacttgattcccatgaccaatggtggggttgcaggcaggtgggaatgtatttgcacatcggaagctgcccagatggcccaggttctctcccttggattggcaagaaggccatctcccattctaagctcctgttccaagattttctagtcttgagatgtccttgaactttcttttcaagtctgaaggggctgcatccaccccttagtgggtgggttaatcattatttccccttcacacttcaccacttctaggttctaatgaccctagatctcagggtctttagacttcaccacttctaggctttaccacttcaccacttctaggctccaatgtttggagctcagggtctttaggagacccaaaaggacatgctccttcacctccagcatgtcctagaggatgtgtcacagggaataactatggcttgtctctaaaagtacctatgagcaatgagaaaaggaaacagcaggttaagtcaaagtgaacaggcactcttcactgcaggactgatcagagcctttaatatggccaagtgccttgtgactacccatgaaggggctagagtgggcagctttctccaaatttacttatttgaaaatgggctcggtttgtcccagagcatctcacaggactgtagatgctcttggacaaagctagtgctcccctggcataaggaggagccctacgaccccatccccaccccagctatactcaccctttttggctacaagggccacagtgacagcctcaaacaacctctaaaaacaactggaaataacctttcagttaaaacagataccatccctgaagaagggtctagaactaggtccctgtctgtgttataggctcatgtcctccaaggctccttcaagtcccaggaagctgatctctacctgggtggcttcccttaggactccctgtaacctcaactcccccaggctcaattacagggactgttaggcaggacatctgtctccaagtccagatcctctctgcctccaagccctaacccctagcctccctcccttccccatccagcagtgatgctgcctctgtggtggtaggtggggagctgcaggggaggagataaggcctctgcctgagtttgggagaccagggccctcatagcttctttcagaggatggagtcagaaaggatccacagctactctgtcacctgcccccatcactgtgtcatgctgtctgccctgttgtcatcagccaacacccaggcatagccaggagcccacctgccctaccgccaggatacacctctgtcctcagaaggttttctcctggatgagactgagccaatgggaatgggaccccttcatccccctggctcgccccagccctgagtcccactctcagccgatccctgagtaaacccagcacagactgactttgatctcattcctgggaattagcactcttccccttcaagactcaaaggacatggttgctaatggtggcatttcaggcatgatgggaaatctttaggggcagattgctgcccagagagctcaaatcgccttaagcagcatttgcccagcagacctttatttagcctctactgtgtgcagtgtggtgtggtgggcagggctttggagtcggacaaacctgctccagctctgacactttggtccagtggctcagcctctcaaggcaccagttatcttcacatcatcaaagcctcagttttcccatctgtaaaatggagatgataatattccttcctggctgggctatggcaaggaggaaatgagaccatgtatgtcatcttcttaatagagcctggcatgaagcaggtgcctaataaatgtttgtcctcaaagaggagaatggggtgaggaaggcattccccagcacatgccgccccttctcctgcactcaggtgaggaaaaggcattttatttttgtatccacatcatttatttttctattgtagtttctaggctgactgcaagctagagaggagacagggcaaagctgtgaggcccagggacagaactcctctgggtgggttgaaggcccaagtccctctctactcccattttataagggggcaggaagctgatttgagttatcctcagacacctgttctttatgtaattttattttatttttttgagacagagtctcactctgtcacccaggctggagtgcagtggcatgatctcagatcactgcaatctctgcctcctggttcaagtgattctcctacctcagcctcctgagtaatgggattacagacgcctaccaccacgcccggaaaacttttgtatttttagtagaaacgggttttcaccatgttggccaggctggtctcaaactcctggcctcatgtgatccacctgcctcagcctcccaaagtgctgggattacaggcatgagccaccatacccagcctcagacacctgttcttaaatattcatccttctttcttaccttccttcctcttccatgccaggactcaggtataagggatagaaattctagccctaaggaataaattgactcacataactggaaagtctaagggtaaaggcaagtgaggttagatccagaggctcaaatgatgtcagctccacctctcagcccctccatctgccccgttgacttcattctcagccaggatctttcctcacaagaaggctctggcagccccaggctcatgtcctcccagctcagcatccctgacccggggagctccctcgtctccatgattccagtaaaggaatgattttctgcagccag

SEQ ID NO: 107231 - DNA, 3348 bp, Homo sapiens
  Payload ID: 1049
  Gene Symbol: ANGPTL1
  Gene Name: angiopoietin-like 1
  Uniprot ID: O95841
  ENST ID: ENST00000234816
  CDS Start-End: 449-1924
gcagctggttactgcatttctccatgtggcagacagagcaaagccacaacgctttctctgctggattaaagacggcccacagaccagaacttccactatactacttaaaattacataggtggcttgtcaaattcaattgattagtattgtaaaaggaaaaagaagttccttcttacagcttggattcaacggtccaaaacaaaaatgcagctgccattaaagtcacagatgaacaaacttctacactgatttttaaaatcaagaataagggcagcaagtttctggattcactgaatcaacagacacaaaaagctggcaatatagcaactatgaagagaaaagctactaataaaattaacccaacgcatagaagacttttttttctcttctaaaaacaactaagtaaagacttaaatttaaacacatcattttacaacctcatttcaaaatgaagacttttacctggaccctaggtgtgctattcttcctactagtggacactggacattgcagaggtggacaattcaaaattaaaaaaataaaccagagaagataccctcgtgccacagatggtaaagaggaagcaaagaaatgtgcatacacattcctggtacctgaacaaagaataacagggccaatctgtgtcaacaccaaggggcaagatgcaagtaccattaaagacatgatcaccaggatggaccttgaaaacctgaaggatgtgctctccaggcagaagcgggagatagatgttctgcaactggtggtggatgtagatggaaacattgtgaatgaggtaaagctgctgagaaaggaaagccgtaacatgaactctcgtgttactcaactctatatgcaattattacatgagattatccgtaagagggataattcacttgaactttcccaactggaaaacaaaatcctcaatgtcaccacagaaatgttgaagatggcaacaagatacagggaactagaggtgaaatacgcttccttgactgatcttgtcaataaccaatctgtgatgatcactttgttggaagaacagtgcttgaggatattttcccgacaagacacccatgtgtctcccccacttgtccaggtggtgccacaacatattcctaacagccaacagtatactcctggtctgctgggaggtaacgagattcagagggatccaggttatcccagagatttaatgccaccacctgatctggcaacttctcccaccaaaagccctttcaagataccaccggtaactttcatcaatgaaggaccattcaaagactgtcagcaagcaaaagaagctgggcattcggtcagtgggatttatatgattaaacctgaaaacagcaatggaccaatgcagttatggtgtgaaaacagtttggaccctgggggttggactgttattcagaaaagaacagacggctctgtcaacttcttcagaaattgggaaaattataagaaagggtttggaaacattgacggagaatactggcttggactggaaaatatctatatgcttagcaatcaagataattacaagttattgattgaattagaagactggagtgataaaaaagtctatgcagaatacagcagctttcgtctggaacctgaaagtgaattctatagactgcgcctgggaacttaccagggaaatgcaggggattctatgatgtggcataatggtaaacaattcaccacactggacagagataaagatatgtatgcaggaaactgcgcccactttcataaaggaggctggtggtacaatgcctgtgcacattctaacctaaatggagtatggtacagaggaggccattacagaagcaagcaccaagatggaattttctgggccgaatacagaggcgggtcatactccttaagagcagttcagatgatgatcaagcctattgactgaagagagacactcgccaatttaaatgacacagaactttgtacttttcagctcttaaaaatgtaaatgttacatgtatattacttggcacaatttatttctacacagaaagtttttaaaatgaattttaccgtaactataaaagggaacctataaatgtagtttcatctgtcgtcaattactgcagaaaattatgtgtatccacaacctagttattttaaaaattatgttgactaaatacaaagtttgttttctaaaatgtaaatatttgccacaatgtaaagcaaatcttagctatattttaaatcataaataacatgttcaagatacttaacaatttatttaaaatctaagattgctctaacgtctagtgaaaaaaatatttttaaaatttcagccaaataatgcattttatttataaaaatacagacagaaaattagggagaaacctctagttttgccaatagaaaatgcttcttccattgaataaaagttatttcaaattgaatttgtgcctttcacacgtaatgattaaatctgaattcttaataatatatcctatgctgattttcccaaaacatgacccatagtattaaatacatatcatttttaaaaataaaaaaaaacccaaaaataatgcatgcataatttaaatggtcaatttataaagacaaatctatgaatgaatttttcagtgttatcttcatatgatatgctgaacaccaaaatctccagaaatgcattttatgtagttctaaaatcagcaaaatattggtattacaaaaatgcagaatatttagtgtgctacagatctgaattatagttctaatttattattactttttttctaatttactgatcttactactacaaagaaaaaaaaacccaaccaatctgcaattcaaatcagaaagtttggacagctttacaagtattagtgcatgctcagaacaggtgggactaaaacaaactcaaggaactgttggctgttttcccgatactgagaattcaacagctccagagcagaagccacaggggcatagcttagtccaaactgctaatttcattttacagtgtatgtaacgcttagtctcacagtgtctttaactcatctttgcaatcaacaactttactagtgactttctggaacaatttcctttcaggaatacatattcactgcttagaggtgaccttgccttaatatatttgtgaagttaaaattttaaagatagctcatgaaacttttgcttaagcaaaaagaaaacctcgaattgaaatgtgtgaggcaaactatgcatgggaatagcttaatgtgaagataatcatttggacaactcaaatccatcaacatgaccaatgtttttcatctgccacatctcaaaataaaacttctggtgaaacaaattaaacaaaatatccaaacctca

SEQ ID NO: 107232 - DNA, 2289 bp, Homo sapiens
  Payload ID: 1049
  Gene Symbol: ANGPTL1
  Gene Name: angiopoietin-like 1
  Uniprot ID: O95841
  ENST ID: ENST00000367629
  CDS Start-End: 309-1784
agacagagcaaagccacaacgctttctctgctggattaaagacggcccacagaccagaacttccactatactacttaaaattacataggtggcttgtcaaattcaattgattagtattgtaaaaggaaaaagaagttccttcttacagcttggattcaacggtccaaaacaaaaatgcagctgccattaaagtcacagatgaacaaacttctacactgatttttaaaatcaagaataagggcagcaagtttctggattcactgaatcaacagacacaaaaagacatcattttacaacctcatttcaaaatgaagacttttacctggaccctaggtgtgctattcttcctactagtggacactggacattgcagaggtggacaattcaaaattaaaaaaataaaccagagaagataccctcgtgccacagatggtaaagaggaagcaaagaaatgtgcatacacattcctggtacctgaacaaagaataacagggccaatctgtgtcaacaccaaggggcaagatgcaagtaccattaaagacatgatcaccaggatggaccttgaaaacctgaaggatgtgctctccaggcagaagcgggagatagatgttctgcaactggtggtggatgtagatggaaacattgtgaatgaggtaaagctgctgagaaaggaaagccgtaacatgaactctcgtgttactcaactctatatgcaattattacatgagattatccgtaagagggataattcacttgaactttcccaactggaaaacaaaatcctcaatgtcaccacagaaatgttgaagatggcaacaagatacagggaactagaggtgaaatacgcttccttgactgatcttgtcaataaccaatctgtgatgatcactttgttggaagaacagtgcttgaggatattttcccgacaagacacccatgtgtctcccccacttgtccaggtggtgccacaacatattcctaacagccaacagtatactcctggtctgctgggaggtaacgagattcagagggatccaggttatcccagagatttaatgccaccacctgatctggcaacttctcccaccaaaagccctttcaagataccaccggtaactttcatcaatgaaggaccattcaaagactgtcagcaagcaaaagaagctgggcattcggtcagtgggatttatatgattaaacctgaaaacagcaatggaccaatgcagttatggtgtgaaaacagtttggaccctgggggttggactgttattcagaaaagaacagacggctctgtcaacttcttcagaaattgggaaaattataagaaagggtttggaaacattgacggagaatactggcttggactggaaaatatctatatgcttagcaatcaagataattacaagttattgattgaattagaagactggagtgataaaaaagtctatgcagaatacagcagctttcgtctggaacctgaaagtgaattctatagactgcgcctgggaacttaccagggaaatgcaggggattctatgatgtggcataatggtaaacaattcaccacactggacagagataaagatatgtatgcaggaaactgcgcccactttcataaaggaggctggtggtacaatgcctgtgcacattctaacctaaatggagtatggtacagaggaggccattacagaagcaagcaccaagatggaattttctgggccgaatacagaggcgggtcatactccttaagagcagttcagatgatgatcaagcctattgactgaagagagacactcgccaatttaaatgacacagaactttgtacttttcagctcttaaaaatgtaaatgttacatgtatattacttggcacaatttatttctacacagaaagtttttaaaatgaattttaccgtaactataaaagggaacctataaatgtagtttcatctgtcgtcaattactgcagaaaattatgtgtatccacaacctagttattttaaaaattatgttgactaaatacaaagtttgttttctaaaatgtaaatatttgccacaatgtaaagcaaatcttagctatattttaaatcataaataacatgttcaagatacttaacaatttatttaaaatctaagattgctctaacgtctagtgaaaaaaatatttttaaaatttcagccaaataatgcattttatttataaaaatacagacagaaaattagggagaaacctctagttttgccaatagaaaatgcttcttccattgaataaaagttatttcaaattgaa

SEQ ID NO: 107233 - DNA, 534 bp, Homo sapiens
  Payload ID: 1049
  Gene Symbol: ANGPTL1
  Gene Name: angiopoietin-like 1
  ENST ID: ENST00000444255
  CDS Start-End: 192-534
gagtttaccatctgaaaggaggcaaatcctgactttcgtttcttctctctactagctggcaatatagcaactatgaagagaaaagctactaataaaattaacccaacgcatagaagacttttttttctcttctaaaaacaactaagtaaagacttaaatttaaacacatcattttacaacctcatttcaaaatgaagacttttacctggaccctaggtgtgctattcttcctactagtggacactggacattgcagaggtggacaattcaaaattaaaaaaataaaccagagaagataccctcgtgccacagatggtaaagaggaagcaaagaaatgtgcatacacattcctggtacctgaacaaagaataacagggccaatctgtgtcaacaccaaggggcaagatgcaagtaccattaaagacatgatcaccaggatggaccttgaaaacctgaaggatgtgctctccaggcagaagcgggagatagatgttctgcaactggtggtggatgtagatggaaacattgtgaatg

SEQ ID NO: 107234 - DNA, 2575 bp, Homo sapiens
  Payload ID: 1050
  Gene Symbol: ANGPTL2
  Gene Name: angiopoietin-like 2
  Uniprot ID: Q9UKU9
  ENST ID: ENST00000373417
  CDS Start-End: 410-985
aaatgaggctgctgcggacggcctgaggatggaccccaagccctggacctgccgagcgtggcactgaggcagcggctgacgctactgtgagggaaagaaggttgtgagcagccccgcaggacccctggccagccctggccccagcctctgccggagccctctgtggaggcagagccagtggagcccagtgaggcagggctgcttggcagccaccggcctgcaactcaggaacccctccagaggccatggacaggctgccccgctgacggccagggtgaagcatgtgaggagccgccccggagccaagcaggagggaagaggcccatggagagactgcctgcaggccctggaggatggccacgacaccagctccatctacctggtgaagccggagaacaccaaccgcctcatgcaggtgtggtgcgaccagagacacgaccccgggggctggaccgtcatccagagacgcctggatggctctgttaacttcttcaggaactgggagacgtacaagcaagggtttgggaacattgacggcgaatactggctgggcctggagaacatttactggctgacgaaccaaggcaactacaaactcctggtgaccatggaggactggtccggccgcaaagtctttgcagaatacgccagtttccgcctggaacctgagagcgagtattataagctgcggctggggcgctaccatggcaatgcgggtgactcctttacatggcacaacggcaagcagttcaccaccctggacagagatcatgatgtctacacaggaaactgtgcccactaccagaagggaggctggtggtataacgcctgtgcccactccaacctcaacggggtctggtaccgcgggggccattaccggagccgctaccaggacggagtctactgggctgagttccgaggaggctcttactcactcaagaaagtggtgatgatgatccgaccgaaccccaacaccttccactaagccagctccccctcctgacctctcgtggccattgccaggagcccaccctggtcacgctggccacagcacaaagaacaactcctcaccagttcatcctgaggctgggaggaccgggatgctggattctgttttccgaagtcactgcagcggatgatggaactgaatcgatacggtgttttctgtccctcctactttccttcacaccagacagcccctcatgtctccaggacaggacaggactacagacaactctttctttaaataaattaagtctctacaataaaaacacaactgcaaagtaccttcataatatacatgtgtatgagcctcccttgtgcacgtatgtgtataccacatatatatgcatttagatatacatcacatgtgatatatctagatccatatataggtttgccttagatacctaaatacacatatattcagttctcagatgttgaagctgtcaccagcagctttgctcttaggagaaaagcatttcattagtgttgtattacttgagtctaagggtagatcacagactgtgtggtctcaactgaaaggatcacccttggcatctgtgtgcctggattcttccagaatgtctacaatgctaatctctcacatagaggttcccagcttcttaagaaccccttttggcacctaatcaaatttcaaaatccctccccccacattttcatacttttccccattctcaggacttttcaccatccatcacccacttatcccttcatttgacaccattcattaagtgccttctgtgtgtcagtccctggccactcactgcagttcaaggccccctttccgctctgctgtactcctcgcctacctactccttgccttttctgtcgcacagccccttctttccaggcgagattcctcagcttctgagtaggaaacactccgggctccaggtttctggttgggaagggaaggccaggccaaaagctccaccggccgtatagataatgtactcgcagttttgtatcttccattcatactttaacctacaggtcatttgagtcttcacacaaataataacctatctggccaggagaattatctcagaacagaagtcatcagatcatcagagcccccagatggctacagaccagagattccacgctctcaggctgactagagtccgcatctcatctccaaactacacttccctggagaacaagtgccacaaaaatgaaaacaggccacttctcaggagttgaataatcaggggtcaccggaccccttggttgatgcactgcagcatggtggctttctgagtcctgttggccaccaagtgtcagcctcagcactcccgggactattgccaagaaggggcaagggatgagtcaagaaggtgagacccttcccggtgggcacgtgggccaggctgtgtgagatgttggatgtttggtactgtccatgtctgggtgtgtgcctattacctcagcatttctcacaaagtgtaccatgtagcatgttttgtgtatataaaagggagggtttttttaaaaatatattcccagattatccttgtaatgacacgaatctgcaataaaagccatcagtgct

SEQ ID NO: 107235 - DNA, 3707 bp, Homo sapiens
  Payload ID: 1050
  Gene Symbol: ANGPTL2
  Gene Name: angiopoietin-like 2
  Uniprot ID: Q9UKU9
  ENST ID: ENST00000373425
  CDS Start-End: 619-2100
ggggcctgccgaggccgccaaagcgggctgggcgggaggggccaggccagctggggccggagctcgtgtgacatcaccgggcggcccgcctctgtctggggctgaggggaggcccggagcctttctggggcctgggggatcctcttgcactggtgggtggagagaagcgcctgcagccaaccagggtcaggctgtgctcacagtttcctctggcggcatgtaaaggctccacaaaggagttgggagttcaaatgaggctgctgcggacggcctgaggatggaccccaagccctggacctgccgagcgtggcactgaggcagcggctgacgctactgtgagggaaagaaggttgtgagcagccccgcaggacccctggccagccctggccccagcctctgccggagccctctgtggaggcagagccagtggagcccagtgaggcagggctgcttggcagccaccggcctgcaactcaggaacccctccagaggccatggacaggctgccccgctgacggccagggtgaagcatgtgaggagccgccccggagccaagcaggagggaagaggctttcatagattctattcacaaagaataaccaccattttgcaaggaccatgaggccactgtgcgtgacatgctggtggctcggactgctggctgccatgggagctgttgcaggccaggaggacggttttgagggcactgaggagggctcgccaagagagttcatttacctaaacaggtacaagcgggcgggcgagtcccaggacaagtgcacctacaccttcattgtgccccagcagcgggtcacgggtgccatctgcgtcaactccaaggagcctgaggtgcttctggagaaccgagtgcataagcaggagctagagctgctcaacaatgagctgctcaagcagaagcggcagatcgagacgctgcagcagctggtggaggtggacggcggcattgtgagcgaggtgaagctgctgcgcaaggagagccgcaacatgaactcgcgggtcacgcagctctacatgcagctcctgcacgagatcatccgcaagcgggacaacgcgttggagctctcccagctggagaacaggatcctgaaccagacagccgacatgctgcagctggccagcaagtacaaggacctggagcacaagtaccagcacctggccacactggcccacaaccaatcagagatcatcgcgcagcttgaggagcactgccagagggtgccctcggccaggcccgtcccccagccaccccccgctgccccgccccgggtctaccaaccacccacctacaaccgcatcatcaaccagatctctaccaacgagatccagagtgaccagaacctgaaggtgctgccaccccctctgcccactatgcccactctcaccagcctcccatcttccaccgacaagccgtcgggcccatggagagactgcctgcaggccctggaggatggccacgacaccagctccatctacctggtgaagccggagaacaccaaccgcctcatgcaggtgtggtgcgaccagagacacgaccccgggggctggaccgtcatccagagacgcctggatggctctgttaacttcttcaggaactgggagacgtacaagcaagggtttgggaacattgacggcgaatactggctgggcctggagaacatttactggctgacgaaccaaggcaactacaaactcctggtgaccatggaggactggtccggccgcaaagtctttgcagaatacgccagtttccgcctggaacctgagagcgagtattataagctgcggctggggcgctaccatggcaatgcgggtgactcctttacatggcacaacggcaagcagttcaccaccctggacagagatcatgatgtctacacaggaaactgtgcccactaccagaagggaggctggtggtataacgcctgtgcccactccaacctcaacggggtctggtaccgcgggggccattaccggagccgctaccaggacggagtctactgggctgagttccgaggaggctcttactcactcaagaaagtggtgatgatgatccgaccgaaccccaacaccttccactaagccagctccccctcctgacctctcgtggccattgccaggagcccaccctggtcacgctggccacagcacaaagaacaactcctcaccagttcatcctgaggctgggaggaccgggatgctggattctgttttccgaagtcactgcagcggatgatggaactgaatcgatacggtgttttctgtccctcctactttccttcacaccagacagcccctcatgtctccaggacaggacaggactacagacaactctttctttaaataaattaagtctctacaataaaaacacaactgcaaagtaccttcataatatacatgtgtatgagcctcccttgtgcacgtatgtgtataccacatatatatgcatttagatatacatcacatgtgatatatctagatccatatataggtttgccttagatacctaaatacacatatattcagttctcagatgttgaagctgtcaccagcagctttgctcttaggagaaaagcatttcattagtgttgtattacttgagtctaagggtagatcacagactgtgtggtctcaactgaaaggatcacccttggcatctgtgtgcctggattcttccagaatgtctacaatgctaatctctcacatagaggttcccagcttcttaagaaccccttttggcacctaatcaaatttcaaaatccctccccccacattttcatacttttccccattctcaggacttttcaccatccatcacccacttatcccttcatttgacaccattcattaagtgccttctgtgtgtcagtccctggccactcactgcagttcaaggccccctttccgctctgctgtactcctcgcctacctactccttgccttttctgtcgcacagccccttctttccaggcgagattcctcagcttctgagtaggaaacactccgggctccaggtttctggttgggaagggaaggccaggccaaaagctccaccggccgtatagataatgtactcgcagttttgtatcttccattcatactttaacctacaggtcatttgagtcttcacacaaataataacctatctggccaggagaattatctcagaacagaagtcatcagatcatcagagcccccagatggctacagaccagagattccacgctctcaggctgactagagtccgcatctcatctccaaactacacttccctggagaacaagtgccacaaaaatgaaaacaggccacttctcaggagttgaataatcaggggtcaccggaccccttggttgatgcactgcagcatggtggctttctgagtcctgttggccaccaagtgtcagcctcagcactcccgggactattgccaagaaggggcaagggatgagtcaagaaggtgagacccttcccggtgggcacgtgggccaggctgtgtgagatgttggatgtttggtactgtccatgtctgggtgtgtgcctattacctcagcatttctcacaaagtgtaccatgtagcatgttttgtgtatataaaagggagggtttttttaaaaatatattcccagattatccttgtaatgacacgaatctgcaataaaagccatcagtgctatttggatgtatctaca

SEQ ID NO: 107236 - DNA, 2805 bp, Homo sapiens
  Payload ID: 1051
  Gene Symbol: ANGPTL3
  Gene Name: angiopoietin-like 3
  Uniprot ID: Q9Y5C1
  ENST ID: ENST00000371129
  CDS Start-End: 81-1463
atatatagagttaagaagtctaggtctgcttccagaagaaaacagttccacgttgcttgaaattgaaaatcaagataaaaatgttcacaattaagctccttctttttattgttcctctagttatttcctccagaattgatcaagacaattcatcatttgattctctatctccagagccaaaatcaagatttgctatgttagacgatgtaaaaattttagccaatggcctccttcagttgggacatggtcttaaagactttgtccataagacgaagggccaaattaatgacatatttcaaaaactcaacatatttgatcagtctttttatgatctatcgctgcaaaccagtgaaatcaaagaagaagaaaaggaactgagaagaactacatataaactacaagtcaaaaatgaagaggtaaagaatatgtcacttgaactcaactcaaaacttgaaagcctcctagaagaaaaaattctacttcaacaaaaagtgaaatatttagaagagcaactaactaacttaattcaaaatcaacctgaaactccagaacacccagaagtaacttcacttaaaacttttgtagaaaaacaagataatagcatcaaagaccttctccagaccgtggaagaccaatataaacaattaaaccaacagcatagtcaaataaaagaaatagaaaatcagctcagaaggactagtattcaagaacccacagaaatttctctatcttccaagccaagagcaccaagaactactccctttcttcagttgaatgaaataagaaatgtaaaacatgatggcattcctgctgaatgtaccaccatttataacagaggtgaacatacaagtggcatgtatgccatcagacccagcaactctcaagtttttcatgtctactgtgatgttatatcaggtagtccatggacattaattcaacatcgaatagatggatcacaaaacttcaatgaaacgtgggagaactacaaatatggttttgggaggcttgatggagaattttggttgggcctagagaagatatactccatagtgaagcaatctaattatgttttacgaattgagttggaagactggaaagacaacaaacattatattgaatattctttttacttgggaaatcacgaaaccaactatacgctacatctagttgcgattactggcaatgtccccaatgcaatcccggaaaacaaagatttggtgttttctacttgggatcacaaagcaaaaggacacttcaactgtccagagggttattcaggaggctggtggtggcatgatgagtgtggagaaaacaacctaaatggtaaatataacaaaccaagagcaaaatctaagccagagaggagaagaggattatcttggaagtctcaaaatggaaggttatactctataaaatcaaccaaaatgttgatccatccaacagattcagaaagctttgaatgaactgaggcaaatttaaaaggcaataatttaaacattaacctcattccaagttaatgtggtctaataatctggtattaaatccttaagagaaagcttgagaaatagattttttttatcttaaagtcactgtctatttaagattaaacatacaatcacataaccttaaagaataccgtttacatttctcaatcaaaattcttataatactatttgttttaaattttgtgatgtgggaatcaattttagatggtcacaatctagattataatcaataggtgaacttattaaataacttttctaaataaaaaatttagagacttttattttaaaaggcatcatatgagctaatatcacaactttcccagtttaaaaaactagtactcttgttaaaactctaaacttgactaaatacagaggactggtaattgtacagttcttaaatgttgtagtattaatttcaaaactaaaaatcgtcagcacagagtatgtgtaaaaatctgtaatacaaatttttaaactgatgcttcattttgctacaaaataatttggagtaaatgtttgatatgatttatttatgaaacctaatgaagcagaattaaatactgtattaaaataagttcgctgtctttaaacaaatggagatgactactaagtcacattgactttaacatgaggtatcactataccttatttgttaaaatatatactgtatacattttatatattttaacacttaatactatgaaaacaaataattgtaaaggaatcttgtcagattacagtaagaatgaacatatttgtggcatcgagttaaagtttatatttcccctaaatatgctgtgattctaatacattcgtgtaggttttcaagtagaaataaacctcgtaacaagttactgaacgtttaaacagcctgacaagcatgtatatatgtttaaaattcaataaacaaagacccagtccctaaattatagaaatttaaattattcttgcatgtttatcgacatcacaacagatccctaaatccctaaatccctaaagattagatacaaattttttaccacagtatcacttgtcagaatttatttttaaatatgattttttaaaactgccagtaagaaattttaaattaaacccatttgttaaaggatatagtgcccaagttatatggtgacctacctttgtcaatacttagcattatgtatttcaaattatccaatatacatgtcatatatatttttatatgtcacatatataaaagatatgtatgatctatgtgaatcctaagtaaatattttgttccagaaaagtacaaaataataaaggtaaaaataatctataa

SEQ ID NO: 107237 - DNA, 1879 bp, Homo sapiens
  Payload ID: 1052
  Gene Symbol: ANGPTL4
  Gene Name: angiopoietin-like 4
  Uniprot ID: Q9BY76
  ENST ID: ENST00000301455
  CDS Start-End: 172-1392
ggggagaagccgagctgagcggatcctcacacgactgtgatccgattctttccagcggcttctgcaaccaagcgggtcttacccccggtcctccgcgtctccagtcctcgcacctggaaccccaacgtccccgagagtccccgaatccccgctcccaggctacctaagaggatgagcggtgctccgacggccggggcagccctgatgctctgcgccgccaccgccgtgctactgagcgctcagggcggacccgtgcagtccaagtcgccgcgctttgcgtcctgggacgagatgaatgtcctggcgcacggactcctgcagctcggccaggggctgcgcgaacacgcggagcgcacccgcagtcagctgagcgcgctggagcggcgcctgagcgcgtgcgggtccgcctgtcagggaaccgaggggtccaccgacctcccgttagcccctgagagccgggtggaccctgaggtccttcacagcctgcagacacaactcaaggctcagaacagcaggatccagcaactcttccacaaggtggcccagcagcagcggcacctggagaagcagcacctgcgaattcagcatctgcaaagccagtttggcctcctggaccacaagcacctagaccatgaggtggccaagcctgcccgaagaaagaggctgcccgagatggcccagccagttgacccggctcacaatgtcagccgcctgcaccggctgcccagggattgccaggagctgttccaggttggggagaggcagagtggactatttgaaatccagcctcaggggtctccgccatttttggtgaactgcaagatgacctcagatggaggctggacagtaattcagaggcgccacgatggctcagtggacttcaaccggccctgggaagcctacaaggcggggtttggggatccccacggcgagttctggctgggtctggagaaggtgcatagcatcacgggggaccgcaacagccgcctggccgtgcagctgcgggactgggatggcaacgccgagttgctgcagttctccgtgcacctgggtggcgaggacacggcctatagcctgcagctcactgcacccgtggccggccagctgggcgccaccaccgtcccacccagcggcctctccgtacccttctccacttgggaccaggatcacgacctccgcagggacaagaactgcgccaagagcctctctggaggctggtggtttggcacctgcagccattccaacctcaacggccagtacttccgctccatcccacagcagcggcagaagcttaagaagggaatcttctggaagacctggcggggccgctactacccgctgcaggccaccaccatgttgatccagcccatggcagcagaggcagcctcctagcgtcctggctgggcctggtcccaggcccacgaaagacggtgactcttggctctgcccgaggatgtggccgttccctgcctgggcaggggctccaaggaggggccatctggaaacttgtggacagagaagaagaccacgactggagaagccccctttctgagtgcaggggggctgcatgcgttgcctcctgagatcgaggctgcaggatatgctcagactctagaggcgtggaccaaggggcatggagcttcactccttgctggccagggagttggggactcagagggaccacttggggccagccagactggcctcaatggcggactcagtcacattgactgacggggaccagggcttgtgtgggtcgagagcgccctcatggtgctggtgctgttgtgtgtaggtcccctggggacacaagcaggcgccaatggtatctgggcggagctcacagagttcttggaataaaagcaacctcagaacactt

SEQ ID NO: 107238 - DNA, 1705 bp, Homo sapiens
  Payload ID: 1052
  Gene Symbol: ANGPTL4
  Gene Name: angiopoietin-like 4
  Uniprot ID: Q9BY76
  ENST ID: ENST00000393962
  CDS Start-End: 154-1260
gcggatcctcacacgactgtgatccgattctttccagcggcttctgcaaccaagcgggtcttacccccggtcctccgcgtctccagtcctcgcacctggaaccccaacgtccccgagagtccccgaatccccgctcccaggctacctaagaggatgagcggtgctccgacggccggggcagccctgatgctctgcgccgccaccgccgtgctactgagcgctcagggcggacccgtgcagtccaagtcgccgcgctttgcgtcctgggacgagatgaatgtcctggcgcacggactcctgcagctcggccaggggctgcgcgaacacgcggagcgcacccgcagtcagctgagcgcgctggagcggcgcctgagcgcgtgcgggtccgcctgtcagggaaccgaggggtccaccgacctcccgttagcccctgagagccgggtggaccctgaggtccttcacagcctgcagacacaactcaaggctcagaacagcaggatccagcaactcttccacaaggtggcccagcagcagcggcacctggagaagcagcacctgcgaattcagcatctgcaaagccagtttggcctcctggaccacaagcacctagaccatgaggtggccaagcctgcccgaagaaagaggctgcccgagatggcccagccagttgacccggctcacaatgtcagccgcctgcaccatggaggctggacagtaattcagaggcgccacgatggctcagtggacttcaaccggccctgggaagcctacaaggcggggtttggggatccccacggcgagttctggctgggtctggagaaggtgcatagcatcacgggggaccgcaacagccgcctggccgtgcagctgcgggactgggatggcaacgccgagttgctgcagttctccgtgcacctgggtggcgaggacacggcctatagcctgcagctcactgcacccgtggccggccagctgggcgccaccaccgtcccacccagcggcctctccgtacccttctccacttgggaccaggatcacgacctccgcagggacaagaactgcgccaagagcctctctggaggctggtggtttggcacctgcagccattccaacctcaacggccagtacttccgctccatcccacagcagcggcagaagcttaagaagggaatcttctggaagacctggcggggccgctactacccgctgcaggccaccaccatgttgatccagcccatggcagcagaggcagcctcctagcgtcctggctgggcctggtcccaggcccacgaaagacggtgactcttggctctgcccgaggatgtggccgttccctgcctgggcaggggctccaaggaggggccatctggaaacttgtggacagagaagaagaccacgactggagaagccccctttctgagtgcaggggggctgcatgcgttgcctcctgagatcgaggctgcaggatatgctcagactctagaggcgtggaccaaggggcatggagcttcactccttgctggccagggagttggggactcagagggaccacttggggccagccagactggcctcaatggcggactcagtcacattgactgacggggaccagggcttgtgtgggtcgagagcgccctcatggtgctggtgctgttgtgtgtaggtcccctggggacacaagcaggcgccaatggtatctgggcgg

SEQ ID NO: 107239 - DNA, 552 bp, Homo sapiens
  Payload ID: 1052
  Gene Symbol: ANGPTL4
  Gene Name: angiopoietin-like 4
  ENST ID: ENST00000601886
  CDS Start-End: 265-552
atgcgagcccagaaaagtctctcctggtcttgggatggaggtcacacgaagcctccgcaaggcaaggacttttgagactgggtttcacgatgttggccgggctggtctggaagtcttgacctcaagcgtgcgccctctccgccactggcggcttctgcaaccaagcgggtcttacccccggtcctccgcgtctccagtcctcgcacctggaaccccaacgtccccgagagtccccgaatccccgctcccaggctacctaagaggatgagcggtgctccgacggccggggcagccctgatgctctgcgccgccaccgccgtgctactgagcgctcagggcggacccgtgcagtccaagtcgccgcgctttgcgtcctgggacgagatgaatgtcctggcgcacggactcctgcagctcggccaggggctgcgcgaacacgcggagcgcacccgcagtcagctgagcgcgctggagcggcgcctgagcgcgtgcgggtccgcctgtcagggaaccgaggggtccaccgacctcccgttagcccctgagagccgg

SEQ ID NO: 107240 - DNA, 813 bp, Homo sapiens
  Payload ID: 1052
  Gene Symbol: ANGPTL4
  Gene Name: angiopoietin-like 4
  ENST ID: ENST00000601770
  CDS Start-End: 557-813
tctttccttcttcctttctttccctccttccttccttcctctttctctctttcctttctctctctcttttctctctctctctccttcttccctccctccctacctctctctcttttctttttccgtccttccttccttctttccttctttctctctcttttctttcttttcttttcttttctcttctttcattttgagacgtactctggctctgtcgcccaggctggagcgcaatggcgccatctcggcgcactgcaacctccacctcccgggttcaagcgattctactgcctcagcctcccgagtagctgggactacaggcgcgcactaccaagcccggctaatttttttttgtatttttagtagagactgggtttcacgatgttggccgggctggtctggaagtcttgacctcaagcgtgcgccctctccgccactggcggcttctgcaaccaagcgggtcttacccccggtcctccgcgtctccagtcctcgcacctggaaccccaacgtccccgagagtccccgaatccccgctcccaggctacctaagaggatgagcggtgctccgacggccggggcagccctgatgctctgcgccgccaccgccgtgctactgagcgctcagggcggacccgtgcagtccaagtcgccgcgctttgcgtcctgggacgagatgaatgtcctggcgcacggactcctgcagctcggccaggggctgcgcgaacacgcggagcgcacccgcagtcagctgagcgcgctggagcggcgcctgagcgcgtgcgggtccgcctgtcagggaaccgaggggtc

SEQ ID NO: 107241 - DNA, 1798 bp, Homo sapiens
  Payload ID: 1052
  Gene Symbol: ANGPTL4
  Gene Name: angiopoietin-like 4
  Uniprot ID: Q9BY76
  ENST ID: ENST00000593998
  CDS Start-End: 154-1374
gcggatcctcacacgactgtgatccgattctttccagcggcttctgcaaccaagcgggtcttacccccggtcctccgcgtctccagtcctcgcacctggaaccccaacgtccccgagagtccccgaatccccgctcccaggctacctaagaggatgagcggtgctccgacggccggggcagccctgatgctctgcgccgccaccgccgtgctactgagcgctcagggcggacccgtgcagtccaagtcgccgcgctttgcgtcctgggacgagatgaatgtcctggcgcacggactcctgcagctcggccaggggctgcgcgaacacgcggagcgcacccgcagtcagctgagcgcgctggagcggcgcctgagcgcgtgcgggtccgcctgtcagggaaccgaggggtccaccgacctcccgttagcccctgagagccgggtggaccctgaggtccttcacagcctgcagacacaactcaaggctcagaacagcaggatccagcaactcttccacaaggtggcccagcagcagcggcacctggagaagcagcacctgcgaattcagcatctgcaaagccagtttggcctcctggaccacaagcacctagaccatgaggtggccaagcctgcccgaagaaagaggctgcccgagatggcccagccagttgacccggctcacaatgtcagccgcctgcaccggctgcccagggattgccaggagctgttccaggttggggagaggcagagtggactatttgaaatccagcctcaggggtctccgccatttttggtgaactgcaagatgacctcagatggaggctggacagtaattcagaggcgccacgatggctcagtggacttcaaccggccctgggaagcctacaaggcggggtttggggatccccacggcgagttctggctgggtctggagaaggtgcatagcatcacgggggaccgcaacagccgcctggccgtgcagctgcgggactgggatggcaacgccgagttgctgcagttctccgtgcacctgggtggcgaggacacggcctatagcctgcagctcactgcacccgtggccggccagctgggcgccaccaccgtcccacccagcggcctctccgtacccttctccacttgggaccaggatcacgacctccgcagggacaagaactgcgccaagagcctctctggaggctggtggtttggcacctgcagccattccaacctcaacggccagtacttccgctccatcccacagcagcggcagaagcttaagaagggaatcttctggaagacctggcggggccgctactacccgctgcaggccaccaccatgttgatccagcccatggcagcagaggcagcctcctagcgtcctggctgggcctggtcccaggcccacgaaagacggtgactcttggctctgcccgaggatgtggccaagaccacgactggagaagccccctttctgagtgcaggggggctgcatgcgttgcctcctgagatcgaggctgcaggatatgctcagactctagaggcgtggaccaaggggcatggagcttcactccttgctggccagggagttggggactcagagggaccacttggggccagccagactggcctcaatggcggactcagtcacattgactgacggggaccagggcttgtgtgggtcgagagcgccctcatggtgctggtgctgttgtgtgtaggtcccctggggacacaagcaggcgccaatggtatctgggcggagctcacagagttcttggaataaaagcaacctcagaaca

SEQ ID NO: 107242 - DNA, 531 bp, Homo sapiens
  Payload ID: 1052
  Gene Symbol: ANGPTL4
  Gene Name: angiopoietin-like 4
  ENST ID: ENST00000594875
  CDS Start-End: 1-389
gacccgtgcagtccaagtcgccgcgctttgcgtcctgggacgagatgaatgtcctggcgcacggactcctgcagctcggccaggggctgcgcgaacacgcggagcgcacccgcagtcagctgagcgcgctggagcggcgcctgagcgcgtgcgggtccgcctgtcagggaaccgaggggtccaccgacctcccgttagcccctgagagccgggtggaccctgaggtccttcacagcctgcagacacaactcaaggctcagaacagcaggatccagcaactcttccacaaggtggcccagcagcagcggcacctggagaagcagcacctgcgaattcagcatctgcaaagccagactggcctcaatggcggactcagtcacattgactgacggggaccagggcttgtgtgggtcgagagcgccctcatggtgctggtgctgttgtgtgtaggtcccctggggacacaagcaggcgccaatggtatctgggcggagctcacagagttcttggaataaaagcaacctcagaaca

SEQ ID NO: 107243 - DNA, 1719 bp, Homo sapiens
  Payload ID: 1052
  Gene Symbol: ANGPTL4
  Gene Name: angiopoietin-like 4
  ENST ID: ENST00000595079
  CDS Start-End: 167-553
gaagccgagctgagcggatcctcacacgactgtgatccgattctttccagcggcttctgcaaccaagcgggtcttacccccggtcctccgcgtctccagtcctcgcacctggaaccccaacgtccccgagagtccccgaatccccgctcccaggctacctaagaggatgagcggtgctccgacggccggggcagccctgatgctctgcgccgccaccgccgtgctactgagcgctcagggcggacccgtgcagtccaagtcgccgcgctttgcgtcctgggacgagatgaatgtcctggcgcacggactcctgcagctcggccaggggctgcgcgaacacgcggagcgcacccgcagtcagctgagcgcgctggagcggcgcctgagcgcgtgcgggtccttcacagcctgcagacacaactcaaggctcagaacagcaggatccagcaactcttccacaaggtggcccagcagcagcggcacctggagaagcagcacctgcgaattcagcatctgcaaagccagtttggcctcctggaccacaagcacctagaccatgaggtggccaagcctgcccgaagaaagaggctgcccgagatggcccagccagttgacccggctcacaatgtcagccgcctgcaccggctgcccagggattgccaggagctgttccaggttggggagaggcagagtggactatttgaaatccagcctcaggggtctccgccatttttggtgaactgcaagatgacctcagatggaggctggacagtaattcagaggcgccacgatggctcagtggacttcaaccggccctgggaagcctacaaggcggggtttggggatccccacggcgagttctggctgggtctggagaaggtgcatagcatcacgggggaccgcaacagccgcctggccgtgcagctgcgggactgggatggcaacgccgagttgctgcagttctccgtgcacctgggtggcgaggacacggcctatagcctgcagctcactgcacccgtggccggccagctgggcgccaccaccgtcccacccagcggcctctccgtacccttctccacttgggaccaggatcacgacctccgcagggacaagaactgcgccaagagcctctctggaggctggtggtttggcacctgcagccattccaacctcaacggccagtacttccgctccatcccacagcagcggcagaagcttaagaagggaatcttctggaagacctggcggggccgctactacccgctgcaggccaccaccatgttgatccagcccatggcagcagaggcagcctcctagcgtcctggctgggcctggtcccaggcccacgaaagacggtgactcttggctctgcccgaggatgtggccgttccctgcctgggcaggggctccaaggaggggccatctggaaacttgtggacagagaagaagaccacgactggagaagccccctttctgagtgcaggggggctgcatgcgttgcctcctgagatcgaggctgcaggatatgctcagactctagaggcgtggaccaaggggcatggagcttcactccttgctggccagggagttggggactcagagggaccacttggggccagccagactggcctcaatggcggactcagtcacattgactgacggggaccagggcttgtgtgggtcgagagcgccctcatggtgctggtgctgttgtgtgta

SEQ ID NO: 107244 - DNA, 571 bp, Homo sapiens
  Payload ID: 1052
  Gene Symbol: ANGPTL4
  Gene Name: angiopoietin-like 4
  ENST ID: ENST00000599192
  CDS Start-End: 258-571
agaaaagtctctcctggtcttgggatggaggtcacacgaagcctccgcaaggcaaggacttttgtagagactgggtttcacgatgttggccgggctggtctggaagtcttgacctcaagcgtgcgccctctccgccactggcggcttctgcaaccaagcgggtcttacccccggtcctccgcgtctccagtcctcgcacctggaaccccaacgtccccgagagtccccgaatccccgctcccaggctacctaagaggatgagcggtgctccgacggccggggcagccctgatgctctgcgccgccaccgccgtgctactgagcgctcagggcggacccgtgcagtccaagtcgccgcgctttgcgtcctgggacgagatgaatgtcctggcgcacggactcctgcagctcggccaggggctgcgcgaacacgcggagcgcacccgcagtcagctgagcgcgctggagcggcgcctgagcgcgtgcgggtccgcctgtcagggaaccgaggggtccaccgacctcccgttagcccctgagagccgggtggaccctgaggtccttcacagcct

SEQ ID NO: 107245 - DNA, 2368 bp, Homo sapiens
  Payload ID: 1053
  Gene Symbol: ANGPTL5
  Gene Name: angiopoietin-like 5
  Uniprot ID: Q86XS5
  ENST ID: ENST00000334289
  CDS Start-End: 597-1763
gatgagaggaactagaagcagctattgcaagctaccattttgagaacctgcccaaagaaagaaaagactgaagggatggaagattgcagaaagcatgatcggagaagagatattttacttttagtgaagctctatacacatttgtcttcctcactagatttgtatccctagaacctagaacagagtcagccaaagagcaggcactcaatacaaattgttgacttgctgctaaaattgtaacagagtacaaagaacatcctagaaattggagacaaaggggataagaaaacagagttaacttggaaagagaagacactcatctctgacaagactgaagatgattacacaacaccatcattgccaaccaagtcctttgggaatacaaaggttaaatcctaatcatcacaacagtctctaaaggaataaacctgatttacagattttgataacaaaatacttctcctctttccattttctacaatgcaaccaacagcaacatcaaagaggtttttaactgaagactctatgctctgtagttctttccacaaagagctgactgatatttgaagaagtgttttcatctatccaagaaaaatatgatgtctccatcccaagcctcactcttattcttaaatgtatgtatttttatttgtggagaagctgtacaaggtaactgtgtacatcattctacggactcttcagtagttaacattgtagaagatggatctaatgcaaaagatgaaagtaaaagtaatgatactgtttgtaaggaagactgtgaggaatcatgtgatgttaaaactaaaattacacgagaagaaaaacatttcatgtgtagaaatttgcaaaattctattgtttcctacacaagaagtaccaaaaaactactaaggaatatgatggatgagcaacaagcttccttggattatttatctaatcaggttaacgagctcatgaatagagttctccttttgactacagaagtttttagaaaacagctggatccttttcctcacagacctgttcagtcacatggtttagattgcactgatattaaggataccattggctctgtcaccaaaacaccgagtggtttatacataattcacccagaaggatctagctacccatttgaggtaatgtgtgacatggattacagaggaggtggacggactgtgatacagaaaagaattgatgggataattgatttccagaggttgtggtgtgattatctggatggatttggagatcttctaggagaattttggctaggactgaaaaagattttttatatagtaaatcagaaaaataccagttttatgctgtatgtggctttggaatctgaagatgacactcttgcttatgcatcatatgataatttttggctagaggatgaaacgagattttttaaaatgcacttaggacggtattcaggaaatgctggtgatgcattccggggtctcaaaaaagaagataatcaaaatgcaatgccttttagcacatcagatgttgataatgatgggtgtcgccctgcatgcctggtcaatggtcagtctgtgaagagctgcagtcacctccataacaagaccggctggtggtttaacgagtgtggtctagcaaatctaaatggcattcatcacttctctggaaaattgcttgcaactggaattcaatggggcacgtggaccaaaaacaactcacctgtcaagattaaatctgtttcaatgaaaattagaagaatgtacaatccatattttaaataatctcatttaacattgtaatgcaagttctacaatgataatatattaaagatttttaaaagtttatcttttcacttagtgtttcaaacatattaggcaaaatttaactgtagatggcatttagatgttatgagtttaattagaaaacttcaattttgtagtattctataaaagaaaacatggcttattgtatgtttttacttctgactatattaacaatatacaatgaaatttgtttcaagtgaactacaacttgtcttcctaaaatttatagtgattttaaaggattttgccttttctttgaagcatttttaaaccataatatgttgtaaggaaaattgaagggaatattttacttatttttatactttatatgattatataatctacagataatttctactgaagacagttacaataaataactttatgcagattaatatataagctacacatgatgtaaaaaccttactatttctaggtgatgccataccattttaaaagtagtaagagtttgctgcccaaatagtttttcttgttttcatatctaatcatggttaactattttgttattgtttgtaataaatatatgtacttttatatcctga

SEQ ID NO: 107246 - DNA, 601 bp, Homo sapiens
  Payload ID: 1053
  Gene Symbol: ANGPTL5
  Gene Name: angiopoietin-like 5
  ENST ID: ENST00000534527
  CDS Start-End: 26-601
gtgttttcatctatccaagaaaaatatgatgtctccatcccaagcctcactcttattcttaaatgtatgtatttttatttgtggagaagctgtacaaggtaactgtgtacatcattctacggactcttcagtagttaacattgtagaagatggatctaatgcaaaagatgaaagtaaaagtaatgatactgtttgtaaggaagactgtgaggaatcatgtgatgttaaaactaaaattacacgagaagaaaaacatttcatgtgtagaaatttgcaaaattctattgtttcctacacaagaagtaccaaaaaactactaaggaatatgatggatgagcaacaagcttccttggattatttatctaatcaggtaatgtgtgacatggattacagaggaggtggacggactgtgatacagaaaagaattgatgggataattgatttccagaggttgtggtgtgattatctggatggatttggagatcttctaggagaattttggctaggactgaaaaagattttttatatagtaaatcagaaaaataccagttttatgctgtatgtggctttggaatctgaagatgacactcttgcttatgca

SEQ ID NO: 107247 - DNA, 1900 bp, Homo sapiens
  Payload ID: 1054
  Gene Symbol: ANGPTL6
  Gene Name: angiopoietin-like 6
  Uniprot ID: Q8NI99
  ENST ID: ENST00000253109
  CDS Start-End: 240-1652
ctcattcgggaaatgctaaatatttatagtttgggctcctgggcccagcatcccagctccactcccaggctctgggggctggggagtggttaccaagcctcctctctccttctgtcccactgccctctccccgtctctagctcagaggccccactggaccctcggctcttccttggacttcttgtgtgttctgtgagcttcgctggattcagggtcttgggcatcagaggtccgccgcgatggggaagccctggctgcgtgcgctacagctgctgctcctgctgggcgcgtcgtgggcgcgggcgggcgccccgcgctgcacctacaccttcgtgctgcccccgcagaagttcacgggcgctgtgtgctggagcggccccgcatccacgcgggcgacgcccgaggccgccaacgccagcgagctggcggcgctgcgcatgcgcgtcggccgccacgaggagctgttacgcgagctgcagaggctggcggcggccgacggcgccgtggccggcgaggtgcgcgcgctgcgcaaggagagccgcggcctgagcgcgcgcctgggccagttgcgcgcgcagctgcagcacgaggcggggcccggggcgggcccgggggcggatctgggggcggagcctgccgcggcgctggcgctgctcggggagcgcgtgctcaacgcgtccgccgaggctcagcgcgcagccgcccggttccaccagctggacgtcaagttccgcgagctggcgcagctcgtcacccagcagagcagtctcatcgcccgcctggagcgcctgtgcccgggaggcgcgggcgggcagcagcaggtcctgccgccacccccactggtgcctgtggttccggtccgtcttgtgggtagcaccagtgacaccagtaggatgctggacccagccccagagccccagagagaccagacccagagacagcaggagcccatggcttctcccatgcctgcaggtcaccctgcggtccccaccaagcctgtgggcccgtggcaggattgtgcagaggcccgccaggcaggccatgaacagagtggagtgtatgaactgcgagtgggccgtcacgtagtgtcagtatggtgtgagcagcaactggagggtggaggctggactgtgatccagcggaggcaagatggttcagtcaacttcttcactacctggcagcactataaggcgggctttgggcggccagacggagaatactggctgggccttgaacccgtgtatcagctgaccagccgtggggaccatgagctgctggttctcctggaggactgggggggccgtggagcacgtgcccactatgatggcttctccctggaacccgagagcgaccactaccgcctgcggcttggccagtaccatggtgatgctggagactctctttcctggcacaatgacaagcccttcagcaccgtggatagggaccgagactcctattctggtaactgtgccctgtaccagcggggaggctggtggtaccatgcctgtgcccactccaacctcaacggtgtgtggcaccacggcggccactaccgaagccgctaccaggatggtgtctactgggctgagtttcgtggtggggcatattctctcaggaaggccgccatgctcattcggcccctgaagctgtgactctgtgttcctctgtcccctaggccctagaggacattggtcagcaggagcccaagttgttctggccacaccttctttgtggctcagtgccaatgtgtcccacagaacttcccactgtggatctgtgaccctgggcgctgaaaatgggacccaggaatcccccccgtcaatatcttggcctcagatggctccccaaggtcattcatatctcggtttgagctcatatcttataataacacaaagtagcc

SEQ ID NO: 107248 - DNA, 1579 bp, Homo sapiens
  Payload ID: 1054
  Gene Symbol: ANGPTL6
  Gene Name: angiopoietin-like 6
  ENST ID: ENST00000589181
  CDS Start-End: 36-1328
ccttccgttcctcctctgcctgcaggtccgccgcgatggggaagccctggctgcgtgcgctacagctgctgctcctgctgggcgcgtcgtgggcgcgggcgggcgccccgcgctgcacctacaccttcgtgctgcccccgcagaagttcacgggcgctgtgtgctggagcggccccgcatccacgcgggcgacgcccgaggccgccaacgccagcgagctggcggcgctgcgcatgcgcgtcggccgccacgaggagctgttacgcgagctgcagaggctggcggcggccgacggcgccgtggccggcgaggtgcgcgcgctgcgcaaggagagccgcggcctgagcgcgcgcctgggccagttgcgcgcgcagctgcagcacgaggcggggcccggggcgggcccgggggcggatctgggggcggagcctgccgcggcgctggcgctgctcggggagcgcgtgctcaacgcgtccgccgaggctcagcgcgcagccgcccggttccaccagctggacgtcaagttccgcgagctggcgcagctcgtcacccagcagagcagtctcatcgcccgcctggagcgcctgtgcccgggaggcgcgggcgggcagcagcaggtcctgccgccacccccactggtgcctgtggttccggtccgtcttgtgggtagcaccagtgacaccagtaggatgctggacccagccccagagccccagagagaccagacccagagacagcaggagcccatggcttctcccatgcctgcaggtcaccctgcggtccccaccaagcctgtgggcccgtggcaggattgtgcagaggcccgccaggcaggccatgaacagagtggagtgtatgaactgcgagcgggctttgggcggccagacggagaatactggctgggccttgaacccgtgtatcagctgaccagccgtggggaccatgagctgctggttctcctggaggactgggggggccgtggagcacgtgcccactatgatggcttctccctggaacccgagagcgaccactaccgcctgcggcttggccagtaccatggtgatgctggagactctctttcctggcacaatgacaagcccttcagcaccgtggatagggaccgagactcctattctggtaactgtgccctgtaccagcggggaggctggtggtaccatgcctgtgcccactccaacctcaacggtgtgtggcaccacggcggccactaccgaagccgctaccaggatggtgtctactgggctgagtttcgtggtggggcatattctctcaggaaggccgccatgctcattcggcccctgaagctgtgactctgtgttcctctgtcccctaggccctagaggacattggtcagcaggagcccaagttgttctggccacaccttctttgtggctcagtgccaatgtgtcccacagaacttcccactgtggatctgtgaccctgggcgctgaaaatgggacccaggaatcccccccgtcaatatcttggcctcagatggctccccaaggtcattcatatctcggtttgagctcatatcttataataacacaaagtagccaca

SEQ ID NO: 107249 - DNA, 1781 bp, Homo sapiens
  Payload ID: 1054
  Gene Symbol: ANGPTL6
  Gene Name: angiopoietin-like 6
  Uniprot ID: Q8NI99
  ENST ID: ENST00000592641
  CDS Start-End: 119-1531
tagctcagaggccccactggaccctcggctcttccttggacttcttgtgtgttctgtgagcttcgctggattcagggtcttgggcatcagaggtgagagggtgggaaggtccgccgcgatggggaagccctggctgcgtgcgctacagctgctgctcctgctgggcgcgtcgtgggcgcgggcgggcgccccgcgctgcacctacaccttcgtgctgcccccgcagaagttcacgggcgctgtgtgctggagcggccccgcatccacgcgggcgacgcccgaggccgccaacgccagcgagctggcggcgctgcgcatgcgcgtcggccgccacgaggagctgttacgcgagctgcagaggctggcggcggccgacggcgccgtggccggcgaggtgcgcgcgctgcgcaaggagagccgcggcctgagcgcgcgcctgggccagttgcgcgcgcagctgcagcacgaggcggggcccggggcgggcccgggggcggatctgggggcggagcctgccgcggcgctggcgctgctcggggagcgcgtgctcaacgcgtccgccgaggctcagcgcgcagccgcccggttccaccagctggacgtcaagttccgcgagctggcgcagctcgtcacccagcagagcagtctcatcgcccgcctggagcgcctgtgcccgggaggcgcgggcgggcagcagcaggtcctgccgccacccccactggtgcctgtggttccggtccgtcttgtgggtagcaccagtgacaccagtaggatgctggacccagccccagagccccagagagaccagacccagagacagcaggagcccatggcttctcccatgcctgcaggtcaccctgcggtccccaccaagcctgtgggcccgtggcaggattgtgcagaggcccgccaggcaggccatgaacagagtggagtgtatgaactgcgagtgggccgtcacgtagtgtcagtatggtgtgagcagcaactggagggtggaggctggactgtgatccagcggaggcaagatggttcagtcaacttcttcactacctggcagcactataaggcgggctttgggcggccagacggagaatactggctgggccttgaacccgtgtatcagctgaccagccgtggggaccatgagctgctggttctcctggaggactgggggggccgtggagcacgtgcccactatgatggcttctccctggaacccgagagcgaccactaccgcctgcggcttggccagtaccatggtgatgctggagactctctttcctggcacaatgacaagcccttcagcaccgtggatagggaccgagactcctattctggtaactgtgccctgtaccagcggggaggctggtggtaccatgcctgtgcccactccaacctcaacggtgtgtggcaccacggcggccactaccgaagccgctaccaggatggtgtctactgggctgagtttcgtggtggggcatattctctcaggaaggccgccatgctcattcggcccctgaagctgtgactctgtgttcctctgtcccctaggccctagaggacattggtcagcaggagcccaagttgttctggccacaccttctttgtggctcagtgccaatgtgtcccacagaacttcccactgtggatctgtgaccctgggcgctgaaaatgggacccaggaatcccccccgtcaatatcttggcctcagatggctccccaaggtcattcatatctcggtttgagctcatatcttataataacacaaagtagccac

SEQ ID NO: 107250 - DNA, 2238 bp, Homo sapiens
  Payload ID: 1055
  Gene Symbol: ANGPTL7
  Gene Name: angiopoietin-like 7
  Uniprot ID: O43827
  ENST ID: ENST00000376819
  CDS Start-End: 240-1280
cttgtggagcattcgggcttggaaggaaagctataggctacccattcagctcccctgtcagagactcaagctttgagaaaggctagcaaagagcaaggaaagagagaaaacaacaaagtggcgaggccctcagagtgaaagcgtaaggttcagtcagcctgctgcagctttgcagacctcagctgggcatctccagactcccctgaaggaagagccttcctcacccaaacccacaaaagatgctgaaaaagcctctctcagctgtgacctggctctgcattttcatcgtggcctttgtcagccacccagcgtggctgcagaagctctctaagcacaagacaccagcacagccacagctcaaagcggccaactgctgtgaggaggtgaaggagctcaaggcccaagttgccaaccttagcagcctgctgagtgaactgaacaagaagcaggagagggactgggtcagcgtggtcatgcaggtgatggagctggagagcaacagcaagcgcatggagtcgcggctcacagatgctgagagcaagtactccgagatgaacaaccaaattgacatcatgcagctgcaggcagcacagacggtcactcagacctccgcagatgccatctacgactgctcttccctctaccagaagaactaccgcatctctggagtgtataagcttcctcctgatgacttcctgggcagccctgaactggaggtgttctgtgacatggagacttcaggcggaggctggaccatcatccagagacgaaaaagtggccttgtctccttctaccgggactggaagcagtacaagcagggctttggcagcatccgtggggacttctggctggggaacgaacacatccaccggctctccagacagccaacccggctgcgtgtagagatggaggactgggagggcaacctgcgctacgctgagtatagccactttgttttgggcaatgaactcaacagctatcgcctcttcctggggaactacactggcaatgtggggaacgacgccctccagtatcataacaacacagccttcagcaccaaggacaaggacaatgacaactgcttggacaagtgtgcacagctccgcaaaggtggctactggtacaactgctgcacagactccaacctcaatggagtgtactaccgcctgggtgagcacaataagcacctggatggcatcacctggtatggctggcatggatctacctactccctcaaacgggtggagatgaaaatccgcccagaagacttcaagccttaaaaggaggctgccgtggagcacggatacagaaactgagacacgtggagactggatgagggcagatgaggacaggaagagagtgttagaaagggtaggactgagaaacagcctataatctccaaagaaagaataagtctccaaggagcacaaaaaaatcatatgtaccaaggatgttacagtaaacaggatgaactatttaaacccactgggtcctgccacatccttctcaaggtggtagactgagtggggtctctctgcccaagatccctgacatagcagtagcttgtcttttccacatgatttgtctgtgaaagaaaataattttgagatcgttttatctattttctctacggcttaggctatgtgagggcaaaacacaaatccctttgctaaaaagaaccatattattttgattctcaaaggataggcctttgagtgttagagaaaggagtgaaggaggcaggtgggaaatggtatttctatttttaaatccagtgaaattatcttgagtctacacattatttttaaaacacaaaaattgttcggctggaactgacccaggctggacttgcggggaggaaactccagggcactgcatctggcgatcagactctgagcactgcccctgctcgccttggtcatgtacagcactgaaaggaatgaagcaccagcaggaggtggacagagtctctcatggatgccggcacaaaactgccttaaaatattcatagttaatacaggtatatctatttttatttactttgtaagaaacaagctcaaggagcttccttttaaattttgtctgtaggaaatggttgaaaactgaaggtagatggtgttatagttaataataaatgctgtaaataagcatctcactttgtaaaaataaaatattgtggttttgttttaaacattcaacgtttcttttccttctacaataaacactttcaaaatgtga

SEQ ID NO: 107251 - DNA, 2479 bp, Homo sapiens
  Payload ID: 1056
  Gene Symbol: ACE
  Gene Name: angiotensin I converting enzyme
  Uniprot ID: P12821
  ENST ID: ENST00000290863
  CDS Start-End: 29-2227
agctgcaggactctgctctcctgcggccatgggccagggttgggctactgcaggacttcccagcctcctcttcctgctgctctgctacgggcaccctctgctggtccccagccaggaggcatcccaacaggtgacagtcacccatgggacaagcagccaggcaacaaccagcagccagacaaccacccaccaggcgacggcccaccagacatcagcccagagcccaaacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcactgcctgcccaggagctggaggagtacaacaagatcctgttggatatggaaaccacctacagcgtggccactgtgtgccacccgaatggcagctgcctgcagctcgagccagatctgacgaatgtgatggccacgtcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggtactttgtcagcttcatcatccagttccagttccacgaggcactgtgccaggcagctggccacacgggccccctgcacaagtgtgacatctaccagtccaaggaggccgggcagcgcctggcgaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccgctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcggctcttcagcatccgccaccgcagcctccaccggcactcccacgggccccagttcggctccgaggtggagctgagacactcctgaggtgacccggctgggtcggccctgcccaagggcctcccaccagagactgggatgggaacactggtgggcagctgaggacacaccccacaccccagcccaccctgctcctcctgccctgtccctgtccccctcccctcccagtcctccagaccaccagccgccccagccccttctcccagcacacggctgcctgacactgagccccacctctccaagtctctctgtgaatacaattaaaggtcctgccctccc

SEQ ID NO: 107252 - DNA, 4959 bp, Homo sapiens
  Payload ID: 1056
  Gene Symbol: ACE
  Gene Name: angiotensin I converting enzyme
  Uniprot ID: P12821
  ENST ID: ENST00000290866
  CDS Start-End: 25-3945
gagccgagcaccgcgcaccgcgtcatgggggccgcctcgggccgccgggggccggggctgctgctgccgctgccgctgctgttgctgctgccgccgcagcccgccctggcgttggaccccgggctgcagcccggcaacttttctgctgacgaggccggggcgcagctcttcgcgcagagctacaactccagcgccgaacaggtgctgttccagagcgtggccgccagctgggcgcacgacaccaacatcaccgcggagaatgcaaggcgccaggaggaagcagccctgctcagccaggagtttgcggaggcctggggccagaaggccaaggagctgtatgaaccgatctggcagaacttcacggacccgcagctgcgcaggatcatcggagctgtgcgcaccctgggctctgccaacctgcccctggctaagcggcagcagtacaacgccctgctaagcaacatgagcaggatctactccaccgccaaggtctgcctccccaacaagactgccacctgctggtccctggacccagatctcaccaacatcctggcttcctcgcgaagctacgccatgctcctgtttgcctgggagggctggcacaacgctgcgggcatcccgctgaaaccgctgtacgaggatttcactgccctcagcaatgaagcctacaagcaggacggcttcacagacacgggggcctactggcgctcctggtacaactcccccaccttcgaggacgatctggaacacctctaccaacagctagagcccctctacctgaacctccatgccttcgtccgccgcgcactgcatcgccgatacggagacagatacatcaacctcaggggacccatccctgctcatctgctgggagacatgtgggcccagagctgggaaaacatctacgacatggtggtgcctttcccagacaagcccaacctcgatgtcaccagtactatgctgcagcagggctggaacgccacgcacatgttccgggtggcagaggagttcttcacctccctggagctctcccccatgcctcccgagttctgggaagggtcgatgctggagaagccggccgacgggcgggaagtggtgtgccacgcctcggcttgggacttctacaacaggaaagacttcaggatcaagcagtgcacacgggtcacgatggaccagctctccacagtgcaccatgagatgggccatatacagtactacctgcagtacaaggatctgcccgtctccctgcgtcggggggccaaccccggcttccatgaggccattggggacgtgctggcgctctcggtctccactcctgaacatctgcacaaaatcggcctgctggaccgtgtcaccaatgacacggaaagtgacatcaattacttgctaaaaatggcactggaaaaaattgccttcctgccctttggctacttggtggaccagtggcgctggggggtctttagtgggcgtacccccccttcccgctacaacttcgactggtggtatcttcgaaccaagtatcaggggatctgtcctcctgttacccgaaacgaaacccactttgatgctggagctaagtttcatgttccaaatgtgacaccatacatcaggtactttgtgagttttgtcctgcagttccagttccatgaagccctgtgcaaggaggcaggctatgagggcccactgcaccagtgtgacatctaccggtccaccaaggcaggggccaagctccggaaggtgctgcaggctggctcctccaggccctggcaggaggtgctgaaggacatggtcggcttagatgccctggatgcccagccgctgctcaagtacttccagccagtcacccagtggctgcaggagcagaaccagcagaacggcgaggtcctgggctggcccgagtaccagtggcacccgccgttgcctgacaactacccggagggcatagacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcactgcctgcccaggagctggaggagtacaacaagatcctgttggatatggaaaccacctacagcgtggccactgtgtgccacccgaatggcagctgcctgcagctcgagccagatctgacgaatgtgatggccacgtcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggtactttgtcagcttcatcatccagttccagttccacgaggcactgtgccaggcagctggccacacgggccccctgcacaagtgtgacatctaccagtccaaggaggccgggcagcgcctggcgaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccgctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcggctcttcagcatccgccaccgcagcctccaccggcactcccacgggccccagttcggctccgaggtggagctgagacactcctgaggtgacccggctgggtcggccctgcccaagggcctcccaccagagactgggatgggaacactggtgggcagctgaggacacaccccacaccccagcccaccctgctcctcctgccctgtccctgtccccctcccctcccagtcctccagaccaccagccgccccagccccttctcccagcacacggctgcctgacactgagccccacctctccaagtctctctgtgaatacaattaaaggtcctgccctccccatctgagtctgtgtccctcacagggaagccagggacagggacaggctgctttcctgcctcctggcagtcaagtgggtcccgttactaggtttgttcctccatcctccttcaggagccggggaggatccccagagctctgccccagcacctcctggcgctggcgcctgtcttccctccagcccaggcagcccgccactgtcctgccaccgcaggcagcccctgtctggcccaagcactgacccacgcggactctgggaagcagacatcctgggctgctggcctcacatttccactggcagtggagcctttccctgctccacaaatggccaggtccccccaggggaaggcttccggctgttatcggctgcctcagggggcgagtaccttggagggcctgcttcaaggagggtgccccctggagggcacacaccagcctagtgcttaccttggctcctgcctgtaccagctccatgactctgctcgggtgaacagccttggctctcagacagccattctaacactgccagtgcagaggggcctcagacgctggagtgtagcagtggctgcacctgcacagggattagctgccagcagccaccctgctggcgtcccagcacacacctcctcactccctgcattggagggagtgtcattttaagggacatttttatgacttttatgtgtatgtttatgtagaaatttggaaaatacagaaaactgtaaagaaaataaaagccctttatatcaacgtcaagagataa

SEQ ID NO: 107253 - DNA, 2237 bp, Homo sapiens
  Payload ID: 1056
  Gene Symbol: ACE
  Gene Name: angiotensin I converting enzyme
  Uniprot ID: P12821
  ENST ID: ENST00000413513
  CDS Start-End: 23-2098
aggactctgctctcctgcggccatgggccagggttgggctactgcaggacttcccagcctcctcttcctgctgctctgctacgggcaccctctgctggtccccagccaggaggcatcccaacaggtgacagtcacccatgggacaagcagccaggcaacaaccagcagccagacaaccacccaccaggcgacggcccaccagacatcagcccagagcccaaacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcactgcctgcccaggagctggaggagtacaacaagatcctgttggatatggaaaccacctacagcgtggccactgtgtgccacccgaatggcagctgcctgcagctcgagccagatctgacgaatgtgatggccacgtcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccgctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcggctcttcagcatccgccaccgcagcctccaccggcactcccacgggccccagttcggctccgaggtggagctgagacactcctgaggtgacccggctgggtcggccctgcccaagggcctcccaccagagactgggatgggaacactggtgggcagctgaggacacaccccacaccccagcccaccctgctcctcctgccctgtccctgtccccctcccctccc

SEQ ID NO: 107254 - DNA, 5120 bp, Homo sapiens
  Payload ID: 1056
  Gene Symbol: ACE
  Gene Name: angiotensin I converting enzyme
  ENST ID: ENST00000428043
  CDS Start-End: 35-3763
agaaggggcagagccgagcaccgcgcaccgcgtcatgggggccgcctcgggccgccgggggccggggctgctgctgccgctgccgctgctgttgctgctgccgccgcagcccgccctggcgttggaccccgggctgcagcccggcaacttttctgctgacgaggccggggcgcagctcttcgcgcagagctacaactccagcgccgaacaggtgctgttccagagcgtggccgccagctgggcgcacgacaccaacatcaccgcggagaatgcaaggcgccaggaggaagcagccctgctcagccaggagtttgcggaggcctggggccagaaggccaaggagctgtatgaaccgatctggcagaacttcacggacccgcagctgcgcaggatcatcggagctgtgcgcaccctgggctctgccaacctgcccctggctaagcggcagcagtacaacgccctgctaagcaacatgagcaggatctactccaccgccaaggtctgcctccccaacaagactgccacctgctggtccctggacccagatctcaccaacatcctggcttcctcgcgaagctacgccatgctcctgtttgcctgggagggctggcacaacgctgcgggcatcccgctgaaaccgctgtacgaggatttcactgccctcagcaatgaagcctacaagcaggacggcttcacagacacgggggcctactggcgctcctggtacaactcccccaccttcgaggacgatctggaacacctctaccaacagctagagcccctctacctgaacctccatgccttcgtccgccgcgcactgcatcgccgatacggagacagatacatcaacctcaggggacccatccctgctcatctgctgggagacatgtgggcccagagctgggaaaacatctacgacatggtggtgcctttcccagacaagcccaacctcgatgtcaccagtactatgctgcagcagggctggaacgccacgcacatgttccgggtggcagaggagttcttcacctccctggagctctcccccatgcctcccgagttctgggaagggtcgatgctggagaagccggccgacgggcgggaagtggtgtgccacgcctcggcttgggacttctacaacaggaaagacttcaggatcaagcagtgcacacgggtcacgatggaccagctctccacagtgcaccatgagatgggccatatacagtactacctgcagtacaaggatctgcccgtctccctgcgtcggggggccaaccccggcttccatgaggccattggggacgtgctggcgctctcggtctccactcctgaacatctgcacaaaatcggcctgctggaccgtgtcaccaatgacacggaaagtgacatcaattacttgctaaaaatggcactggaaaaaattgccttcctgccctttggctacttggtggaccagtggcgctggggggtctttagtgggcgtacccccccttcccgctacaacttcgactggtggtatcttcgaaccaagtatcaggggatctgtcctcctgttacccgaaacgaaacccactttgatgctggagctaagtttcatgttccaaatgtgacaccatacatcaggtactttgtgagttttgtcctgcagttccagttccatgaagccctgtgcaaggaggcaggctatgagggcccactgcaccagtgtgacatctaccggtccaccaaggcaggggccaagctccggaaggtgctgcaggctggctcctccaggccctggcaggaggtgctgaaggacatggtcggcttagatgccctggatgcccagccgctgctcaagtacttccagccagtcacccagtggctgcaggagcagaaccagcagaacggcgaggtcctgggctggcccgagtaccagtggcacccgccgttgcctgacaactacccggagggcatagacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcactgcctgcccaggagctggaggagtacaacaagatcctgttggatatggaaaccacctacagcgtggccactgtgtgccacccgaatggcagctgcctgcagctcgagccagatctgacgaatgtgatggccacgtcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggtactttgtcagcttcatcatccagttccagttccacgaggcactgtgccaggcagctggccacacgggccccctgcacaagtgtgacatctaccagtccaaggaggccgggcagcgcctggcgaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccggtaccgccacccaccccacctccagccttgggtcttaaccccctccccaggctgggcagccatgcggctgacctcggagcctggccctgccccgcacccttgccctgccctgccctgccctgcccatgctgtctccttgcttcccgctcagctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcggctcttcagcatccgccaccgcagcctccaccggcactcccacgggccccagttcggctccgaggtggagctgagacactcctgaggtgacccggctgggtcggccctgcccaagggcctcccaccagagactgggatgggaacactggtgggcagctgaggacacaccccacaccccagcccaccctgctcctcctgccctgtccctgtccccctcccctcccagtcctccagaccaccagccgccccagccccttctcccagcacacggctgcctgacactgagccccacctctccaagtctctctgtgaatacaattaaaggtcctgccctccccatctgagtctgtgtccctcacagggaagccagggacagggacaggctgctttcctgcctcctggcagtcaagtgggtcccgttactaggtttgttcctccatcctccttcaggagccggggaggatccccagagctctgccccagcacctcctggcgctggcgcctgtcttccctccagcccaggcagcccgccactgtcctgccaccgcaggcagcccctgtctggcccaagcactgacccacgcggactctgggaagcagacatcctgggctgctggcctcacatttccactggcagtggagcctttccctgctccacaaatggccaggtccccccaggggaaggcttccggctgttatcggctgcctcagggggcgagtaccttggagggcctgcttcaaggagggtgccccctggagggcacacaccagcctagtgcttaccttggctcctgcctgtaccagctccatgactctgctcgggtgaacagccttggctctcagacagccattctaacactgccagtgcagaggggcctcagacgctggagtgtagcagtggctgcacctgcacagggattagctgccagcagccaccctgctggcgtcccagcacacacctcctcactccctgcattggagggagtgtcattttaagggacatttttatgacttttatgtgtatgtttatgtagaaatttggaaaatacagaaaactgtaaagaaaataaaagccctttatatcaacgtcaagagataa

SEQ ID NO: 107255 - DNA, 982 bp, Homo sapiens
  Payload ID: 1056
  Gene Symbol: ACE
  Gene Name: angiotensin I converting enzyme
  ENST ID: ENST00000582005
  CDS Start-End: 25-462
gcaggactctgctctcctgcggccatgggccagggttgggctactgcaggacttcccagcctcctcttcctgctgctctgctacgggcaccctctgctggtccccagccaggaggcatcccaacaggtgacagtcacccatgggacaagcagccaggcaacaaccagcagccagacaaccacccaccaggcgacggcccaccagacatcagcccagagcccaaacctggtgactgatgaggctgaggccagcaagtttgtggaggaatatgaccggacatcccaggtggtgtggaacgagtatgccgaggccaactggaactacaacaccaacatcaccacagagaccagcaagattctgggcctttacgacacttgggggtcttctcttctctgcccctgcctggatatgtgttgcttgaccgcaggcatccagggaggctgcagaagaacatgcaaatagccaaccacaccctgaagtacggcacccaggccaggaagtttgatgtgaaccagttgcagaacaccactatcaagcggatcataaagaaggttcaggacctagaacgggcagcactgcctgcccaggagctggaggagtacaacaagatcctgttggatatggaaaccacctacagcgtggccactgtgtgccacccgaatggcagctgcctgcagctcgagccagatctgacgaatgtgatggccacgtcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggccca

SEQ ID NO: 107256 - DNA, 1881 bp, Homo sapiens
  Payload ID: 1056
  Gene Symbol: ACE
  Gene Name: angiotensin I converting enzyme
  ENST ID: ENST00000578839
  CDS Start-End: 23-133
aggactctgctctcctgcggccatgggccagggttgggctactgcaggacttcccagcctcctcttcctgctgctctgctacgggcaccctctgctggtccccagccaggaggcatcccaacagacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcactgcctgcccaggagctggaggagtacaacaagatcctgttggatatggaaaccacctacagcgtggccactgtgtgccacccgaatggcagctgcctgcagctcgagccagatctgacgaatgtgatggccacgtcccggaaatatgaagacctgttatgggcatgggagggctggcgagacaaggcggggagagccatcctccagttttacccgaaatacgtggaactcatcaaccaggctgcccggctcaatgggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccgctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcggctcttcagcatccgccaccgcagcctccaccggcactcccacgggccccagttcggctccgaggtggagctgagacactcctgaggtgacccggctgggtcggccctgcccaagggcctcccaccagagactgggatgggaacactggtgggcagc

SEQ ID NO: 107257 - DNA, 1002 bp, Homo sapiens
  Payload ID: 1056
  Gene Symbol: ACE
  Gene Name: angiotensin I converting enzyme
  ENST ID: ENST00000582627
  CDS Start-End: 61-1002
ccgcggggcccgagcgccgggctgcgcgcacggcctgcgctcccagcatgcacgagttggatggatgagggtggctgctcccaggccgcgcccgccttcgccgaaggtgctgggcttggctctggggcccccgcgctctcgggcagctgccttctcacctccggacgctgtcgctgtcaccgtcaccgcactgcactgtccatccaccctccactcgcccggcctcttttctggtcccaatttctgctccaccattcccatgaggcagattccctccagaaggaggaagcgcggcttccgcaaactaaggaggaagcagccctgctcagccaggagtttgcggaggcctggggccagaaggccaaggagctgtatgaaccgatctggcagaacttcacggacccgcagctgcgcaggatcatcggagctgtgcgcaccctgggctctgccaacctgcccctggctaagcggcagcagtacaacgccctgctaagcaacatgagcaggatctactccaccgccaaggtctgcctccccaacaagactgccacctgctggtccctggacccagatctcaccaacatcctggcttcctcgcgaagctacgccatgctcctgtttgcctgggagggctggcacaacgctgcgggcatcccgctgaaaccgctgtacgaggatttcactgccctcagcaatgaagcctacaagcaggacggcttcacagacacgggggcctactggcgctcctggtacaactcccccaccttcgaggacgatctggaacacctctaccaacagctagagcccctctacctgaacctccatgccttcgtccgccgcgcactgcatcgccgatacggagacagatacatcaacctcaggggacccatccctgctcatctgctgggagacatgtgggcccagagctgggaaaacatctacgacatggtggtgcctttcccagacaagcccaacctcgatgtcaccagtactatgctgcag

SEQ ID NO: 107258 - DNA, 2551 bp, Homo sapiens
  Payload ID: 1056
  Gene Symbol: ACE
  Gene Name: angiotensin I converting enzyme
  ENST ID: ENST00000579314
  CDS Start-End: 23-649
aggactctgctctcctgcggccatgggccagggttgggctactgcaggacttcccagcctcctcttcctgctgctctgctacgggcaccctctgctggtccccagccaggaggcatcccaacaggtgacagtcacccatgggacaagcagccaggcaacaaccagcagccagacaaccacccaccaggcgacggcccaccagacatcagcccagagcccaaacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcactgcctgcccaggagctggaggagtacaacaagatcctgttggatatggaaaccacctacagcgtggccactgtgtgccacccgaatggcagctgcctgcagctcgagccagctctgaaattctctgagctccccttacaagcagaggtgagctaagggctggagctcaaggcattcaaacccctaccagatctgacgaatgtgatggccacgtcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggtactttgtcagcttcatcatccagttccagttccacgaggcactgtgccaggcagctggccacacgggccccctgcacaagtgtgacatctaccagtccaaggaggccgggcagcgcctggcgaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccgctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcggctcttcagcatccgccaccgcagcctccaccggcactcccacgggccccagttcggctccgaggtggagctgagacactcctgaggtgacccggctgggtcggccctgcccaagggcctcccaccagagactgggatgggaacactggtgggcagctgaggacacaccccacaccccagcccaccctgctcctcctgccctgtccctgtccccctcccctcccagtcctccagaccaccagccgccccagccccttctcccagcacacggctgcctgacactgagccccacctctccaagtctctctgtgaatacaattaaaggtcctgccctccc

SEQ ID NO: 107259 - DNA, 846 bp, Homo sapiens
  Payload ID: 1056
  Gene Symbol: ACE
  Gene Name: angiotensin I converting enzyme
  ENST ID: ENST00000582761
  CDS Start-End: 1-846
ttggatatggaaaccacctacagcgtggccactgtgtgccacccgaatggcagctgcctgcagctcgagccagatctgacgaatgtgatggccacgtcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgccc

SEQ ID NO: 107260 - DNA, 2398 bp, Homo sapiens
  Payload ID: 1056
  Gene Symbol: ACE
  Gene Name: angiotensin I converting enzyme
  ENST ID: ENST00000582678
  CDS Start-End: 35-541
agaaggggcagagccgagcaccgcgcaccgcgtcatgggggccgcctcgggccgccgggggccggggctgctgctgccgctgccgctgctgttgctgctgccgccgcagcccgccctggcgttggaccccgggctgcagcccggcaacttttctgctgacgaggccggggcgcagctcttcgcgcagagctacaactccagcgccgaacaggtgctgttccagagcgtggccgccagctgggcgcacgacaccaacatcaccgcggagaatgcaaggcgccaggaggaagcagccctgctcagccaggagtttgcggaggcctggggccagaaggccaaggagctgtatgaaccgatctggcagaacttcacggacccgcagctgcgcaggatcatcggagctgtgcgcaccctgggctctgccaacctgcccctggctaagcggcagcagatctcaccaacatcctggcttcctcgcgaagctacgccatgctcctgtttgcctgggagggctggcacaacgctgcgggcatcccgctgaaaccgctgtacgaggatttcactgccctcagcaatgaagcctacaagcaggacggcttcacagacacgggggcctactggcgctcctggtacaactcccccaccttcgaggacgatctggaacacctctaccaacagctagagcccctctacctgaacctccatgccttcgtccgccgcgcactgcatcgccgatacggagacagatacatcaacctcaggggacccatccctgctcatctgctgggagacatgtgggcccagagctgggaaaacatctacgacatggtggtgcctttcccagacaagcccaacctcgatgtcaccagtactatgctgcagcagggctggaacgccacgcacatgttccgggtggcagaggagttcttcacctccctggagctctcccccatgcctcccgagttctgggaagggtcgatgctggagaagccggccgacgggcgggaagtggtgtgccacgcctcggcttgggacttctacaacaggaaagacttcaggatcaagcagtgcacacgggtcacgatggaccagctctccacagtgcaccatgagatgggccatatacagtactacctgcagtacaaggatctgcccgtctccctgcgtcggggggccaaccccggcttccatgaggccattggggacgtgctggcgctctcggtctccactcctgaacatctgcacaaaatcggcctgctggaccgtgtcaccaatgacacggaaagtgacatcaattacttgctaaaaatggcactggaaaaaattgccttcctgccctttggctacttggtggaccagtggcgctggggggtctttagtgggcgtacccccccttcccgctacaacttcgactggtggtatcttcgaaccaagtatcaggggatctgtcctcctgttacccgaaacgaaacccactttgatgctggagctaagtttcatgttccaaatgtgacaccatacatcaggtactttgtgagttttgtcctgcagttccagttccatgaagccctgtgcaaggaggcaggctatgagggcccactgcaccagtgtgacatctaccggtccaccaaggcaggggccaagctccggaaggtgctgcaggctggctcctccaggccctggcaggaggtgctgaaggacatggtcggcttagatgccctggatgcccagccgctgctcaagtacttccagccagtcacccagtggctgcaggagcagaaccagcagaacggcgaggtcctgggctggcccgagtaccagtggcacccgccgttgcctgacaactacccggagggcatagacctggtgactgatgaggctgaggccagcaagtttgtggaggaatatgaccggacatcccaggtggtgtggaacgagtatgccgaggccaactggaactacaacaccaacatcaccacagagaccagcaagattctggtgggagccacctccccacccccaaacctgagcatgtgcatacacacagagatgctgtcccgctcaccacacagtggggctgccaccacattttaaattgaatatttaaaacaatactcaatttcgggccgggcgcggtggctcacgcctgtaatcccagcactttgggagggggaggcgggcggatcacgaggtcagatcaagaccatcctggctaacacggtgaaaccccatctctagtaaaaatacaaaaattagccgggtgtggtggcgagcacctgtagtcccagtactcaggaggctgaggcaggagaatggcatgaacccgggaggcagagcttgcagtgagccgagatggcaccactgcactccagcctgggcgacagagcgagactccatc

SEQ ID NO: 107261 - DNA, 867 bp, Homo sapiens
  Payload ID: 1056
  Gene Symbol: ACE
  Gene Name: angiotensin I converting enzyme
  ENST ID: ENST00000579726
  CDS Start-End: 1-359
tgcaggctggctcctccaggccctggcaggaggtgctgaaggacatggtcggcttagatgccctggatgcccagccgctgctcaagtacttccagccagtcacccagtggctgcaggagcagaaccagcagaacggcgaggtcctgggctggcccgagtaccagtggcacccgccgttgcctgacaactacccggagggcataggtgacagtcacccatgggacaagcagccaggcaacaaccagcagccagacaaccacccaccaggcgacggcccaccagacatcagcccagagcccaagtgggaccatgcaggggaggggcagggtgccaggggtgggagaggcggggccgggtagggacagggcagggtacaagggagtgcgagagggataatggcttctggtgagaccacaaacctggagaggggaggcagaggtttgtctgtttccctgcactctgtcccacagacctggtgactgatgaggctgaggccagcaagtttgtggaggaatatgaccggacatcccaggtggtgtggaacgagtatgccgaggccaactggaactacaacaccaacatcaccacagagaccagcaagattctggcatccagggaggctgcagaagaacatgcaaatagccaaccacaccctgaagtacggcacccaggccaggaagtttgatgtgaaccagttgcagaacaccactatcaagcggatcataaagaaggttcaggacctagaacgggcagcactgcctgcccaggagctggaggagtacaacaagatcctgttggatatggaaaccacctacagcgtggccactgtgtgccacccgaatggcagctgcctgcagctcgagccag

SEQ ID NO: 107262 - DNA, 546 bp, Homo sapiens
  Payload ID: 1056
  Gene Symbol: ACE
  Gene Name: angiotensin I converting enzyme
  ENST ID: ENST00000579409
  CDS Start-End: 1-416
ccaggactcaaggtgactttgacccaggggccaagttccacattccttctagcgtgccttacatcaggtactttgtcagcttcatcatccagttccagttccacgaggcactgtgccaggcagctggccacacgggccccctgcacaagtgtgacatctaccagtccaaggaggccgggcagcgcctggcgaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccggtaccgccacccaccccacctccagccttgggtcttaaccccctccccaggctgggcagccatgcggctgacctcggagcctggccctgccccgcacccttgccctgccctgccctgccctgcccatgctgtctccttgcttcccgctcagctcgctcagaagggccc

SEQ ID NO: 107263 - DNA, 808 bp, Homo sapiens
  Payload ID: 1056
  Gene Symbol: ACE
  Gene Name: angiotensin I converting enzyme
  ENST ID: ENST00000579204
  CDS Start-End: 1-111
atgggccagggttgggctactgcaggacttcccagcctcctcttcctgctgctctgctacgggcaccctctgctggtccccagccaggaggcatcccaacagacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcactgcctgcccaggagctggaggagtacaacaagatcctgttggatatggaaaccacctacagcgtggccactgtgtgccacccgaatggcagctgcctgcagctcgagccagctctgaaattctctgagctccccttacaagcagaggtgagctaagggctggagctcaaggcattcaaacccctaccagatctgacgaatgtgatggccacgtcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacct

SEQ ID NO: 107264 - DNA, 3393 bp, Homo sapiens
  Payload ID: 1057
  Gene Symbol: ACE2
  Gene Name: angiotensin I converting enzyme 2
  Uniprot ID: Q9BYF1
  ENST ID: ENST00000252519
  CDS Start-End: 104-2521
cgcccaacccaagttcaaaggctgataagagagaaaatctcatgaggaggttttagtctagggaaagtcattcagtggatgtgatcttggctcacaggggacgatgtcaagctcttcctggctccttctcagccttgttgctgtaactgctgctcagtccaccattgaggaacaggccaagacatttttggacaagtttaaccacgaagccgaagacctgttctatcaaagttcacttgcttcttggaattataacaccaatattactgaagagaatgtccaaaacatgaataatgctggggacaaatggtctgcctttttaaaggaacagtccacacttgcccaaatgtatccactacaagaaattcagaatctcacagtcaagcttcagctgcaggctcttcagcaaaatgggtcttcagtgctctcagaagacaagagcaaacggttgaacacaattctaaatacaatgagcaccatctacagtactggaaaagtttgtaacccagataatccacaagaatgcttattacttgaaccaggtttgaatgaaataatggcaaacagtttagactacaatgagaggctctgggcttgggaaagctggagatctgaggtcggcaagcagctgaggccattatatgaagagtatgtggtcttgaaaaatgagatggcaagagcaaatcattatgaggactatggggattattggagaggagactatgaagtaaatggggtagatggctatgactacagccgcggccagttgattgaagatgtggaacatacctttgaagagattaaaccattatatgaacatcttcatgcctatgtgagggcaaagttgatgaatgcctatccttcctatatcagtccaattggatgcctccctgctcatttgcttggtgatatgtggggtagattttggacaaatctgtactctttgacagttccctttggacagaaaccaaacatagatgttactgatgcaatggtggaccaggcctgggatgcacagagaatattcaaggaggccgagaagttctttgtatctgttggtcttcctaatatgactcaaggattctgggaaaattccatgctaacggacccaggaaatgttcagaaagcagtctgccatcccacagcttgggacctggggaagggcgacttcaggatccttatgtgcacaaaggtgacaatggacgacttcctgacagctcatcatgagatggggcatatccagtatgatatggcatatgctgcacaaccttttctgctaagaaatggagctaatgaaggattccatgaagctgttggggaaatcatgtcactttctgcagccacacctaagcatttaaaatccattggtcttctgtcacccgattttcaagaagacaatgaaacagaaataaacttcctgctcaaacaagcactcacgattgttgggactctgccatttacttacatgttagagaagtggaggtggatggtctttaaaggggaaattcccaaagaccagtggatgaaaaagtggtgggagatgaagcgagagatagttggggtggtggaacctgtgccccatgatgaaacatactgtgaccccgcatctctgttccatgtttctaatgattactcattcattcgatattacacaaggaccctttaccaattccagtttcaagaagcactttgtcaagcagctaaacatgaaggccctctgcacaaatgtgacatctcaaactctacagaagctggacagaaactgttcaatatgctgaggcttggaaaatcagaaccctggaccctagcattggaaaatgttgtaggagcaaagaacatgaatgtaaggccactgctcaactactttgagcccttatttacctggctgaaagaccagaacaagaattcttttgtgggatggagtaccgactggagtccatatgcagaccaaagcatcaaagtgaggataagcctaaaatcagctcttggagataaagcatatgaatggaacgacaatgaaatgtacctgttccgatcatctgttgcatatgctatgaggcagtactttttaaaagtaaaaaatcagatgattctttttggggaggaggatgtgcgagtggctaatttgaaaccaagaatctcctttaatttctttgtcactgcacctaaaaatgtgtctgatatcattcctagaactgaagttgaaaaggccatcaggatgtcccggagccgtatcaatgatgctttccgtctgaatgacaacagcctagagtttctggggatacagccaacacttggacctcctaaccagccccctgtttccatatggctgattgtttttggagttgtgatgggagtgatagtggttggcattgtcatcctgatcttcactgggatcagagatcggaagaagaaaaataaagcaagaagtggagaaaatccttatgcctccatcgatattagcaaaggagaaaataatccaggattccaaaacactgatgatgttcagacctccttttagaaaaatctatgtttttcctcttgaggtgattttgttgtatgtaaatgttaatttcatggtatagaaaatataagatgataaagatatcattaaatgtcaaaactatgactctgttcagaaaaaaaattgtccaaagacaacatggccaaggagagagcatcttcattgacattgctttcagtatttatttctgtctctggatttgacttctgttctgtttcttaataaggattttgtattagagtatattagggaaagtgtgtatttggtctcacaggctgttcagggataatctaaatgtaaatgtctgttgaatttctgaagttgaaaacaaggatatatcattggagcaagtgttggatcttgtatggaatatggatggatcacttgtaaggacagtgcctgggaactggtgtagctgcaaggattgagaatggcatgcattagctcactttcatttaatccattgtcaaggatgacatgctttcttcacagtaactcagttcaagtactatggtgatttgcctacagtgatgtttggaatcgatcatgctttcttcaaggtgacaggtctaaagagagaagaatccagggaacaggtagaggacattgctttttcacttccaaggtgcttgatcaacatctccctgacaacacaaaactagagccaggggcctccgtgaactcccagagcatgcctgatagaaactcatttctactgttctctaactgtggagtgaatggaaattccaactgtatgttcaccctctgaagtgggtacccagtctcttaaatcttttgtatttgctcacagtgtttgagcagtgctgagcacaaagcagacactcaataaatgctagatttacacactc

SEQ ID NO: 107265 - DNA, 3507 bp, Homo sapiens
  Payload ID: 1057
  Gene Symbol: ACE2
  Gene Name: angiotensin I converting enzyme 2
  Uniprot ID: Q9BYF1
  ENST ID: ENST00000427411
  CDS Start-End: 218-2635
gttgttgtgatcccatggctacagaggatcaggagttgacatagatactctttggatttcataccatgtggaggctttcttacttccacgtgaccttgactgagttttgaatagcgcccaacccaagttcaaaggctgataagagagaaaatctcatgaggaggttttagtctagggaaagtcattcagtggatgtgatcttggctcacaggggacgatgtcaagctcttcctggctccttctcagccttgttgctgtaactgctgctcagtccaccattgaggaacaggccaagacatttttggacaagtttaaccacgaagccgaagacctgttctatcaaagttcacttgcttcttggaattataacaccaatattactgaagagaatgtccaaaacatgaataatgctggggacaaatggtctgcctttttaaaggaacagtccacacttgcccaaatgtatccactacaagaaattcagaatctcacagtcaagcttcagctgcaggctcttcagcaaaatgggtcttcagtgctctcagaagacaagagcaaacggttgaacacaattctaaatacaatgagcaccatctacagtactggaaaagtttgtaacccagataatccacaagaatgcttattacttgaaccaggtttgaatgaaataatggcaaacagtttagactacaatgagaggctctgggcttgggaaagctggagatctgaggtcggcaagcagctgaggccattatatgaagagtatgtggtcttgaaaaatgagatggcaagagcaaatcattatgaggactatggggattattggagaggagactatgaagtaaatggggtagatggctatgactacagccgcggccagttgattgaagatgtggaacatacctttgaagagattaaaccattatatgaacatcttcatgcctatgtgagggcaaagttgatgaatgcctatccttcctatatcagtccaattggatgcctccctgctcatttgcttggtgatatgtggggtagattttggacaaatctgtactctttgacagttccctttggacagaaaccaaacatagatgttactgatgcaatggtggaccaggcctgggatgcacagagaatattcaaggaggccgagaagttctttgtatctgttggtcttcctaatatgactcaaggattctgggaaaattccatgctaacggacccaggaaatgttcagaaagcagtctgccatcccacagcttgggacctggggaagggcgacttcaggatccttatgtgcacaaaggtgacaatggacgacttcctgacagctcatcatgagatggggcatatccagtatgatatggcatatgctgcacaaccttttctgctaagaaatggagctaatgaaggattccatgaagctgttggggaaatcatgtcactttctgcagccacacctaagcatttaaaatccattggtcttctgtcacccgattttcaagaagacaatgaaacagaaataaacttcctgctcaaacaagcactcacgattgttgggactctgccatttacttacatgttagagaagtggaggtggatggtctttaaaggggaaattcccaaagaccagtggatgaaaaagtggtgggagatgaagcgagagatagttggggtggtggaacctgtgccccatgatgaaacatactgtgaccccgcatctctgttccatgtttctaatgattactcattcattcgatattacacaaggaccctttaccaattccagtttcaagaagcactttgtcaagcagctaaacatgaaggccctctgcacaaatgtgacatctcaaactctacagaagctggacagaaactgttcaatatgctgaggcttggaaaatcagaaccctggaccctagcattggaaaatgttgtaggagcaaagaacatgaatgtaaggccactgctcaactactttgagcccttatttacctggctgaaagaccagaacaagaattcttttgtgggatggagtaccgactggagtccatatgcagaccaaagcatcaaagtgaggataagcctaaaatcagctcttggagataaagcatatgaatggaacgacaatgaaatgtacctgttccgatcatctgttgcatatgctatgaggcagtactttttaaaagtaaaaaatcagatgattctttttggggaggaggatgtgcgagtggctaatttgaaaccaagaatctcctttaatttctttgtcactgcacctaaaaatgtgtctgatatcattcctagaactgaagttgaaaaggccatcaggatgtcccggagccgtatcaatgatgctttccgtctgaatgacaacagcctagagtttctggggatacagccaacacttggacctcctaaccagccccctgtttccatatggctgattgtttttggagttgtgatgggagtgatagtggttggcattgtcatcctgatcttcactgggatcagagatcggaagaagaaaaataaagcaagaagtggagaaaatccttatgcctccatcgatattagcaaaggagaaaataatccaggattccaaaacactgatgatgttcagacctccttttagaaaaatctatgtttttcctcttgaggtgattttgttgtatgtaaatgttaatttcatggtatagaaaatataagatgataaagatatcattaaatgtcaaaactatgactctgttcagaaaaaaaattgtccaaagacaacatggccaaggagagagcatcttcattgacattgctttcagtatttatttctgtctctggatttgacttctgttctgtttcttaataaggattttgtattagagtatattagggaaagtgtgtatttggtctcacaggctgttcagggataatctaaatgtaaatgtctgttgaatttctgaagttgaaaacaaggatatatcattggagcaagtgttggatcttgtatggaatatggatggatcacttgtaaggacagtgcctgggaactggtgtagctgcaaggattgagaatggcatgcattagctcactttcatttaatccattgtcaaggatgacatgctttcttcacagtaactcagttcaagtactatggtgatttgcctacagtgatgtttggaatcgatcatgctttcttcaaggtgacaggtctaaagagagaagaatccagggaacaggtagaggacattgctttttcacttccaaggtgcttgatcaacatctccctgacaacacaaaactagagccaggggcctccgtgaactcccagagcatgcctgatagaaactcatttctactgttctctaactgtggagtgaatggaaattccaactgtatgttcaccctctgaagtgggtacccagtctcttaaatcttttgtatttgctcacagtgtttgagcagtgctgagcacaaagcagacactcaataaatgctagatttacacactc

SEQ ID NO: 107266 - DNA, 2356 bp, Homo sapiens
  Payload ID: 1058
  Gene Symbol: AGTR1
  Gene Name: angiotensin II receptor, type 1
  Uniprot ID: P30556
  ENST ID: ENST00000349243
  CDS Start-End: 389-1468
actataaattcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagacccgcaccagcgcagccggccctcggcgggacgtgacgcagcgcccggggcgcgggtttgatatttgacaaattgatctaaaatggctgggtttttatctgaataactcactgatgccatcccagaaagtcggcaccaggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaaccctcccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttccactgccaaaacaatgcccgtaagatggcttatttgtataatggtgttactaaagtcacatataaaagttaaactacttgtaaaggtgctgcactggtcccaagtagtagtgtcttcctagtatattagtttgatttaatatctgagaagtgtatatagtttgtggtaaaaagattatatatcataaagtatgccttcctgtttaaaaaaagtatatattctacacatatatgtatatgtatatctatatctctaaactgctgttaattgattaaaatctggcaaagttatatttactttaaaataaaataattttattgcaa

SEQ ID NO: 107267 - DNA, 2252 bp, Homo sapiens
  Payload ID: 1058
  Gene Symbol: AGTR1
  Gene Name: angiotensin II receptor, type 1
  Uniprot ID: P30556
  ENST ID: ENST00000404754
  CDS Start-End: 280-1359
agccaggaccccaggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagacccgcaccagcgcagccggccctcggcgggacgtgacgcagcgcccggggcgcgggtgagtccgcgcggaccgccaggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaaccctcccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttccactgccaaaacaatgcccgtaagatggcttatttgtataatggtgttactaaagtcacatataaaagttaaactacttgtaaaggtgctgcactggtcccaagtagtagtgtcttcctagtatattagtttgatttaatatctgagaagtgtatatagtttgtggtaaaaagattatatatcataaagtatgccttcctgtttaaaaaaagtatatattctacacatatatgtatatgtatatctatatctctaaactgctgttaattgattaaaatctggcaaagttatatttactttaaaataaaataattttattgcaatgtat

SEQ ID NO: 107268 - DNA, 2172 bp, Homo sapiens
  Payload ID: 1058
  Gene Symbol: AGTR1
  Gene Name: angiotensin II receptor, type 1
  ENST ID: ENST00000402260
  CDS Start-End: 120-1286
agggcatgccattgcaagagaatgctcagccatgttcatctggggacctgctcctggtagagcaataggatctgtgtgcccagcaccactgcccacctagctgtcctggcctgtgcccaatgctgaccttcacctcagagtgtggctgtaccacattcggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaaccctcccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttccactgccaaaacaatgcccgtaagatggcttatttgtataatggtgttactaaagtcacatataaaagttaaactacttgtaaaggtgctgcactggtcccaagtagtagtgtcttcctagtatattagtttgatttaatatctgagaagtgtatatagtttgtggtaaaaagattatatatcataaagtatgccttcctgtttaaaaaaagtatatattctacacatatatgtatatgtatatctatatctctaaactgctgttaattgattaaaatctggcaaagttatatttactttaaaataaaataattttattgc

SEQ ID NO: 107269 - DNA, 2071 bp, Homo sapiens
  Payload ID: 1058
  Gene Symbol: AGTR1
  Gene Name: angiotensin II receptor, type 1
  ENST ID: ENST00000418473
  CDS Start-End: 1-1185
atgaagaaaatgaatcacaagtcaactgacagtccaaaggctccacagctcagaggaggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaaccctcccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttccactgccaaaacaatgcccgtaagatggcttatttgtataatggtgttactaaagtcacatataaaagttaaactacttgtaaaggtgctgcactggtcccaagtagtagtgtcttcctagtatattagtttgatttaatatctgagaagtgtatatagtttgtggtaaaaagattatatatcataaagtatgccttcctgtttaaaaaaagtatatattctacacatatatgtatatgtatatctatatctctaaactgctgttaattgattaaaatctggcaaagttatatttactttaaaataaaataattttattgc

SEQ ID NO: 107270 - DNA, 1795 bp, Homo sapiens
  Payload ID: 1058
  Gene Symbol: AGTR1
  Gene Name: angiotensin II receptor, type 1
  Uniprot ID: P30556
  ENST ID: ENST00000474935
  CDS Start-End: 584-1663
gttttgcaccaaactggacacatgcttgctacttcatcatcctcatcgtgaacattattattattatcatcattttccagatgaagaaaatgaatcacaagtcaactgacagtccaaaggctccacagctcagaggaggtaaatcatgtgcttaattcagaacttttggctcccatcactatgctcttcccactgtcttaactctggttgtcacctgagccattgtgtttcttctcaggtagatcttagttcttcctgagaaggtatgaaggtgggtattccaccctacctgaattataggaatttcagatatctgtgagcagctgcaaaggggattttactagatgacatcctgctgggcacactttacgccagtcctgaatgtgtaatagaaatctgcagtttaatgacactgaactaaagaaccagaaaatagaggggtgtattagtgaactacagaaaattcaagtcccaaaagctgtaaatactctgaggaccaaagaaaatatatacgttgttcagatttgccctgaggggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaaccctcccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactg

SEQ ID NO: 107271 - DNA, 1545 bp, Homo sapiens
  Payload ID: 1058
  Gene Symbol: AGTR1
  Gene Name: angiotensin II receptor, type 1
  Uniprot ID: P30556
  ENST ID: ENST00000461609
  CDS Start-End: 334-1413
cttgctacttcatcatcctcatcgtgaacattattattattatcatcattttccagatgaagaaaatgaatcacaagtcaactgacagtccaaaggctccacagctcagaggaggtagatcttagttcttcctgagaaggtatgaaggtgggtattccaccctacctgaattataggaatttcagatatctgtgagcagctgcaaaggggattttactagatgacatcctgctgggcacactttacgccagtcctgaatgtgtaatagaaatctgcagtttaatgagtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaaccctcccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactg

SEQ ID NO: 107272 - DNA, 2359 bp, Homo sapiens
  Payload ID: 1058
  Gene Symbol: AGTR1
  Gene Name: angiotensin II receptor, type 1
  Uniprot ID: P30556
  ENST ID: ENST00000497524
  CDS Start-End: 392-1471
cgggagggtctcccggggcggggcggaggaggagggaatgcaaaacagagcctcgtccccggaacccaagaagcagcaacgcccctcactataaattcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagacccgcaccagcgcagccggccctcggcgggacgtgacgcagcgcccggggcgcgggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaaccctcccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttccactgccaaaacaatgcccgtaagatggcttatttgtataatggtgttactaaagtcacatataaaagttaaactacttgtaaaggtgctgcactggtcccaagtagtagtgtcttcctagtatattagtttgatttaatatctgagaagtgtatatagtttgtggtaaaaagattatatatcataaagtatgccttcctgtttaaaaaaagtatatattctacacatatatgtatatgtatatctatatctctaaactgctgttaattgattaaaatctggcaaagttatatttactttaaaataaaataattttattgcaa

SEQ ID NO: 107273 - DNA, 1669 bp, Homo sapiens
  Payload ID: 1058
  Gene Symbol: AGTR1
  Gene Name: angiotensin II receptor, type 1
  Uniprot ID: P30556
  ENST ID: ENST00000475347
  CDS Start-End: 458-1537
gttttgcaccaaactggacacatgcttgctacttcatcatcctcatcgtgaacattattattattatcatcattttccagatgaagaaaatgaatcacaagtcaactgacagtccaaaggctccacagctcagaggaggtaaatcatgtgcttaattcagaacttttggctcccatcactatgctcttcccactgtcttaactctggttgtcacctgagccattgtgtttcttctcaggtagatcttagttcttcctgagaaggtatgaaggtgggtattccaccctacctgaattataggaatttcagatatctgtgagcagctgcaaaggggattttactagatgacatcctgctgggcacactttacgccagtcctgaatgtgtaatagaaatctgcagtttaatgagtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaaccctcccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactg

SEQ ID NO: 107274 - DNA, 2882 bp, Homo sapiens
  Payload ID: 1059
  Gene Symbol: AGTR2
  Gene Name: angiotensin II receptor, type 2
  Uniprot ID: P50052
  ENST ID: ENST00000371906
  CDS Start-End: 191-1282
agaaggaaaccagagatctggtgctattacgtcccagcgtctgagagaacgagtaagcacagaattcaaagcattctgcagcctgaattttgaaggagtgtgtttaggcactaagcaagctgatttatgataactgctttaaacttcaacaaccaaaggcataagaactaggagctgctgacatttcaatatgaagggcaactccacccttgccactactagcaaaaacattaccagcggtcttcacttcgggcttgtgaacatctctggcaacaatgagtctaccttgaactgttcacagaaaccatcagataagcatttagatgcaattcctattctttactacattatatttgtaattggatttctggtcaatattgtcgtggttacactgttttgttgtcaaaagggtcctaaaaaggtttctagcatatacatcttcaacctcgctgtggctgatttactccttttggctactcttcctctatgggcaacctattattcttatagatatgactggctctttggacctgtgatgtgcaaagtttttggttcttttcttaccctgaacatgtttgcaagcattttttttatcacctgcatgagtgttgataggtaccaatctgtcatctacccctttctgtctcaaagaagaaatccctggcaagcatcttatatagttccccttgtttggtgtatggcctgtttgtcctcattgccaacattttattttcgagacgtcagaaccattgaatacttaggagtgaatgcttgcattatggctttcccacctgagaaatatgcccaatggtcagctgggattgccttaatgaaaaatatccttggttttattatccctttaatattcatagcaacatgctattttggaattagaaaacacttactgaagacgaatagctatgggaagaacaggataacccgtgaccaagtcctgaagatggcagctgctgttgttctggccttcatcatttgctggcttcccttccatgttctgaccttcctggatgctctggcctggatgggtgtcattaatagctgcgaagttatagcagtcattgacctggcacttccttttgccatcctcttgggattcaccaacagctgcgttaatccgtttctgtattgttttgttggaaaccggttccaacagaagctccgcagtgtgtttagggttccaattacttggctccaagggaaaagagagagtatgtcttgccggaaaagcagttctcttagagaaatggagacctttgtgtcttaaacgtgagagcaaaatgcatgtaatcaacatggctacttgctttgaggctcaccagaattatttttaagtggttttaataaaataataaaatttcccctaatcttttctgaatcttctgaaaccaaatgtaactatgttttatcgtccagtgactttcaggaattgcccattgtttttctgatatgtttgtacaagattgtcattagtgagacatatttacaacctagaagtaactggtgatatatctcaaattgtaattaataatagattgtgaataatgatttggggattcagatttctctttgaaacatgcttgtgtttcttagtggggttttatatccatttttatcaggatttcctcttgaaccagaaccagtctttcaactcattgcatcatttacaagacaacattgtaagagagatgagcacttctaagttgagtatattataatagattagtactggattattcaggctttaggcatatgcttctttaaaaaagctataaattatattcctcttgcatttcacttgagtggaggtttatagttaatctataactacatattgaatagggctaggaatatagattaaatcatactcctatgctttagcttatttttacagttatagaaagcaagatgtactataacatagaattgcaatctataatatttgtgtgttcactaaactctgaataagcactttttaaaaaactttctactcattttaatgattgtttaaaggtttctattttctctgatacttttttgaaatcagtaaacactgtgtattgttgtaaaatgtaaaggtcacttttcacatccttgactttttagatgtgctgctttgatatataggacattgatttgatttttattattaatgctttggttctgggttgtttcctaaaatatctgggtggcttaaaaaaaactctttaacttgtaataaacccttaactggcataggaaatggtatccagaatggaattttgctacatggggtctgggtgggggcaaagagacccagtcaattacatgtttggtaccaagaaaggaacctgtcagggcagtacaatgtgactttgaaaatatataccgtgggggtagttttaccctatatctataaacactgtttgttccagaatctgtatgattctatggagctattttaaaccaattgcaggtctagatacctccttctcagcactattaaagctcctaagttagaggagtgcctaaaactgagttacctaaagtttacttacattaaagtatgaatattaattttagaaatttgagactttattctgtaccagccctgtataataacaggttatctaggaccttcctctgaggtaggtctaaatactgatctctgaggcggaactaacgttttggggactcagcatctctgccaggttccaggattatagacagaagagtcctgtcataccactttctggaaaagtcctaatttcatgtaatccttttattttcaataaaaacaaatagctaaatgtataaccaactatgatgttatgttttcaataattttgtaaaacagctcatataaataaaatttttaattggaagaa

SEQ ID NO: 107275 - DNA, 1107 bp, Homo sapiens
  Payload ID: 1060
  Gene Symbol: AGTRAP
  Gene Name: angiotensin II receptor-associated protein
  Uniprot ID: Q6RW13
  ENST ID: ENST00000314340
  CDS Start-End: 55-534
ggagcctaggagccccccgcggctgcggcgcaggtgccctcggcctgagtcgggatggagctgcctgctgtgaacctgaaggtgattctcctaggtcactggctgctgacaacctggggctgcattgtattctcaggctcctatgcctgggccaacttcaccatcctggccttgggcgtgtgggctgtggctcagcgggactccatcgacgccataagcatgtttctgggtggcttgctggccaccatcttcctggacatcgtgcacatcagcatcttctacccgcgggtcagcctcacggacacgggccgctttggcgtgggcatggccatcctcagcttgctgctcaagccgctctcctgctgcttcgtctaccacatgtaccgggagcgcgggggtgagctcctggtccacactggtttccttgggtcttctcaggaccgtagtgcctaccagacgattgactcagcagaggcgcccgcagatccctttgcagtcccagagggcaggagtcaagatgcccgagggtactgaagccagccacgctgcgcccggccctgccccgggccttcctcgtgcctgggaggtcgttctagggatgctcctgacctccgtctcttggacctaagatggaatgtgtccccagctcagggattgcctgaaccaagaggccaggagcccccatgggccgcccagtaccatgcacactcctgtcccgaactccctgaggcctcccctcccttcagggcacccactggttcccaggctggaaccagggtctctctttacctcctaccccatggtggcaccacagaggccctcagccgagtcctgcctgagtgttgcaagctcaggcctttaaggactgctgatgccccctcaggcctcccccaagtttgctgggctttggtggaagccctgagagcttcaggtcctgctcagcccgaggagcagtctggcatgggagtgaggccccgtccttctcactgcctggtcacatggtgcctagggatgcagggctggaggccagaggtgtcagcaacactgtgtcccaccacaacctccagcctcccttttcagagcacagcattaaagtttggggaattc

SEQ ID NO: 107276 - DNA, 1055 bp, Homo sapiens
  Payload ID: 1060
  Gene Symbol: AGTRAP
  Gene Name: angiotensin II receptor-associated protein
  ENST ID: ENST00000376627
  CDS Start-End: 57-536
tcggagcctaggagccccccgcggctgcggcgcaggtgccctcggcctgagtcgggatggagctgcctgctgtgaacctgaagtgcgccagctccagtgtcccaagaaatcaccctcacgtgattctcctaggtcactggctgctgacaacctgcttctggagacatttctctgccaaaccaagactggaaaccattgagctcacctgtgcactttgcaaacttcgaagtgcagcgcacagggcaacagctgggctgcattgtattctcaggctcctatgcctgggccaacttcaccatcctggccttgggcgtgtgggctgtggctcagcgggactccatcgacgccataagcatgtttctgggtggcttgctggccaccatcttcctggacatcgtgcacatcagcatcttctacccgcgggtcagcctcacggacacgggccgctttggcgtgggcatggccatcctcagcttgctgctcaagccgctctcctgctgcttcgtctaccacatgtaccgggagcgcgggggtgagctcctggtccacactggtttccttgggtcttctcaggaccgtagtgcctaccagacgattgactcagcagaggcgcccgcagatccctttgcagtcccagagggcaggagtcaagatgcccgagggtactgaagccagccacgctgcgcccggccctgccccgggccttcctcgtgcctgggaggtcgttctagggatgctcctgacctccgtctcttggacctaagatggaatgtgtccccagctcagggattgcctgaaccaagaggccaggagcccccatgggccgcccagtaccatgcacactcctgtcccgaactccctgaggcctcccctcccttcagggcacccactggttcccaggctggaaccagggtctctctttacctcctaccccatggtggcaccacagaggccctcagccgagtcctgcctgagtgttgcaagctcaggcctttaaggactgctgatgccccctcaggcctcccccaagtttgctgggctttggtggaagccct

SEQ ID NO: 107277 - DNA, 1100 bp, Homo sapiens
  Payload ID: 1060
  Gene Symbol: AGTRAP
  Gene Name: angiotensin II receptor-associated protein
  Uniprot ID: Q6RW13
  ENST ID: ENST00000376629
  CDS Start-End: 63-521
ccgagttcggagcctaggagccccccgcggctgcggcgcaggtgccctcggcctgagtcgggatggagctgcctgctgtgaacctgaaggtgattctcctaggtcactggctgctgacaacctggggctgcattgtattctcaggctcctatgcctgggccaacttcaccatcctggccttgggcgtgtgggctgtggctcagcgggactccatcgacgccataagcatgtttctgggtggcttgctggccaccatcttcctggacatcgtgcacatcagcatcttctacccgcgggtcagcctcacggacacgggccgctttggcgtgggcatggccatcctcagcttgctgctcaagccgctctcctgctgcttcgtctaccacatgtaccgggagcgcgggggtttccttgggtcttctcaggaccgtagtgcctaccagacgattgactcagcagaggcgcccgcagatccctttgcagtcccagagggcaggagtcaagatgcccgagggtactgaagccagccacgctgcgcccggccctgccccgggccttcctcgtgcctgggaggtcgttctagggatgctcctgacctccgtctcttggacctaagatggaatgtgtccccagctcagggattgcctgaaccaagaggccaggagcccccatgggccgcccagtaccatgcacactcctgtcccgaactccctgaggcctcccctcccttcagggcacccactggttcccaggctggaaccagggtctctctttacctcctaccccatggtggcaccacagaggccctcagccgagtcctgcctgagtgttgcaagctcaggcctttaaggactgctgatgccccctcaggcctcccccaagtttgctgggctttggtggaagccctgagagcttcaggtcctgctcagcccgaggagcagtctggcatgggagtgaggccccgtccttctcactgcctggtcacatggtgcctagggatgcagggctggaggccagaggtgtcagcaacactgtgtcccaccacaacctccagcctcccttttcagagcacagcattaaagtttggggaattctgtaga

SEQ ID NO: 107278 - DNA, 1067 bp, Homo sapiens
  Payload ID: 1060
  Gene Symbol: AGTRAP
  Gene Name: angiotensin II receptor-associated protein
  Uniprot ID: Q6RW13
  ENST ID: ENST00000376637
  CDS Start-End: 126-461
gctgcgctggggttggagtggccgcaacgggcggggcggggcggggccgggcaagtttgttccccgagttcggagcctaggagccccccgcggctgcggcgcaggtgccctcggcctgagtcgggatggagctgcctgctgtgaacctgaaggggctgcattgtattctcaggctcctatgcctgggccaacttcaccatcctggccttgggcgtgtgggctgtggctcagcgggactccatcgacgccataagcatgtttctgggtggcttgctggccaccatcttcctggacatcgtgcacatcagcatcttctacccgcgggtcagcctcacggacacgggccgctttggcgtgggcatggccatcctcagcttgctgctcaagccgctctcctgctgcttcgtctaccacatgtaccgggagcgcgggggtttccttgggtcttctcaggaccgtagtgcctaccagacgattgactcagcagaggcgcccgcagatccctttgcagtcccagagggcaggagtcaagatgcccgagggtactgaagccagccacgctgcgcccggccctgccccgggccttcctcgtgcctgggaggtcgttctagggatgctcctgacctccgtctcttggacctaagatggaatgtgtccccagctcagggattgcctgaaccaagaggccaggagcccccatgggccgcccagtaccatgcacactcctgtcccgaactccctgaggcctcccctcccttcagggcacccactggttcccaggctggaaccagggtctctctttacctcctaccccatggtggcaccacagaggccctcagccgagtcctgcctgagtgttgcaagctcaggcctttaaggactgctgatgccccctcaggcctcccccaagtttgctgggctttggtggaagccctgagagcttcaggtcctgctcagcccgaggagcagtctggcatgggagtgaggccccgtccttctcactgcctggtcacatggtgcctagggatgcagggctggaggccagaggtgtcagcaacactgtgtcc

SEQ ID NO: 107279 - DNA, 786 bp, Homo sapiens
  Payload ID: 1060
  Gene Symbol: AGTRAP
  Gene Name: angiotensin II receptor-associated protein
  Uniprot ID: Q6RW13
  ENST ID: ENST00000400895
  CDS Start-End: 86-529
gcggggccgggcaagtttgttccccgagttcggagcctaggagccccccgcggctgcggcgcaggtgccctcggcctgagtcgggatggagctgcctgctgtgaacctgaaggtgattctcctaggtcactggctgctgacaacctgcttctggagacatttctctgccaaaccaagactggaaaccattgagctcacctgtgcactttgcaaacttcgaagtgcagcgcacagggcaacagctgggctgcattgtattctcaggctcctatgcctgggccaacttcaccatcctggccttgggcgtgtgggctgtggctcagcgggactccatcgacgccataagcatgtttctgggtggcttgctggccaccatcttcctggacatcgtgcacatcagcatcttctacccgcgggtcagcctcacggacacgggccgctttggcgtgggcatggccatcctcagcttgctgctcaagccgctctcctgctgcttcgtctaccacatgtaccgggagcgcgggggtgagctcctggtccacactggtttccttgggtcttctcaggaccgtagtgcctaccagacgattgactcagcagaggcgcccgcagatccctttgcagtcccagagggcaggagtcaagatgcccgagggtactgaagccagccacgctgcgcccggccctgccccgggccttcctcgtgcctgggaggtcgttctagggatgctcctgacctccgtctcttggacctaagatggaatgtgtccccagctcagggattgc

SEQ ID NO: 107280 - DNA, 809 bp, Homo sapiens
  Payload ID: 1060
  Gene Symbol: AGTRAP
  Gene Name: angiotensin II receptor-associated protein
  Uniprot ID: Q6RW13
  ENST ID: ENST00000452018
  CDS Start-End: 37-504
gcggctgcggcgcaggtgccctcggcctgagtcgggatggagctgcctgctgtgaacctgaaggtgattctcctaggtcactggctgctgacaacctgcttctggagacatttctctgccaaaccaagactggaaaccattgagctcacctgtgcactttgcaaacttcgaagtgcagcgcacagggcaacagctgggctgcattgtattctcaggctcctatgcctgggccaacttcaccatcctggccttgggcgtgtgggctgtggctcagcgggactccatcgacgccataagcatgtttctgggtggcttgctggccaccatcttcctggacatcgtgcacatcagcatcttctacccgcgggtcagcctcacggacacgggccgctttggcgtgggcatggccatcctcagcttgctgctcaagccgctctcctgctgcttcgtctaccacatgtaccgggagcgcgggggtttccttgggtcttctcaggaccgtagtgcctaccagacgattgactcagcagaggcgcccgcagatccctttgcagtcccagagggcaggagtcaagatgcccgagggtactgaagccagccacgctgcgcccggccctgccccgggccttcctcgtgcctgggaggtcgttctagggatgctcctgacctccgtctcttggacctaagatggaatgtgtccccagctcagggattgcctgaaccaagaggccaggagcccccatgggccgcccagtaccatgcacactcctgtcccgaactccctgaggcctcccctcccttcagggcac

SEQ ID NO: 107281 - DNA, 849 bp, Homo sapiens
  Payload ID: 1060
  Gene Symbol: AGTRAP
  Gene Name: angiotensin II receptor-associated protein
  ENST ID: ENST00000510878
  CDS Start-End: 35-502
ggctgcggcgcaggtgccctcggcctgagtcgggatggagctgcctgctgtgaacctgaaggtgattctcctaggtcactggctgctgacaacctgtttctgggtggcttgctggccaccatcttcctggacatcgtgcacatcagcatcttctacccgcgggtcagcctcacggacacgggccgctttggcgtgggcatggccatcctcagcttgctgctcaagccgctctcctgctgcttcgtctaccacatgtaccgggagcgcgggggtgagctcctggtccacactggtttccttgggtcttctcaggaccgtagtgcctaccagacgattgactcagcagaggcgcccgcagatccctttgcagtcccagagggcaggagtcaagatgcccgagggtactgaagccagccacgctgcgcccggccctgccccgggccttcctcgtgcctgggaggtcgttctagggatgctcctgacctccgtctcttggacctaagatggaatgtgtccccagctcagggattgcctgaaccaagaggccaggagcccccatgggccgcccagtaccatgcacactcctgtcccgaactccctgaggcctcccctcccttcagggcacccactggttcccaggctggaaccagggtctctctttacctcctaccccatggtggcaccacagaggccctcagccgagtcctgcctgagtgttgcaagctcaggcctttaaggactgctgatgccccctcaggcctcccccaagtttgctgggctttggtggaagccctgagagcttcaggtcctgctcagcccgaggagcagtctggcatgggagtgaggccc

SEQ ID NO: 107282 - DNA, 942 bp, Homo sapiens
  Payload ID: 1060
  Gene Symbol: AGTRAP
  Gene Name: angiotensin II receptor-associated protein
  ENST ID: ENST00000476512
  CDS Start-End: 93-284
gggcggggcggggccgggcaagtttgttccccgagttcggagcctaggagccccccgcggctgcggcgcaggtgccctcggcctgagtcgggatggagctgcctgctgtgaacctgaaggtgattctcctaggtcactggctgctgacaacctggcataaggattgcacaccctgcaggagctgggagggagacgtggaagtgctcatcagagctccccagggcctgccccacagtgaggcctcagcactgcagcttgattttcacctttaccatctcttttaatctgttgagcttctggagacatttctctgccaaaccaagactggaaaccattgagctcacctgtgcactttgcaaacttcgaagtgcagcgcacagggcaacagctgggctgcattgtattctcaggctcctatgcctgggccaacttcaccatcctggccttgggcgtgtgggctgtggctcagcgggactccatcgacgccataagcatgtttctgggtggcttgctggccaccatcttcctggacatcgtgcacatcagcatcttctacccgcgggtcagcctcacggacacgggccgctttggcgtgggcatggccatcctcagcttgctgctcaagccgctctcctgctgcttcgtctaccacatgtaccgggagcgcgggggtgagctcctggtccacactggtttccttgggtcttctcaggaccgtagtgcctaccagacgattgactcagcagaggcgcccgcagatccctttgcagtcccagagggcaggagtcaagatgcccgagggtactgaagccagccacgctgcgcccggccctgccccgggccttcctcgtgcctgggaggtcgttctagggatgctcctgacctccgtctcttggacctaagatggaatgtgtccccagctcagggattgcctgaaccaag

SEQ ID NO: 107283 - DNA, 2291 bp, Homo sapiens
  Payload ID: 1061
  Gene Symbol: AGT
  Gene Name: angiotensinogen (serpin peptidase inhibitor, clade A, member 8)
  Uniprot ID: P01019
  ENST ID: ENST00000366667
  CDS Start-End: 216-1673
aagacttcctggaagaggtcccagcgtgagtgtcgcttctggcatctgtccttctggccagcctgtggtctggccaagtgatgtaaccctcctctccagcctgtgcacaggcagcctgggaacagctccatccccacccctcagctataaatagggcatcgtgacccggccgggggaagaagctgccgttgttctgggtactacagcagaagggtatgcggaagcgagcaccccagtctgagatggctcctgccggtgtgagcctgagggccaccatcctctgcctcctggcctgggctggcctggctgcaggtgaccgggtgtacatacaccccttccacctcgtcatccacaatgagagtacctgtgagcagctggcaaaggccaatgccgggaagcccaaagaccccaccttcatacctgctccaattcaggccaagacatcccctgtggatgaaaaggccctacaggaccagctggtgctagtcgctgcaaaacttgacaccgaagacaagttgagggccgcaatggtcgggatgctggccaacttcttgggcttccgtatatatggcatgcacagtgagctatggggcgtggtccatggggccaccgtcctctccccaacggctgtctttggcaccctggcctctctctatctgggagccttggaccacacagctgacaggctacaggcaatcctgggtgttccttggaaggacaagaactgcacctcccggctggatgcgcacaaggtcctgtctgccctgcaggctgtacagggcctgctagtggcccagggcagggctgatagccaggcccagctgctgctgtccacggtggtgggcgtgttcacagccccaggcctgcacctgaagcagccgtttgtgcagggcctggctctctatacccctgtggtcctcccacgctctctggacttcacagaactggatgttgctgctgagaagattgacaggttcatgcaggctgtgacaggatggaagactggctgctccctgatgggagccagtgtggacagcaccctggctttcaacacctacgtccacttccaagggaagatgaagggcttctccctgctggccgagccccaggagttctgggtggacaacagcacctcagtgtctgttcccatgctctctggcatgggcaccttccagcactggagtgacatccaggacaacttctcggtgactcaagtgcccttcactgagagcgcctgcctgctgctgatccagcctcactatgcctctgacctggacaaggtggagggtctcactttccagcaaaactccctcaactggatgaagaaactatctccccggaccatccacctgaccatgccccaactggtgctgcaaggatcttatgacctgcaggacctgctcgcccaggctgagctgcccgccattctgcacaccgagctgaacctgcaaaaattgagcaatgaccgcatcagggtgggggaggtgctgaacagcattttttttgagcttgaagcggatgagagagagcccacagagtctacccaacagcttaacaagcctgaggtcttggaggtgaccctgaaccgcccattcctgtttgctgtgtatgatcaaagcgccactgccctgcacttcctgggccgcgtggccaacccgctgagcacagcatgaggccagggccccagaacacagtgcctggcaaggcctctgcccctggcctttgaggcaaaggccagcagcagataacaaccccggacaaatcagcgatgtgtcacccccagtctcccaccttttcttctaatgagtcgactttgagctggaaagcagccgtttctccttggtctaagtgtgctgcatggagtgagcagtagaagcctgcagcggcacaaatgcacctcccagtttgctgggtttattttagagaatgggggtggggaggcaagaaccagtgtttagcgcgggactactgttccaaaaagaattccaaccgaccagcttgtttgtgaaacaaaaaagtgttcccttttcaagttgagaacaaaaattgggttttaaaattaaagtatacatttttgcattgccttcggtttgtatttagtgtcttgaatgtaagaacatgacctccgtgtagtgtctgtaataccttagttttttccacagatgcttgtgatttttgaacaatacgtgaaagatgcaagcacctgaatttctgtttgaatgcggaaccatagctggttatttctcccttgtgttagtaataaacgtcttgccacaataagcctccaaaaa

SEQ ID NO: 107284 - DNA, 4787 bp, Homo sapiens
  Payload ID: 1062
  Gene Symbol: ANLN
  Gene Name: anillin actin binding protein
  Uniprot ID: Q9NQW6
  ENST ID: ENST00000265748
  CDS Start-End: 222-3596
agcgcgcatgctcgcggctcggcgctgaaattcaaatttgaacggctgcagaggccgagtccgtcactggaagccgagaggagaggacagctggttgtgggagagttcccccgcctcagactcctggttttttccaggagacacactgagctgagactcacttttctcttcctgaatttgaaccaccgtttccatcgtctcgtagtccgacgcctggggcgatggatccgtttacggagaaactgctggagcgaacccgtgccaggcgagagaatcttcagagaaaaatggctgagaggcccacagcagctccaaggtctatgactcatgctaagcgagctagacagccactttcagaagcaagtaaccagcagcccctctctggtggtgaagagaaatcttgtacaaaaccatcgccatcaaaaaaacgctgttctgacaacactgaagtagaagtttctaacttggaaaataaacaaccagttgagtcgacatctgcaaaatcttgttctccaagtcctgtgtctcctcaggtgcagccacaagcagcagataccatcagtgattctgttgctgtcccggcatcactgctgggcatgaggagagggctgaactcaagattggaagcaactgcagcctcctcagttaaaacacgtatgcaaaaacttgcagagcaacggcgccgttgggataatgatgatatgacagatgacattcctgaaagctcactcttctcaccaatgccatcagaggaaaaggctgcttcccctcccagacctctgctttcaaatgcctcggcaactccagttggcagaaggggccgtctggccaatcttgctgcaactatttgctcctgggaagatgatgtaaatcactcatttgcaaaacaaaacagtgtacaagaacagcctggtaccgcttgtttatccaaattttcctctgcaagtggagcatctgctaggatcaatagcagcagtgttaagcaggaagctacattctgttcccaaagggatggcgatgcctctttgaataaagccctatcctcaagtgctgatgatgcgtctttggttaatgcctcaatttccagctctgtgaaagctacttctccagtgaaatctactacatctatcactgatgctaaaagttgtgagggacaaaatcctgagctacttccaaaaactcctattagtcctctgaaaacgggggtatcgaaaccaattgtgaagtcaactttatcccagacagttccatccaagggagaattaagtagagaaatttgtctgcaatctcaatctaaagacaaatctacgacaccaggaggaacaggaattaagcctttcctggaacgctttggagagcgttgtcaagaacatagcaaagaaagtccagctcgtagcacaccccacagaacccccattattactccaaatacaaaggccatccaagaaagattattcaagcaagacacatcttcatctactacccatttagcacaacagctcaagcaggaacgtcaaaaagaactagcatgtcttcgtggccgatttgacaagggcaatatatggagtgcagaaaaaggcggaaactcaaaaagcaaacaactagaaaccaaacaggaaactcactgtcagagcactcccctcaaaaaacaccaaggtgtttcaaaaactcagtcacttccagtaacagaaaaggtgaccgaaaaccagataccagccaaaaattctagtacagaacctaaaggtttcactgaatgcgaaatgacgaaatctagccctttgaaaataacattgtttttagaagaggacaaatccttaaaagtaacatcagacccaaaggttgagcagaaaattgaagtgatacgtgaaattgagatgagtgtggatgatgatgatatcaatagttcgaaagtaattaatgacctcttcagtgatgtcctagaggaaggtgaactagatatggagaagagccaagaggagatggatcaagcattagcagaaagcagcgaagaacaggaagatgcactgaatatctcctcaatgtctttacttgcaccattggcacaaacagttggtgtggtaagtccagagagtttagtgtccacacctagactggaattgaaagacaccagcagaagtgatgaaagtccaaaaccaggaaaattccaaagaactcgtgtccctcgagctgaatctggtgatagccttggttctgaagatcgtgatcttctttacagcattgatgcatatagatctcaaagattcaaagaaacagaacgtccatcaataaagcaggtgattgttcggaaggaagatgttacttcaaaactggatgaaaaaaataatgcctttccttgtcaagttaatatcaaacagaaaatgcaggaactcaataacgaaataaatatgcaacagacagtgatctatcaagctagccaggctcttaactgctgtgttgatgaagaacatggaaaagggtccctagaagaagctgaagcagaaagacttcttctaattgcaactgggaagagaacacttttgattgatgaattgaataaattgaagaacgaaggacctcagaggaagaataaggctagtccccaaagtgaatttatgccatccaaaggatcagttactttgtcagaaatccgcttgcctctaaaagcagattttgtctgcagtacggttcagaaaccagatgcagcaaattactattacttaattatactaaaagcaggagctgaaaatatggtagccacaccattagcaagtacttcaaactctcttaacggtgatgctctgacattcactactacatttactctgcaagatgtatccaatgactttgaaataaatattgaagtttacagcttggtgcaaaagaaagatccctcaggccttgataagaagaaaaaaacatccaagtccaaggctattactccaaagcgactcctcacatctataaccacaaaaagcaacattcattcttcagtcatggccagtccaggaggtcttagtgctgtgcgaaccagcaacttcgcccttgttggatcttacacattatcattgtcttcagtaggaaatactaagtttgttctggacaaggtcccctttttatcttctttggaaggtcatatttatttaaaaataaaatgtcaagtgaattccagtgttgaagaaagaggttttctaaccatatttgaagatgttagtggttttggtgcctggcatcgaagatggtgtgttctttctggaaactgtatatcttattggacttatccagatgatgagaaacgcaagaatcccataggaaggataaatctggctaattgtaccagtcgtcagatagaaccagccaacagagaattttgtgcaagacgcaacacttttgaattaattactgtccgaccacaaagagaagatgaccgagagactcttgtcagccaatgcagggacacactctgtgttaccaagaactggctgtctgcagatactaaagaagagcgggatctctggatgcaaaaactcaatcaagttcttgttgatattcgcctctggcaacctgatgcttgctacaaacctattggaaagccttaaaccgggaaatttccatgctatctagaggtttttgatgtcatcttaagaaacacacttaagagcatcagatttactgattgcattttatgctttaagtacgaaagggtttgtgccaatattcactacgtattatgcagtatttatatcttttgtatgtaaaactttaactgatttctgtcattcatcaatgagtagaagtaaatacattatagttgattttgctaaatcttaatttaaaagcctcattttcctagaaatctaattattcagttattcatgacaatatttttttaaaagtaagaaattctgagttgtcttcttggagctgtaggtcttgaagcagcaacgtctttcaggggttggagacagaaacccattctccaatctcagtagttttttcgaaaggctgtgatcatttattgatcgtgatatgacttgttactagggtactgaaaaaaatgtctaaggcctttacagaaacatttttagtaatgaggatgagaactttttcaaatagcaaatatatattggcttaaagcatgaggctgtcttcagaaaagtgatgtggacataggaggcaatgtgtgagacttgggggttcaatattttatatagaagagttaataagcacatggtttacatttactcagctactatatatgcagtgtggtgcacattttcacagaattctggcttcattaagatcattatttttgctgcgtagcttacagacttagcatattagttttttctactcctacaagtgtaaattgaaaaatctttatattaaaaaagtaaactgttatgaagctgctatgtactaataatactttgcttgccaaagtgtttgggttttgttgttgtttgtttgtttgtttgtttttggttcatgaacaacagtgtctagaaacccattttgaaagtggaaaattattaagtcacctatcacctttaaacgcctttttttaaaattataaaatattgtaaagcagggtctcaacttttaaatacactttgaacttcttctctgaattattaaagttctttatgacctcatttataaacactaaattctgtcacctcctgtcattttattttttattcattcaaatgtattttttcttgtgcatattataaaaatatattttatgagctcttactcaaataaatacctgtaaatgtctaaaggaa

SEQ ID NO: 107285 - DNA, 4661 bp, Homo sapiens
  Payload ID: 1062
  Gene Symbol: ANLN
  Gene Name: anillin actin binding protein
  Uniprot ID: Q9NQW6
  ENST ID: ENST00000396068
  CDS Start-End: 207-3470
ggctcggcgctgaaattcaaatttgaacggctgcagaggccgagtccgtcactggaagccgagaggagaggacagctggttgtgggagagttcccccgcctcagactcctggttttttccaggagacacactgagctgagactcacttttctcttcctgaatttgaaccaccgtttccatcgtctcgtagtccgacgcctggggcgatggatccgtttacggagaaactgctggagcgaacccgtgccaggcgagagaatcttcagagaaaaatggctgagaggcccacagcagctccaaggtctatgactcatgctaagcgagctagacagccactttcagaagcaagtaaccagcagcccctctctggtggtgaagagaaatcttgtacaaaaccatcgccatcaaaaaaacgctgttctgacaacactgaagtagaagtttctaacttggaaaataaacaaccagttgagtcgacatctgcaaaatcttgttctccaagtcctgtgtctcctcaggtgcagccacaagcagcagataccatcagtgattctgttgctgtcccggcatcactgctgggcatgaggagagggctgaactcaagattggaagcaactgcagcctcctcagttaaaacacgtatgcaaaaacttgcagagcaacggcgccgttgggataatgatgatatgacagatgacattcctgaaagctcactcttctcaccaatgccatcagaggaaaaggctgcttcccctcccagacctctgctttcaaatgcctcggcaactccagttggcagaaggggccgtctggccaatcttgctgcaactatttgctcctgggaagatgatgtaaatcactcatttgcaaaacaaaacagtgtacaagaacagcctggtaccgcttgtttatccaaattttcctctgcaagtggagcatctgctaggatcaatagcagcagtgttaagcaggaagctacattctgttcccaaagggatggcgatgcctctttgaataaagccctatcctcaagtgctgatgatgcgtctttggttaatgcctcaatttccagctctgtgaaagctacttctccagtgaaatctactacatctatcactgatgctaaaagttgtgagggacaaaatcctgagctacttccaaaaactcctattagtcctctgaaaacgggggtatcgaaaccaattgtgaagtcaactttatcccagacagttccatccaagggagaattaagtagagaaatttgtctgcaatctcaatctaaagacaaatctacgacaccaggaggaacaggaattaagcctttcctggaacgctttggagagcgttgtcaagaacatagcaaagaaagtccagctcgtagcacaccccacagaacccccattattactccaaatacaaaggccatccaagaaagattattcaagcaagacacatcttcatctactacccatttagcacaacagctcaagcaggaacgtcaaaaagaactagcatgtcttcgtggccgatttgacaagggcaatatatggagtgcagaaaaaggcggaaactcaaaaagcaaacaactagaaaccaaacaggaaactcactgtcagagcactcccctcaaaaaacaccaaggtgtttcaaaaactcagtcacttccagtaacagaaaaggtgaccgaaaaccagataccagccaaaaattctagtacagaacctaaagaagtgatacgtgaaattgagatgagtgtggatgatgatgatatcaatagttcgaaagtaattaatgacctcttcagtgatgtcctagaggaaggtgaactagatatggagaagagccaagaggagatggatcaagcattagcagaaagcagcgaagaacaggaagatgcactgaatatctcctcaatgtctttacttgcaccattggcacaaacagttggtgtggtaagtccagagagtttagtgtccacacctagactggaattgaaagacaccagcagaagtgatgaaagtccaaaaccaggaaaattccaaagaactcgtgtccctcgagctgaatctggtgatagccttggttctgaagatcgtgatcttctttacagcattgatgcatatagatctcaaagattcaaagaaacagaacgtccatcaataaagcaggtgattgttcggaaggaagatgttacttcaaaactggatgaaaaaaataatgcctttccttgtcaagttaatatcaaacagaaaatgcaggaactcaataacgaaataaatatgcaacagacagtgatctatcaagctagccaggctcttaactgctgtgttgatgaagaacatggaaaagggtccctagaagaagctgaagcagaaagacttcttctaattgcaactgggaagagaacacttttgattgatgaattgaataaattgaagaacgaaggacctcagaggaagaataaggctagtccccaaagtgaatttatgccatccaaaggatcagttactttgtcagaaatccgcttgcctctaaaagcagattttgtctgcagtacggttcagaaaccagatgcagcaaattactattacttaattatactaaaagcaggagctgaaaatatggtagccacaccattagcaagtacttcaaactctcttaacggtgatgctctgacattcactactacatttactctgcaagatgtatccaatgactttgaaataaatattgaagtttacagcttggtgcaaaagaaagatccctcaggccttgataagaagaaaaaaacatccaagtccaaggctattactccaaagcgactcctcacatctataaccacaaaaagcaacattcattcttcagtcatggccagtccaggaggtcttagtgctgtgcgaaccagcaacttcgcccttgttggatcttacacattatcattgtcttcagtaggaaatactaagtttgttctggacaaggtcccctttttatcttctttggaaggtcatatttatttaaaaataaaatgtcaagtgaattccagtgttgaagaaagaggttttctaaccatatttgaagatgttagtggttttggtgcctggcatcgaagatggtgtgttctttctggaaactgtatatcttattggacttatccagatgatgagaaacgcaagaatcccataggaaggataaatctggctaattgtaccagtcgtcagatagaaccagccaacagagaattttgtgcaagacgcaacacttttgaattaattactgtccgaccacaaagagaagatgaccgagagactcttgtcagccaatgcagggacacactctgtgttaccaagaactggctgtctgcagatactaaagaagagcgggatctctggatgcaaaaactcaatcaagttcttgttgatattcgcctctggcaacctgatgcttgctacaaacctattggaaagccttaaaccgggaaatttccatgctatctagaggtttttgatgtcatcttaagaaacacacttaagagcatcagatttactgattgcattttatgctttaagtacgaaagggtttgtgccaatattcactacgtattatgcagtatttatatcttttgtatgtaaaactttaactgatttctgtcattcatcaatgagtagaagtaaatacattatagttgattttgctaaatcttaatttaaaagcctcattttcctagaaatctaattattcagttattcatgacaatatttttttaaaagtaagaaattctgagttgtcttcttggagctgtaggtcttgaagcagcaacgtctttcaggggttggagacagaaacccattctccaatctcagtagttttttcgaaaggctgtgatcatttattgatcgtgatatgacttgttactagggtactgaaaaaaatgtctaaggcctttacagaaacatttttagtaatgaggatgagaactttttcaaatagcaaatatatattggcttaaagcatgaggctgtcttcagaaaagtgatgtggacataggaggcaatgtgtgagacttgggggttcaatattttatatagaagagttaataagcacatggtttacatttactcagctactatatatgcagtgtggtgcacattttcacagaattctggcttcattaagatcattatttttgctgcgtagcttacagacttagcatattagttttttctactcctacaagtgtaaattgaaaaatctttatattaaaaaagtaaactgttatgaagctgctatgtactaataatactttgcttgccaaagtgtttgggttttgttgttgtttgtttgtttgtttgtttttggttcatgaacaacagtgtctagaaacccattttgaaagtggaaaattattaagtcacctatcacctttaaacgcctttttttaaaattataaaatattgtaaagcagggtctcaacttttaaatacactttgaacttcttctctgaattattaaagttctttatgacctcatttataaacactaaattctgtcacctcctgtcattttattttttattcattcaaatgtattttttcttgtgcatattataaaaatatattttatgagctcttactcaaataaatacctgtaaatgtctaaaggaa

SEQ ID NO: 107286 - DNA, 716 bp, Homo sapiens
  Payload ID: 1062
  Gene Symbol: ANLN
  Gene Name: anillin actin binding protein
  ENST ID: ENST00000441696
  CDS Start-End: 1-209
aattttcctctgcaagtggagcatctgctaggatcaatagcagcagtgttaagcaggaagctacattctgttcccaaagggatggcgatgcctctttgaataaagccctatcctcaagtgctgatgatgcgtctttggttaatgcctcaatttccagctctgtggtaaaaagctacttctccagtgaaatctactacatctatcactgatgctaaaagttgtgagggacaaaatcctgagctacttccaaaaactcctattagtcctctgaaaacgggggtatcgaaaccaattgtgaagtcaactttatcccagacagttccatccaagggagaattaagtagagaaatttgtctgcaatctcaatctaaagacaaatctacgacaccaggaggaacaggaattaagcctttcctggaacgctttggagagcgttgtcaagaacatagcaaagaaagtccagctcgtagcacaccccacagaacccccattattactccaaatacaaaggccatccaagaaagattattcaagcaagacacatcttcatctactacccatttagcacaacagctcaagcaggaacgtcaaaaagaactagcatgtcttcgtggccgatttgacaagggcaatatatggagtgcagaaaaaggcggaaactcaaaaagcaaacaactagaaaccaaacaggaaactcactgtcagagcactcccct

SEQ ID NO: 107287 - DNA, 557 bp, Homo sapiens
  Payload ID: 1062
  Gene Symbol: ANLN
  Gene Name: anillin actin binding protein
  ENST ID: ENST00000429082
  CDS Start-End: 1-222
aaattttcctctgcaagtggagcatctgctaggatcaatagcagcagtgttaagcaggaagctacattctgttcccaaagggatggcgatgcctctttgaataaagccctatcctcaagtgctgatgatgcgtctttggttaatgcctcaatttccagctctgtgtgttttcatgtttcagaaagctacttctccagtgaaatctactacatctatcactgatgctaaaagttgtgagggacaaaatcctgagctacttccaaaaactcctattagtcctctgaaaacgggggtatcgaaaccaattgtgaagtcaactttatcccagacagttccatccaagggagaattaagtagagaaatttgtctgcaatctcaatctaaagacaaatctacgacaccaggaggaacaggaattaagcctttcctggaacgctttggagagcgttgtcaagaacatagcaaagaaagtccagctcgtagcacaccccacagaacccccattattactccaaatacaaaggccatccaagaaagattattcaagcaagacacat

SEQ ID NO: 107288 - DNA, 757 bp, Homo sapiens
  Payload ID: 1062
  Gene Symbol: ANLN
  Gene Name: anillin actin binding protein
  ENST ID: ENST00000457743
  CDS Start-End: 1-757
ttatgccatccaaaggatcagttactttgtcagaaatccgcttgcctctaaaagcagattttgtctgcagtacggttcagaaaccagatgcagcaaattactattacttaattatactaaaagcaggagctgaaaatatggtagccacaccattagcaagtacttcaaactctcttaacggtgatgctctgacattcactactacatttactctgcaagatgtatccaatgactttgaaataaatattgaagtttacagcttggtgcaaaagaaagatccctcaggccttgataagaagaaaaaaacatccaagtccaaggctattactccaaagcgactcctcacatctataaccacaaaaagcaacattcattcttcagtcatggccagtccaggaggtcttagtgctgtgcgaaccagcaacttcgcccttgttggatcttacacattatcattgtcttcagtaggaaatactaagtttgttctggacaagataaattatgatgtaagagagcgagagctactgggctatttgttccaggaaaaggtcccctttttatcttctttggaaggtcatatttatttaaaaataaaatgtcaagtgaattccagtgttgaagaaagaggttttctaaccatatttgaagatgttagtggttttggtgcctggcatcgaagatggtgtgttctttctggaaactgtatatcttattggacttatccagatgatgagaaacgcaagaatcccataggaag

SEQ ID NO: 107289 - DNA, 829 bp, Homo sapiens
  Payload ID: 1062
  Gene Symbol: ANLN
  Gene Name: anillin actin binding protein
  ENST ID: ENST00000446635
  CDS Start-End: 1-829
gtccaaaaccaggaaaattccaaagaactcgtgtccctcgagctgaatctggtgatagccttggttctgaagatcgtgatcttctttacagatctcaaagattcaaagaaacagaacgtccatcaataaagcaggtgattgttcggaaggaagatgttacttcaaaactggatgaaaaaaataatgcctttccttgtcaagttaatatcaaacagaaaatgcaggaactcaataacgaaataaatatgcaacagacagtgatctatcaagctagccaggctcttaactgctgtgttgatgaagaacatggaaaagggtccctagaagaagctgaagcagaaagacttcttctaattgcaactgggaagagaacacttttgattgatgaattgaataaattgaagaacgaaggacctcagaggaagaataaggctagtccccaaagtgaatttatgccatccaaaggatcagttactttgtcagaaatccgcttgcctctaaaagcagattttgtctgcagtacggttcagaaaccagatgcagcaaattactattacttaattatactaaaagcaggagctgaaaatatggtagccacaccattagcaagtacttcaaactctcttaacggtgatgctctgacattcactactacatttactctgcaagatgtatccaatgactttgaaataaatattgaagtttacagcttggtgcaaaagaaagatccctcaggccttgataagaagaaaaaaacatccaagtccaaggctattactccaaagcgactcctcacatctataaccacaaaaagcaacattcattcttc

SEQ ID NO: 107290 - DNA, 596 bp, Homo sapiens
  Payload ID: 1062
  Gene Symbol: ANLN
  Gene Name: anillin actin binding protein
  ENST ID: ENST00000424865
  CDS Start-End: 90-596
gtgcgggccggggtcgccgcggctgcggcctgctgtggttgaaactgctggagcgaacccgtgccaggcgagagaatcttcagagaaaaatggctgagaggcccacagcagctccaaggtctatgactcatgctaagcgagctagacagccactttcagaagcaagtaaccagcagcccctctctggtggtgaagagaaatcttgtacaaaaccatcgccatcaaaaaaacgctgttctgacaacactgaagtagaagtttctaacttggaaaataaacaaccagttgagtcgacatctgcaaaatcttgttctccaagtcctgtgtctcctcaggtgcagccacaagcagcagataccatcagtgattctgttgctgtcccggcatcactgctgggcatgaggagagggctgaactcaagattggaagcaactgcagcctcctcagttaaaacacgtatgcaaaaacttgcagagcaacggcgccgttgggataatgatgatatgacagatgacattcctgaaagctcactcttctcaccaatgccatcagaggaaaaggctgcttcccctcccagacctctgctttcaaatgcc

SEQ ID NO: 107291 - DNA, 463 bp, Homo sapiens
  Payload ID: 1062
  Gene Symbol: ANLN
  Gene Name: anillin actin binding protein
  ENST ID: ENST00000418118
  CDS Start-End: 356-463
gtttcggtcctacagataaaactcagggaggaaggctttgagtctgtcctaaaaggctgttgcgagaggtctttcagcccccgtttttaccatgtccctctgcagtcctggcgcagcaagagtgaggcgcaggcctgcggaacgggtcctgctggaagcagctggaatgccctgcagggcggggtccggggccggtgactcagtgcggctgccgccgggaaaggcagtaggatgtgtgatttgcggagttcacgcagcccgcaggggagatgctaatgaaatgacagcaaaacgttaaaataagcagaaactgctggagcgaacccgtgccaggcgagagaatcttcagagaaaaatggctgagaggcccacagcagctccaaggtctatgactcatgctaagcgagctagacagccactttcagaagcaagtaaccagcagcccctctctggtggtgaaggt

SEQ ID NO: 107292 - DNA, 580 bp, Homo sapiens
  Payload ID: 1062
  Gene Symbol: ANLN
  Gene Name: anillin actin binding protein
  ENST ID: ENST00000452877
  CDS Start-End: 1-79
gtctttggttaatgcctcaatttccagctctgtggtaaaaagctacttctccagtgaaatctactacatctatcactgatgctaaaagttgtgagggacaaaatcctgagctacttccaaaaactcctattagtcctctgaaaacgggggtatcgaaaccaattgtgaagtcaactttatcccagacagttccatccaagggagaattaagtagagaaatttgtctgcaatctcaatctaaagacaaatctacgacaccaggaggaacaggaattaagcctttcctggaacgctttggagagcgttgtcaagaacatagcaaagaaagtccagctcgtagcacaccccacagaacccccattattactccaaatacaaaggccatccaagaaagattattcaagcaagacacatcttcatctactacccatttagcacaacagctcaagcaggaaactcactgtcagagcactcccctcaaaaaacaccaaggtgtttcaaaaactcagtcacttccagtaacagaaaaggtgaccgaaaaccagataccagccaaaaattctagtacagaacctaaagg

SEQ ID NO: 107293 - DNA, 707 bp, Homo sapiens
  Payload ID: 1062
  Gene Symbol: ANLN
  Gene Name: anillin actin binding protein
  ENST ID: ENST00000428612
  CDS Start-End: 1-707
tcaagaacatagcaaagaaagtccagctcgtagcacaccccacagaacccccattattactccaaatacaaaggccatccaagaaagattattcaagcaagatgtatccaatgactttgaaataaatattgaagtttacagcttggtgcaaaagaaagatccctcaggccttgataagaagaaaaaaacatccaagtccaaggctattactccaaagcgactcctcacatctataaccacaaaaagcaacattcattcttcagtcatggccagtccaggaggtcttagtgctgtgcgaaccagcaacttcgcccttgttggatcttacacattatcattgtcttcagtaggaaatactaagtttgttctggacaaggtcccctttttatcttctttggaaggtcatatttatttaaaaataaaatgtcaagtgaattccagtgttgaagaaagaggttttctaaccatatttgaagatgttagtggttttggtgcctggcatcgaagatggtgtgttctttctggaaactgtatatcttattggacttatccagatgatgagaaacgcaagaatcccataggaaggataaatctggctaattgtaccagtcgtcagatagaaccagccaacagagaattttgtgcaagacgcaacacttttgaattaattactgtccgaccacaaagagaagatgaccgagagactc

SEQ ID NO: 107294 - DNA, 8203 bp, Homo sapiens
  Payload ID: 1063
  Gene Symbol: ANKH
  Gene Name: ANKH inorganic pyrophosphate transport regulator
  Uniprot ID: Q9HCJ1
  ENST ID: ENST00000284268
  CDS Start-End: 332-1810
agagcgcttataatggagccgctgtcagcagaaccttctgccgccgccgccgccgccgccgtccctcctcttttttttcccggcagatctttgttgtgtgggagggcagcagggatggacttgagcttgcggatcccctgctagagcagccgcgctcggagaaggcgccgcagccgcgaggaggagccgccgccgccgcgcccgaggccccgccgcccgcggcctctgtcggcccgcgccccgctcgccccgtcgccccgtcgcccctcgcctccccgcagagtcccctcgcggcagcagatgtgtgtggggtcagcccacggcggggactatggtgaaattcccggcgctcacgcactactggcccctgatccggttcttggtgcccctgggcatcaccaacatagccatcgacttcggggagcaggccttgaaccggggcattgctgctgtcaaggaggatgcagtcgagatgctggccagctacgggctggcgtactccctcatgaagttcttcacgggtcccatgagtgacttcaaaaatgtgggcctggtgtttgtgaacagcaagagagacaggaccaaagccgtcctgtgtatggtggtggcaggggccatcgctgccgtctttcacacactgatagcttatagtgatttaggatactacattatcaataaactgcaccatgtggacgagtcggtggggagcaagacgagaagggccttcctgtacctcgccgcctttcctttcatggacgcaatggcatggacccatgctggcattctcttaaaacacaaatacagtttcctggtgggatgtgcctcaatctcagatgtcatagctcaggttgtttttgtagccattttgcttcacagtcacctggaatgccgggagcccctgctcatcccgatcctctccttgtacatgggcgcacttgtgcgctgcaccaccctgtgcctgggctactacaagaacattcacgacatcatccctgacagaagtggcccggagctggggggagatgcaacaataagaaagatgctgagcttctggtggcctttggctctaattctggccacacagagaatcagtcggcctattgtcaacctctttgtttcccgggaccttggtggcagttctgcagccacagaggcagtggcgattttgacagccacataccctgtgggtcacatgccatacggctggttgacggaaatccgtgctgtgtatcctgctttcgacaagaataaccccagcaacaaactggtgagcacgagcaacacagtcacggcagcccacatcaagaagttcaccttcgtctgcatggctctgtcactcacgctctgtttcgtgatgttttggacacccaacgtgtctgagaaaatcttgatagacatcatcggagtggactttgcctttgcagaactctgtgttgttcctttgcggatcttctccttcttcccagttccagtcacagtgagggcgcatctcaccgggtggctgatgacactgaagaaaaccttcgtccttgcccccagctctgtgctgcggatcatcgtcctcatcgccagcctcgtggtcctaccctacctgggggtgcacggtgcgaccctgggcgtgggctccctcctggcgggctttgtgggagaatccaccatggtcgccatcgctgcgtgctatgtctaccggaagcagaaaaagaagatggagaatgagtcggccacggagggggaagactctgccatgacagacatgcctccgacagaggaggtgacagacatcgtggaaatgagagaggagaatgaataaggcacgggacgccatgggcactgcagggacagtcagtcaggatgacacttcggcatcatctcttccctctcccatcgtattttgttcccttttttttgttttgttttggtaatgaaagaggccttgatttaaaggtttcgtgtcaattctctagcatactgggtatgctcacactgacggggggacctagtgaatggtctttactgttgctatgtaaaaacaaacgaaacaactgacttcatacccctgcctcacgaaaacccaaaagacacagctgcctcacggttgacgttgtgtcctcctcccctggacaatctcctcttggaaccaaaggactgcagctgtgccatcgcgcctcggtcaccctgcacagcaggccacagactctcctgtcccccttcatcgctcttaagaatcaacaggttaaaactcggcttcctttgatttgcttcccagtcacatggccgtacaaagagatggagccccggtggcctcttaaatttcccttccgccacggagttcgaaaccatctactccacacatgcaggaggcgggtggcacgctgcagcccggagtccccgttcacactgaggaacggagacctgtgaccacagcaggctgacagatggacagaatctcccgtagaaaggtttggtttgaaatgccccgggggcagcaaactgacatggttgaatgatagcatttcactctgcgttctcctagatctgagcaagctgtcagttctcacccccaccgtgtatatacatgagctaacttttttaaattgtcacaaaagcgcatctccagattccagaccctgccgcatgacttttcctgaaggcttgcttttccctcgcctttcctgaaggtcgcattagagcgagtcacatggagcatcctaactttgcattttagtttttacagtgaactgaagctttaagtctcatccagcattctaatgccaggttgctgtagggtaacttttgaagtagatatattacctggttctgctatccttagtcataactctgcggtacaggtaattgagaatgtactacggtacttccctcccacaccatacgataaagcaagacattttataacgataccagagtcactatgtggtcctccctgaaataacgcattcgaaatccatgcagtgcagtatatttttctaagttttggaaagcaggttttttcctttaaaaaaattatagacacggttcactaaattgatttagtcagaattcctagactgaaagaacctaaaaaaaaaaatattttaaagatataaatatatgctgtatatgttatgtaatttattttaggctataatacatttcctattttcgcattttcaataaaatgtctctaatacaatacggtgattgcttgtgtgctcaacatacctgcagttgaaacgtattgtatcaatgaacattgtaccttattggcagcagttttataaagtccgtcatttgcatttgaatgtaaggctcagtaaatgacagaactatttttcattatgggtaactggggaataaatgggtcactggagtaggaatagaagtgcaagctggaaaggcaaaaatgagaaagaaaaaggcaggccctttgtgtctaccgttttcagtgctgtgtgatcatattgttcctcacagcaaaaaagaatgcaagggcataatgttagctgtgaacatgccagggttgcattcacattcctgggtacccagtgctgatggggtgtgcccacgtggggacatgtccttggcgtgcttcctcagagtggcttttcctccattaatacatatatgagtactgaaaaattaagttgcatagctgctttgcagtggtttcagaggcagatctgagaagattaaaaaaaaatctcaatgtatcagctttttttaaaggacattactagaaaattaaacagtattttttaacatgtgtgactttcatgcttctggggttggagcttaaagatccaaactgagaaagcaggccgggcatggtggctcatgcctgtaatcccaacactttgggaggccaaggagggtggatcacttaaggtcaggagtttgagaccagcctggccaacatggcaaaaccctgtctctactaaaaacataaaaattagctgggggtggtagcacatacctgtaatcccagctactcaggaggctgaggcaggagaatttgcttgatcctgggaggcagaggttgtagtgagccgagatcgcgccatcgcactccagcctgggtgacaagagcaaaactccatctcaaaaaaaaaaaaaatcctttccctctaaatccaggaaggatcagcaagggcctcctcattatgagatgaggaaatacaactccagagattccttcagtgatcaagatcagtgggccataatatttggttagagtttctgagaacacaggaagcaatgccacactcaggccaccacaatggagctgatttggcaggacttgttcaaacctttcaccttaaagcacgtgatccttcttcgtacattttcttcacttgggctgcttaagtcacagcctaacaactttgaggcaaaactgagaactggcatattctcctgcgtttcttctaatcgagtcccatcatccagctagacatgagagatcaaaccagggagggtgacctttctccttcccacttttcagagtcattggggcaactttttgacttttgtgaccaaagaaacattcccccaaaacatttatttttcattgtagggcattcagctgacagctgcattttagaaagttaccatgcctgtgagattctcatgtcaaagaccagggaaagaccaggtgtgactttctccaaaactgagtgattgcttgtggatgaatacaatctaaaaatacaaggccatgaagtagtttttcatttagatgctgagaaataataggtttgggcagctcaaagcataggaaatagtaagggttttctagagctcctcctttggtggcctgtttgagtagcacaagggacgtcatcctaaatgtgcagttgccatttgttctgtagtgacttacagggatctcagtggcaaagggcgtcagtgagacaacaactgagcaaaaagaactagacgaggcttgcgcttggaaagtcacggtaggattggacctgccggccacatggctcagggagtattgacggatttgcacattggcaggaaactctcccgtttgggattctttaaatggggcacagaaggccacttgtttgcatttctgggtaaaaaacagtcatcccccatgactgcctgcatcgggtttgtcttgtgccaaagttactcttcctttgtttttactttgccttgatttttagcattagctggtagtttggcttggaaatgtcctggatagccgattccctaagaaactgaaacatttaatattggcttaggatgtatcagatggggccaaataaagcttctttacaatagtaaaagcactttatacttcactctctgagtcttcccaataaataaccttgggaggtgcagggggtggggggcccaggatggggaggcctgggagctcccagggtagtgacagagttgggctgagttctccagacgccaggatgcgtcgcagcggggccagctcaggagtgctcactcccagccctctggatctctctcctggttggaataatcattacatatcgtaactctcaaaatttattcacttatattttcagaataagaagtgtgaaatgttaacagctctctgctctcttacttgttccccatttggggatcttctggagggaaggggcagggggagagtaacttttctatatccttggtttctaggaacacatcgatttgaagactcagtagctgactggtttttttttttcccccttcaaactgaagtgcgagtgtgcgtgtgttccacaaaatagcaagtatttatagtgttgtaattacatttccttgagaaatattttcttgtatttaaaaatctttctacttcagtaactcccagcagaacagtgcccaggacagcatgtgccggttagtaccagctttgcaggtgagctgacttctaaacttaggacgacgtcttcatcaatcaaactagtgcacagtccagaaaaaggggtcctttatcttctaagttctgctcctcacctttctttggaaccaaaattgcagtggagtgtgaggaagagctttgaaagacgtggagtgttgagatgtctgcattgcacattcagccggttcaaagccagcagctcctgcctgcattctgtagacatcgccctcacacacagtcctctgatggctctcatataaagcactcaaaccgtaggaaagcatgtttttgagcaacgtgtctgggatactcctctgtgtggttattttgaatctctatttctgtcattgaagcagcaaaaaacatcatgtgactcatcaactgatctaatcacacttaaaacaggatgtagagaaaaatctgatgagaaacgtaaaagggcctgttgcctgcccttttaaaggcaaaatgtctaaaatcatgcaaatgttcaaaatgagagaaattgcattgtggaatcaaaataacccaaactccactcagaaaagtcacaaatatatagtatactatctgatctcaaaagggaaaaacgagatgataagaccttaagtttagactttattttcttctcaagagtggacattaaatctattaacttgcaactttctgctgggaagagcatcaaaggtgggcctcctaaatcatttttgaaaaacctctgtcaagtccaagtggttccaggagaattatagccagtatcttttaaaatatttcattttagtgataatgtttttctctgcttcatttgcaatcaaccaggatctctaaaagactgcataagatatatgcacttttataggtggctgtcagctacacatagattcagcaaattttttttatatagtacctgtttttaagttaggctacataacttaaagtgcactttactaacaagacttgacattagcgtctacaatatgtatatgtaaacaaaagcacacaagaactaggcaccctttctctctccaagagtttaagtggtttccttaggttaaagaaggggacagaccagctaaaaatggttgtaccactcactgtacaacctcatggaaattctcactataagatttagaggcaatgttccctagctataagccagggcaagaaatggcgcctctggagttggggaacattaggggaacattacaaccgggtagatgctggttccctgaagtgtggggccatgaacatgcagggacccacggtttgaatgaaacagctactgaaagctaagttcaaaccacccttgcgtaacaaaggagtacagggtacacatcaacaccaatcacccagcaccccacagcgatggtcatgtcaccgtgcagcaggtcccttaccccagggctgccacatccacaagccttgcagtggcaaatacgctgctccttggatttaatgagatattttggttgcttaatgatgtactgatcagggaactgtctaaagctagtagggccaaggagttaatcaaagggcttcgggaaagtggacaagagccacacacgtgattctgttccatgccgacactcattcatttaagaagtgtattcaagctggaggcttccatatcactcacgcttcttggcctcaccttgctcatctgtccaatgggaggcttgagccattattgctaaggccccttcctgatctaacattctgtttatgatctaggatttagaacgtcgtatgagatcctacaatggaagaataaaatcacctcattcttcatttcagatctgaacattagcagtgatctagatttttttttttttaaacaaaattaagtgtgcttagagtcattcctctacatgggctgtggctgtcagcccataggtttgtcagtttcacatcaaaactgtgggtataaactgttgaaaccaatcacattaaaatatttagctgggcacagtggtgtgcatctgtagtcccagctacttgggaggctgaggcaggaggatcgcttaagcacaggagttggaatccagcctgagcaacagagcaaaaccccgtctctaaaatacaaataaaatatttgtgtagtttttgattaaaattgactacagcggtcagtataaaatacatgtcgcttttaaggaagtgctctttatgtatctaacagatggaagtttttgcattggtaagagcatttatatatgctttgtttcagggtttatggatttgtattcatatattgtcaaataggtttcatactctaattttactttaagtaaagcttaaacacttggcatacaa

SEQ ID NO: 107295 - DNA, 1866 bp, Homo sapiens
  Payload ID: 1063
  Gene Symbol: ANKH
  Gene Name: ANKH inorganic pyrophosphate transport regulator
  ENST ID: ENST00000505140
  CDS Start-End: 280-660
ccgccgccgtccctcctcttttttttcccggcagatctttgttgtgtgggagggcagcagggatggacttgagcttgcggatcccctgctagagcagccgcgctcggagaaggcgccgcagccgcgaggaggagccgccgccgccgcgcccgaggccccgccgcccgcggcctctgtcggcccgcgccccgctcgccccgtcgccccgtcgcccctcgcctccccgcagagtcccctcgcggcagcagatgtgtgtggggtcagcccacggcggggactatggtgaaattcccggcgctcacgcactactggcccctgatccggttcttggtgcccctgggcatcaccaacatagccatcgacttcggggagcaggtaagccccggccccgcgccccacgcccgctcgccctgccttggccttacacgcccggacacgggggcggaggggagtcacctgctccgagtccctctttatcctgaaacatttggtcgggtgtgcagcttgtcaagggtgacttttccagcaccccattccctccctccctcccctcaattattcagcagacttttccagccctctctggaaaatgttaaaaagactggatggtgtgaagcttcacctatggaagggtttttagtgcacggcagtattatgtaatttgcgattatgtaaacctcagctctaattaaaatgtagtttctagtagcttaagtgctgggtttttatttacccatggctggtggtaatggtgacggtggggagattctgttttataatgcgtccaagttgatttcccaggtacttccatttttaaacatttgtttcgtagtccaggtaaggattaggggtatcccgaatgtgtcctgataagccggtcttgaccatttatttctagtttgggatttcttttttttccttttccttttctttttttttctttctttctttctttcttttttttttttcatggaccactaaagaaggggagcacatttttgtttggggtcgccttctcgtccttgtttcttttcacgttttctccatgtggcgtcattgaaaatctagcgctgcaagctctccagcgatggggcattggcaccctgcactttgcatgtggggaccgttttggcagggccaccagcgggatgcagctgcgttctaaggccggggagaggatttggtgatggggaggcagtgacatgccaccctgatgggcaggtgtcccaagtggccagagcgtgtgacgagcggcactcctgtattgtggtactgtctttcttctttccttttaagtcaagagacttaaacggatatttatctagaatatgcacctattttgatgcagtactcattgtaaaagtaaaacagctttcaggaggcagttacaaatcggagatttgtgtgactccttcgtttgacgaatatctgtttggatttgtctttctgtgctcaaaacttttgaataattgcaactctgtaagctctctaatatgtagcccacattgtaagctactttttactttgaattttgttggtgataggtgtattacaccttgctgggagtgaatgatggcttatttgtcagcgatttacaaatcctaagatggagaggtagcacgggagtacaaaggccaatgcagcctcaggttcacgtgcttttgagatgattaagaaatgcaaagttaggctgggcaaggtggctcatgcctatgatcgtagcacttggggagatcaatcctagcactttgggaggcttaggctagaggattgcttaggctaaggtgggaggatcgcttgagctcaggagttcaaaaccagcctgggcaacatagtgaaacctcgtctctattaaaaaaaaaaaaa

SEQ ID NO: 107296 - DNA, 2243 bp, Homo sapiens
  Payload ID: 1064
  Gene Symbol: ANKHD1-EIF4EBP3
  Gene Name: ANKHD1-EIF4EBP3 readthrough
  ENST ID: ENST00000437495
  CDS Start-End: 1-1911
tcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttgggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatgtgactctcctattccatctgtttcttcgggatcatcttcacctctttcagccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatgggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcaggccagtctgcttccttcagtccctgctctcaaaggggaaatcccatcacctcagctaaccagaccgaagaagagaattggacggccgatggtggcctctcctaaccagaggcaccaggatcatctacgaccgaaagttcctgctggagtgcaagaactcacccattgcccggacacccccctgctgcctccctcagattcccggggtcacaactcctccaacagcccctctctccaagctggaggagctgaaggagcaggagacagaggaagagatacccgatgacgcacaatttgaaatggacatctaatccagtgcagatgacctggcatgtggagttacagagggatccctcatgccactgctgccaccacctcttcctggggcatccaaaggccagctggcctcatctaatctggaagggagtgacttgttagttccaggcctcctttagttctgaggcagctagaccagggataggagtgggcaacttgccaagcccttaactctacttcctcttcagtctgtggtactcctcctaaccctaaaccctctatgctcaggggctggaactggggaatggagtaagtcaccttctgactgcttagtaaacattc

SEQ ID NO: 107297 - DNA, 8246 bp, Homo sapiens
  Payload ID: 1064
  Gene Symbol: ANKHD1-EIF4EBP3
  Gene Name: ANKHD1-EIF4EBP3 readthrough
  ENST ID: ENST00000532219
  CDS Start-End: 61-7914
gatcagcggcggcggtgaccgcgagtgggtcggcaccgtctccggctccgggtgcgaacaatgctgactgatagcggaggcggcggcacctcctttgaggaggacctggactctgtggctccgcgatccgccccagctggggcctcggagccgcctccgccgggaggggtcggtctggggatccgcaccgtgaggctctttggggaggccgggccagcgtcgggagtcggcagcagcggcggcggcggcagcggcagcggtacgggcggaggggacgcggcgctggatttcaagttggcggctgccgtgctgaggaccgggggtggaggtggtgcctctggcagtgacgaggacgaagtgtccgaggttgaatcatttattttggaccaagaagatctggataacccagtgcttaaaacaacatcagagatattcttatcaagtactgcagaaggagcagacttacgcactgtggatccagagacacaggcacgactagaagcattgctagaagcagcaggaattggcaaattgtcaactgctgatggtaaagcttttgcagatcctgaggtactccggagactgacatcctcagttagttgtgcactggatgaagctgctgctgcactgacacggatgaaagcagaaaacagccacaatgcaggacaagtggacactcgcagtctagcagaagcttgttcagatggggatgttaatgctgttcgtaaattgctagatgaaggcagaagtgtaaatgaacatacagaagaaggagaaagcctgctgtgtttggcttgttcagcagggtattatgaattagcacaagtattgcttgctatgcatgctaatgttgaagatcgagggaataaaggagacataactcccctgatggcagcttccagtggaggttacttagatattgtgaaattattacttcttcatgatgctgatgtcaactcccagtctgcaacaggaaacactgcgctaacttatgcatgtgctggaggatttgttgacattgttaaagtgctccttaatgaaggtgcaaatatagaagatcataatgaaaatggacatactcccttaatggaagcagccagtgcaggtcatgtggaagttgcaagagttcttttagatcatggtgcaggcatcaacactcattctaatgaattcaaagaaagtgctctaacacttgcttgctacaaaggccatttggatatggttcgctttctacttgaagctggtgcagatcaagagcacaaaacagatgagatgcacactgccttaatggaggcctgcatggatggacatgtagaggtggcacgtttgcttttggatagtggtgctcaagtgaacatgcctgcagattcatttgaatctccattgacgctagctgcctgtggaggacatgttgaattggcagctctacttattgaaaggggagcaaatcttgaagaagttaatgatgaaggatacactcccttgatggaagctgcccgggaaggacatgaagaaatggtggcactactcttagcacaaggagcaaatataaatgcccagacagaagaaactcaagaaactgctcttactttggcttgctgtggaggattttctgaagttgcagactttcttattaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagaacatgaatctgaaggtggaagaacacctttgatgaaagctgcaagagctggtcatttgtgcactgtgcagtttcttattagcaaaggtgccaatgttaacagggctacagccaataatgatcatacagtagtgtcgctggcatgtgcaggaggccacctggcagttgttgagcttctcttggctcatggggctgaccctactcatcgactcaaggatggttcaacaatgctcattgaagctgcaaagggtggccatactaatgtagtttcttatctgttggattatccaaataatgttctgtcagttcccaccacagatgtgtctcagctccctccaccttctcaagatcagtctcaggtgccacgtgtgccaacgcatacacttgccatggttgtacctccccaggaacctgacagaacttcacaggagaactctcctgcccttttaggagtgcaaaaaggtacatccaagcagaagtccagttccctccaggtagcagatcaggacctactgccatcttttcacccataccagcctttggagtgcatagtagaggagactgaaggcaagctgaatgaactgggacaaagaattagtgctattgaaaaagcacagcttaagtcactggagttaattcaaggtgaacctctgaacaaagataagatagaagaacttaaaaagaacagagaagagcaagtccagaagaagaagaaaatattgaaagaactgcagaaagtggaaaggcagttgcagatgaaaacacagcagcaatttaccaaagaatacttggaaaccaaaggtcagaaagacacagtgtctctacaccaacagtgctctcatagaggagtcttcccagaaggggaaggagatggtagtctcccagaggatcacttttcagagttacctcaggttgacacaatcttatttaaagataatgatgttgatgatgagcaacagtctccaccatcggcagaacagattgattttgtcccagtccagcctttatcatctccacagtgtaacttttccagtgacttaggttctaatgggacaaattctcttgaacttcagaaagtatcaggtaatcagcagattgtaggacagcctcagattgctattactggacatgatcaggggctgttagttcaagaaccagatggactaatggttgcaactccagctcagacgcttaccgacactcttgatgacctgatagcagctgtgagtaccagagtgcccactggttccaacagttcttctcagaccacagagtgtcttacacctgaatcctgttcgcagactacaagcaatgtggcttcccaatcgatgcctcctgtgtatccttcagttgacattgatgcacatactgagagcaatcatgacacagcattaacactagcttgtgcaggtggtcatgaagaacttgtatctgtgctcattgcacgggatgccaaaattgaacacagagacaaaaaaggtttcacaccactaatcctggcagcaacagcagggcatgttggagttgttgaaatccttttggataaaggtggagatatagaagcacagtctgaacgaactaaggatactccgctttcattggcatgttctggtggacgtcaggaggtggtagacttgctgctggctcgaggtgcaaataaagaacataggaacgtatctgattatacaccactgagtctagctgcgtctggaggatatgttaatatcattaagattctgcttaatgctggggcagaaattaattcaaggactgggagtaaactaggtatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaagggtcatgtaaaagttgttcaatatttggtaaaggaagtaaatcagttcccttctgatatagaatgcatgagatacatagcaacaattacagataaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttgggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatggcaagtggttttgtggatttttctaaaggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcaggccagtctgcttccttcagtccctgctctcaaaggggaaatcccatcacctcagctaaccagaccgaagaagagaattggacggccgatggtggcctctcctaaccagaggcaccaggatcatctacgaccgaaagttcctgctggagtgcaagaactcacccattgcccggacacccccctgctgcctccctcagattcccggggtcacaactcctccaacagcccctctctccaagctggaggagctgaaggagcaggagacagaggaagagatacccgatgacgcacaatttgaaatggacatctaatccagtgcagatgacctggcatgtggagttacagagggatccctcatgccactgctgccaccacctcttcctggggcatccaaaggccagctggcctcatctaatctggaagggagtgacttgttagttccaggcctcctttagttctgaggcagctagaccagggataggagtgggcaacttgccaagcccttaactctacttcctcttcagtctgtggtactcctcctaaccctaaaccctctatgctcaggggctggaactggggaatggagtaagtcaccttctgactgcttagtaaacattc

SEQ ID NO: 107298 - DNA, 6379 bp, Homo sapiens
  Payload ID: 1065
  Gene Symbol: ANK1
  Gene Name: ankyrin 1, erythrocytic
  Uniprot ID: P16157
  ENST ID: ENST00000265709
  CDS Start-End: 283-5976
gggaggcggcgggccctgcccagagcccgtcccgggcgccggcaagcgagctccggccgcggcggcagcgccatcccgggccgcgggcagccgcccctcgccctccgcgtccggaactgccttcgccttcccgcgaccccgcagcagccggccctcggggcgccacgaacgctgtcccctctgtggagcagagacccccttccccttcttagggggtgtcgcctcggggatcgctgagcgctaggggtccaggaggcggggacgggagcgccgtgacccgccatggctcaagcggccaaacagctgaagaaaatcaaagacatcgaggcgcaggccctccaggagcagaaggagaaggaggaatccaacaggaagcggagaaaccgctcccgtgaccgaaagaagaaggccgatgctgctaccagctttctgagagcagcaagatcaggtaacttggacaaagctttggatcacctgcggaatggggtagatattaacacctgtaaccagaatgggttgaatggcttgcatctggcttctaaggaaggccatgtgaaaatggtggttgaacttctgcacaaagaaatcattctagaaacgacaaccaagaaggggaacacggccctgcacatcgctgctctagccgggcaggatgaggtggtccgggagcttgtcaactatggagccaacgtcaacgcccagtcacagaaaggttttacacccctgtacatggcagcacaagagaaccacttggaagtggttaagtttttactggaaaatggagctaaccagaatgtagccacagaagacggcttcacgcctctggcggtagccctgcagcagggccatgagaacgtcgtcgcgcacctcatcaactacggcaccaaggggaaggtgcgcctcccggccctgcacatcgcggcccgcaacgacgacacgcgcacggctgcggtgctgctgcagaacgaccccaacccggacgtgctttccaagacgggattcacgcccctgcacattgcggctcactacgagaacctcaacgtggcccagttgctcctcaacagaggagccagcgtcaatttcacaccacagaacggcatcacgccactgcacatcgcctcccgcaggggcaacgtgatcatggtgcggctgctgctggatcggggagcccagatagaaaccaagaccaaggacgaattgacacctctccactgtgcagctcgaaatgggcacgtgcgaatctcagagatcctgctggaccacggggcaccaatccaagccaaaaccaagaacggcctgtccccaattcacatggcggctcagggagaccacctcgactgtgtccggctcctgttgcaatacgacgcagagatagacgacatcaccctggaccacctgaccccactccacgtggctgcccactgtggacaccacagggtggctaaggtccttctggataaaggggccaaacccaactccagagccctgaatggctttacccccttacacatcgcctgcaaaaagaaccacgtccgtgtcatggagctgctgctgaagacgggagcctcgatcgacgcggtcaccgagtctggcctgacacctctccacgtggcctccttcatggggcaccttcccatcgtgaagaacctcctgcagcggggggcgtcgcccaacgtctccaacgtgaaagtggagaccccgctacacatggcagccagagccgggcacacggaagtggccaaatatttactccagaacaaagccaaagtcaatgccaaggccaaggatgaccagaccccacttcactgtgcagctcgcatcggccacacaaacatggtgaagctcctgctggaaaataacgccaaccccaacctggccaccaccgccgggcacacccccctgcacattgcagcccgtgagggccatgtggaaacagtcctggcccttctggaaaaggaagcatcccaggcctgcatgaccaagaaaggatttacccctctgcacgtggcggccaagtacgggaaggtgcgggtggcagagctgctgctggagcgggacgcacacccgaatgctgccggaaaaaatggcctgacccccctgcacgtggccgtccatcacaacaacctggacatcgtcaagctgctgcttccccggggcggctccccgcacagccctgcctggaatggctacacccctttgcacatcgctgccaagcagaaccaggtggaggtggcccgtagtctgctgcagtatgggggctcagcaaacgccgagtcggtgcaaggtgtgacgccccttcacctggccgcccaggagggccacgcagagatggtggctctgctgctctcgaaacaagccaatggcaacctggggaacaagagcggactcactcccctccatctggtagcacaagaaggccacgttccagtggcagatgtgctgatcaaacacggcgtcatggtggacgccaccacccggatgggctacactcccctccatgtggccagtcactatggaaacatcaagctggtgaagtttctgctgcagcaccaggcagatgtcaatgccaagaccaagctaggatacagccccctgcaccaggcagcccagcagggacacacagacatcgtgactctgcttctgaaaaacggtgcttccccaaacgaggtcagctcggatggaaccacacctctggccatagccaagcgcttgggctacatttctgtcaccgacgtgctcaaggtcgtcacggatgaaaccagtttcgtgttagtcagtgataagcatcgaatgagtttccctgagacagttgatgagatcctggatgtctcggaagatgaaggaactgctcatataactataatgggggaagaactcatcagcttcaaggctgagaggcgggattccagggatgttgatgaagagaaggagctgctggattttgtgccgaagctagaccaagtggtggaatctccagccatccccaggattccctgtgccatgcctgagacagtggtgatcaggtcagaagagcaggagcaggcatctaaagagtatgatgaggactccctcatccccagcagcccggccaccgagacctcagacaacatcagcccggtggccagcccggtgcatacagggtttctggtgagcttcatggttgacgcccggggtggttccatgagaggaagtcgccacaacggcctgcgagtggtgatcccgccacggacgtgcgcagcgcccacccgcatcacctgccgcctggtcaagccccagaagctcagcacgccgcccccactggccgaggaggagggcctggccagcaggatcatagcactggggcccacgggggcacagttcctgagccctgtaatcgtggagatcccgcactttgcctcccatggccgtggagaccgcgagctcgtggttctgaggagcgaaaacggctccgtgtggaaggagcacaggagccgctatggagagagctacctggatcagatcctcaacgggatggacgaagagctggggagcctggaggagctagagaagaagagggtgtgccgaatcatcaccaccgacttcccgctgtacttcgtgatcatgtcacggctctgccaggactacgacaccatcggtcccgaagggggctccctgaagagcaagctggtgcccctggtacaggcaacgttcccggagaatgccgtcaccaagagagtgaagctggctctgcaggcccagcctgtcccggatgagcttgtcactaagctcctgggcaaccaggccacattcagccccattgtcaccgtggagccccggcgccggaagttccaccgccccattgggcttcggatcccactacctccttcctggaccgacaacccgagggacagcggggagggagacaccaccagcctgcgcctgctttgcagcgtcattggaggaacagaccaagcccagtgggaagacataacaggaaccaccaaacttgtatatgccaacgagtgcgccaacttcaccaccaatgtctctgccaggttttggctgtcggactgtcctcggactgctgaggctgtgaactttgccaccctgctgtacaaagagctcactgcagtgccctacatggccaaattcgtcatctttgccaagatgaatgacccccgagaggggcgcctgcgctgctactgcatgacagatgataaagtggacaagaccctggagcagcatgagaacttcgtggaggtggcccggagcagggacatagaggtgttggaaggaatgtccctgtttgcagaactctctgggaacctggtgcctgtgaagaaagctgcccagcagcggagcttccacttccagtcatttcgggagaaccgtctggccatgcctgtaaaggtgagggacagcagtcgagagccgggagggtccctgtcgtttctgcgcaaggcgatgaagtacgaggacacccagcacattctctgccacctgaacatcaccatgcccccctgcgccaagggaagtggagccgaagataggagaaggaccccgacgcccctggccctgcgatacagcattctcagtgagtccacaccaggttctctcagtgggacagagcaggcagagatgaagatggctgttatctcagagcacctcggtctcagctgggcagagttggcccgggagctgcagttcagtgtggaagacatcaacaggatccgagtggaaaatcccaactccctgttggagcagagtgtggccttgctgaacctctgggtcatccgtgaaggccaaaacgcaaacatggagaatctgtacacagccctgcagagcattgaccgtggcgagatcgtgaacatgctggagggttccggccgacagagccgcaacttgaagccagacaggcggcacaccgaccgcgactactcgctgtcaccctcccagatgaatggttactcctcactgcaggacgagctgctgtcccctgcctccctgggctgtgcactttcctctccgctacgtgcagaccagtactggaatgaggtggccgtcctagacgccatccccttggcggccacggagcatgacaccatgctggagatgtctgacatgcaggtgtggtctgcgggcctcacgccttctctggtcactgctgaggactcctctctggagtgtagcaaggctgaggactctgatgccacaggtcacgagtggaagttggagggggcactctcagaggaaccgcggggccccgagttgggctctctggaacttgtggaggacgacacagtggattcagatgccacaaatggccttatcgatttgcttgaacaggaggaaggtcagaggtcagaagagaagctgccaggttctaagaggcaggatgacgcgacaggtgcagggcaggactcagagaatgaagtgtctcttgtttcaggccatcagagggggcaagcccgaatcacacattcccccaccgtgagtcaggtgacggagaggagtcaggacagactgcaggactgggatgcagacggctcgattgtctcatacctgcaagatgctgcacaaggttcctggcaagaggaggtcacgcaaggtccacactcattccagggaacaagtaccatgactgaagggctagagcccggtggatctcaggagtacgagaaggtcctggtgtctgtaagtgagcacacgtggacagaacagcccgaggctgagagctcccaggccgacagggaccggaggcagcaaggccaagaagagcaggtgcaggaggccaagaacaccttcacccaagtggtgcaggggaatgagtttcagaatattccaggggagcaggtgacagaggagcaattcacggatgagcagggcaacattgtcaccaagaagatcattcgcaaggtggttcgacagatagacttgtccagcgccgatgccgcccaggagcacgaggaggatcacacctcgacacccaacccctgaaccccacacactctgccatgcacacaggaggagagctggacctgagggccaccgcagcggtgcacacattcctctgggctgacggcatgacctctgtaagggactcctgctagtcccctcttggcatgaatgactgactgtagacgcatgacctccaggcttcaatcctgcctcttgcaatgacagctgatctgtcggaaccaggacacaaaagcagcaagaagcggggagagagagggatagaaaacaagcgcaggagagcctgcgaacgcaaaagtgaatgagggctttttgtggctggggatgggttttggttttggggttttttttttaaattgttttgacttcgtacagggtactttttcccaacctcatctgtcagaaatccatgtgggcttcctgg

SEQ ID NO: 107299 - DNA, 8297 bp, Homo sapiens
  Payload ID: 1065
  Gene Symbol: ANK1
  Gene Name: ankyrin 1, erythrocytic
  Uniprot ID: P16157
  ENST ID: ENST00000289734
  CDS Start-End: 85-5727
agaggctgcggtgagtccgccagccccagctgctcctcctcaagcccccaaggcccttcggcgggcccctgctgaaagaccggcatgccctattctgtgggcttccgcgaagccgatgctgctaccagctttctgagagcagcaagatcaggtaacttggacaaagctttggatcacctgcggaatggggtagatattaacacctgtaaccagaatgggttgaatggcttgcatctggcttctaaggaaggccatgtgaaaatggtggttgaacttctgcacaaagaaatcattctagaaacgacaaccaagaaggggaacacggccctgcacatcgctgctctagccgggcaggatgaggtggtccgggagcttgtcaactatggagccaacgtcaacgcccagtcacagaaaggttttacacccctgtacatggcagcacaagagaaccacttggaagtggttaagtttttactggaaaatggagctaaccagaatgtagccacagaagacggcttcacgcctctggcggtagccctgcagcagggccatgagaacgtcgtcgcgcacctcatcaactacggcaccaaggggaaggtgcgcctcccggccctgcacatcgcggcccgcaacgacgacacgcgcacggctgcggtgctgctgcagaacgaccccaacccggacgtgctttccaagacgggattcacgcccctgcacattgcggctcactacgagaacctcaacgtggcccagttgctcctcaacagaggagccagcgtcaatttcacaccacagaacggcatcacgccactgcacatcgcctcccgcaggggcaacgtgatcatggtgcggctgctgctggatcggggagcccagatagaaaccaagaccaaggacgaattgacacctctccactgtgcagctcgaaatgggcacgtgcgaatctcagagatcctgctggaccacggggcaccaatccaagccaaaaccaagaacggcctgtccccaattcacatggcggctcagggagaccacctcgactgtgtccggctcctgttgcaatacgacgcagagatagacgacatcaccctggaccacctgaccccactccacgtggctgcccactgtggacaccacagggtggctaaggtccttctggataaaggggccaaacccaactccagagccctgaatggctttacccccttacacatcgcctgcaaaaagaaccacgtccgtgtcatggagctgctgctgaagacgggagcctcgatcgacgcggtcaccgagtctggcctgacacctctccacgtggcctccttcatggggcaccttcccatcgtgaagaacctcctgcagcggggggcgtcgcccaacgtctccaacgtgaaagtggagaccccgctacacatggcagccagagccgggcacacggaagtggccaaatatttactccagaacaaagccaaagtcaatgccaaggccaaggatgaccagaccccacttcactgtgcagctcgcatcggccacacaaacatggtgaagctcctgctggaaaataacgccaaccccaacctggccaccaccgccgggcacacccccctgcacattgcagcccgtgagggccatgtggaaacagtcctggcccttctggaaaaggaagcatcccaggcctgcatgaccaagaaaggatttacccctctgcacgtggcggccaagtacgggaaggtgcgggtggcagagctgctgctggagcgggacgcacacccgaatgctgccggaaaaaatggcctgacccccctgcacgtggccgtccatcacaacaacctggacatcgtcaagctgctgcttccccggggcggctccccgcacagccctgcctggaatggctacacccctttgcacatcgctgccaagcagaaccaggtggaggtggcccgtagtctgctgcagtatgggggctcagcaaacgccgagtcggtgcaaggtgtgacgccccttcacctggccgcccaggagggccacgcagagatggtggctctgctgctctcgaaacaagccaatggcaacctggggaacaagagcggactcactcccctccatctggtagcacaagaaggccacgttccagtggcagatgtgctgatcaaacacggcgtcatggtggacgccaccacccggatgggctacactcccctccatgtggccagtcactatggaaacatcaagctggtgaagtttctgctgcagcaccaggcagatgtcaatgccaagaccaagctaggatacagccccctgcaccaggcagcccagcagggacacacagacatcgtgactctgcttctgaaaaacggtgcttccccaaacgaggtcagctcggatggaaccacacctctggccatagccaagcgcttgggctacatttctgtcaccgacgtgctcaaggtcgtcacggatgaaaccagtttcgtgttagtcagtgataagcatcgaatgagtttccctgagacagttgatgagatcctggatgtctcggaagatgaaggggaagaactcatcagcttcaaggctgagaggcgggattccagggatgttgatgaagagaaggagctgctggattttgtgccgaagctagaccaagtggtggaatctccagccatccccaggattccctgtgccatgcctgagacagtggtgatcaggtcagaagagcaggagcaggcatctaaagagtatgatgaggactccctcatccccagcagcccggccaccgagacctcagacaacatcagcccggtggccagcccggtgcatacagggtttctggtgagcttcatggttgacgcccggggtggttccatgagaggaagtcgccacaacggcctgcgagtggtgatcccgccacggacgtgcgcagcgcccacccgcatcacctgccgcctggtcaagccccagaagctcagcacgccgcccccactggccgaggaggagggcctggccagcaggatcatagcactggggcccacgggggcacagttcctgagccctgtaatcgtggagatcccgcactttgcctcccatggccgtggagaccgcgagctcgtggttctgaggagcgaaaacggctccgtgtggaaggagcacaggagccgctatggagagagctacctggatcagatcctcaacgggatggacgaagagctggggagcctggaggagctagagaagaagagggtgtgccgaatcatcaccaccgacttcccgctgtacttcgtgatcatgtcacggctctgccaggactacgacaccatcggtcccgaagggggctccctgaagagcaagctggtgcccctggtacaggcaacgttcccggagaatgccgtcaccaagagagtgaagctggctctgcaggcccagcctgtcccggatgagcttgtcactaagctcctgggcaaccaggccacattcagccccattgtcaccgtggagccccggcgccggaagttccaccgccccattgggcttcggatcccactacctccttcctggaccgacaacccgagggacagcggggagggagacaccaccagcctgcgcctgctttgcagcgtcattggaggaacagaccaagcccagtgggaagacataacaggaaccaccaaacttgtatatgccaacgagtgcgccaacttcaccaccaatgtctctgccaggttttggctgtcggactgtcctcggactgctgaggctgtgaactttgccaccctgctgtacaaagagctcactgcagtgccctacatggccaaattcgtcatctttgccaagatgaatgacccccgagaggggcgcctgcgctgctactgcatgacagatgataaagtggacaagaccctggagcagcatgagaacttcgtggaggtggcccggagcagggacatagaggtgttggaaggaatgtccctgtttgcagaactctctgggaacctggtgcctgtgaagaaagctgcccagcagcggagcttccacttccagtcatttcgggagaaccgtctggccatgcctgtaaaggtgagggacagcagtcgagagccgggagggtccctgtcgtttctgcgcaaggcgatgaagtacgaggacacccagcacattctctgccacctgaacatcaccatgcccccctgcgccaagggaagtggagccgaagataggagaaggaccccgacgcccctggccctgcgatacagcattctcagtgagtccacaccaggttctctcagtgggacagagcaggcagagatgaagatggctgttatctcagagcacctcggtctcagctgggcagagttggcccgggagctgcagttcagtgtggaagacatcaacaggatccgagtggaaaatcccaactccctgttggagcagagtgtggccttgctgaacctctgggtcatccgtgaaggccaaaacgcaaacatggagaatctgtacacagccctgcagagcattgaccgtggcgagatcgtgaacatgctggagggttccggccgacagagccgcaacttgaagccagacaggcggcacaccgaccgcgactactcgctgtcaccctcccagatgaatggttactcctcactgcaggacgagctgctgtcccctgcctccctgggctgtgcactttcctctccgctacgtgcagaccagtactggaatgaggtggccgtcctagacgccatccccttggcggccacggagcatgacaccatgctggagatgtctgacatgcaggtgtggtctgcgggcctcacgccttctctggtcactgctgaggactcctctctggagtgtagcaaggctgaggactctgatgccacaggtcacgagtggaagttggagggggcactctcagaggaaccgcggggccccgagttgggctctctggaacttgtggaggacgacacagtggattcagatgccacaaatggccttatcgatttgcttgaacaggaggaaggtcagaggtcagaagagaagctgccaggttctaagaggcaggatgacgcgacaggtgcagggcaggactcagagaatgaagtgtctcttgtttcaggccatcagagggggcaagcccgaatcacacattcccccaccgtgagtcaggtgacggagaggagtcaggacagactgcaggactgggatgcagacggctcgattgtctcatacctgcaagatgctgcacaaggttcctggcaagaggaggtcacgcaaggtccacactcattccagggaacaagtaccatgactgaagggctagagcccggtggatctcaggagtacgagaaggtcctggtgtctgtaagtgagcacacgtggacagaacagcccgaggctgagagctcccaggccgacagggaccggaggcagcaaggccaagaagagcaggtgcaggaggccaagaacaccttcacccaagtggtgcaggggaatgagtttcagaatattccaggggagcaggtgacagaggagcaattcacggatgagcagggcaacattgtcaccaagaagatcattcgcaaggtggttcgacagatagacttgtccagcgccgatgccgcccaggagcacgaggaggtggagctgagagggagtggcctacagccggacctgatagagggcaggaagggggcgcagatagtgaagcgggccagcctgaaaagggggaaacagtgaccccgagccgctctccttggagtagcctctcgggaggatcacacctcgacacccaacccctgaaccccacacactctgccatgcacacaggaggagagctggacctgagggccaccgcagcggtgcacacattcctctgggctgacggcatgacctctgtaagggactcctgctagtcccctcttggcatgaatgactgactgtagacgcatgacctccaggcttcaatcctgcctcttgcaatgacagctgatctgtcggaaccaggacacaaaagcagcaagaagcggggagagagagggatagaaaacaagcgcaggagagcctgcgaacgcaaaagtgaatgagggctttttgtggctggggatgggttttggttttggggttttttttttaaattgttttgacttcgtacagggtactttttcccaacctcatctgtcagaaatccatgtgggcttcctggaaagaaaaaaaaaaaaaagaaaactaggcatgaaatcagtttaacaccttaatcttaagccatgtcctcatctgcccaccctccccaacccacatacctccattccacttgtgacaccccctcgactccctggtgacgctcctcccagatcgctctacatgacattcaggacacacacacacacacacacacaccactcgcctccactgaatctacacacagattttactgtgacttctgaagctgtatagactctgctgtggataaattggaattttttatgttgtctctctctctgccaatttcaatacgaatcatcttccaatggaaaatcattaccttgaagagtgcattcggggttccttgtgttagggacttaagaatctgaggcgaggacccccaggcttacctgtaggactcaaagggagccaggaccccatctgaaagggtctcctctctcagttgggggacaggccggtggctgacccaggattgcaccagcatgtccatagagaagaggttttctatgtcttcaagcactatatcatagtccgtgttcaaagtgtaaactgtacagtaatcagccttgtgtatatgaaaaacaataaatactatgcaaaccaatagaaacatttagcagtacgtacagagcctgacagcgcagctcctgaggacttctgcggctgcaggagaaggagctgtggcctgtctttcagtgaaagaggaaggaaaggagtagggctagtgaatgtatctgccaggtcttagaagtcaggaccacccagggtctcccagagtgaacttggtgctctaagtccaggcagcctgcaggctggggaccctgggtgcaggtgccaggctcgaggctgttccctgtcctgcctcagtgcctcccctctgcccagcccctgtggcctcttggagaggcgagccagggggctccccggaccgcatggccggtgagagtagagtcggaggcggagagcctggacgcccagaggccggggccaggctctgggtcaaggcaggaaggagacagacagctggcagttcctcgcctcggtgccatcagggaggagccttaagttccactagagcctccggcccagggaggccagaatcagcacaatcccggccccgccctcgcggcgggcgcccccagggccaggagagagagacagggctggctcctctcgcccctggagccgcggtgtggacggcccggccccgtccgccccgccgctctgcgggagtgtcctcgggacacacttaaaccttccaagtagcacagaagccccctccacgtcagaggccccctggccgcggggcctgtgagcggagaggggccctgcttcccacacaaatccgccccggtgcacccccggccaggcaggccccggggcggcctaggcgccttgtcggccgggggtggggctgcttttgcttcctttagaggggcgggcagggagaggaagctctagctccgggcctgagtttccccgaggctgcgtcggaggagctgcagggcgagcccggacggctgccgtctccgccagaggccaccccggcccggcctccagggcgcagaggcgcccccctccatcctcccccatcccgggggccacggcaggggggccgcacagcgcggctgggaccgattcggtgacggcccaaggaagctgggctcagggctcgcctctcccgcctcgatcctgcaccttcctctcccaggtcgctgctgcagccaacccagtagcccccttagcgcccccgcggaccccgcagctccagactccgctttggcacctctgctccggctggcatggctgcacgctccggctgctagtaggagccgttaggggaggagtttggggtctccacacgatgcctagagaatgctgcagtctgcacattagacgctttttagaagttttgaaattaccttgatttttttaattgttatgaaaatggatcttttcttgactctcccacatgctctgttatgggagagaatcccctaccctactctgatgtatagaccattctcccttcaccagccgaaccaatgtcaaaattaataaagaaatggactaatggcacaggg

SEQ ID NO: 107300 - DNA, 622 bp, Homo sapiens
  Payload ID: 1065
  Gene Symbol: ANK1
  Gene Name: ankyrin 1, erythrocytic
  Uniprot ID: P16157
  ENST ID: ENST00000348036
  CDS Start-End: 252-581
actcagggcagagcctggctgctgggcagaagggcacttgggccgggctgcttcagccgagagggccattcggtgtcctgcccacagagagagaaacagtgagagaccaagagagcaaaccagagagatagggagggggaatgcaaggggtccctgggggactcaggagtcccagtggagaatgagaggcaggccccccgtggtggccggggccctggctgccagaggaccgggctggtgaggaggcgaggatgtggactttcgtcacccagctgttggtcacgctggtgctgctgagcttcttcctggtcagctgtcagaacgtgatgcacattgtcagggggtccctgtgctttgtgctaaagcacatccaccaggagctggacaaggagctgggggagagcgagggcctcagtgacgacgaggagaccatctccaccagggtggtccggcggcgggtcttcctgaaggggaatgagtttcagaatattccaggggagcaggtgacagaggagcaattcacggatgagcagggcaacattgtcaccaagaaggatcacacctcgacacccaacccctgaaccccacacactctgccatgcacacaggaggagagctggac

SEQ ID NO: 107301 - DNA, 1185 bp, Homo sapiens
  Payload ID: 1065
  Gene Symbol: ANK1
  Gene Name: ankyrin 1, erythrocytic
  Uniprot ID: P16157
  ENST ID: ENST00000314214
  CDS Start-End: 252-719
actcagggcagagcctggctgctgggcagaagggcacttgggccgggctgcttcagccgagagggccattcggtgtcctgcccacagagagagaaacagtgagagaccaagagagcaaaccagagagatagggagggggaatgcaaggggtccctgggggactcaggagtcccagtggagaatgagaggcaggccccccgtggtggccggggccctggctgccagaggaccgggctggtgaggaggcgaggatgtggactttcgtcacccagctgttggtcacgctggtgctgctgagcttcttcctggtcagctgtcagaacgtgatgcacattgtcagggggtccctgtgctttgtgctaaagcacatccaccaggagctggacaaggagctgggggagagcgagggcctcagtgacgacgaggagaccatctccaccagggtggtccggcggcgggtcttcctgaaggggaatgagtttcagaatattccaggggagcaggtgacagaggagcaattcacggatgagcagggcaacattgtcaccaagaagatcattcgcaaggtggttcgacagatagacttgtccagcgccgatgccgcccaggagcacgaggaggtggagctgagagggagtggcctacagccggacctgatagagggcaggaagggggcgcagatagtgaagcgggccagcctgaaaagggggaaacagtgaccccgagccgctctccttggagtagcctctcgggaggatcacacctcgacacccaacccctgaaccccacacactctgccatgcacacaggaggagagctggacctgagggccaccgcagcggtgcacacattcctctgggctgacggcatgacctctgtaagggactcctgctagtcccctcttggcatgaatgactgactgtagacgcatgacctccaggcttcaatcctgcctcttgcaatgacagctgatctgtcggaaccaggacacaaaagcagcaagaagcggggagagagagggatagaaaacaagcgcaggagagcctgcgaacgcaaaagtgaatgagggctttttgtggctggggatgggttttggttttggggttttttttttaaattgttttgacttcgtacagggtactttttcccaacctcatctgtcagaaatccatgtgggcttcctgg

SEQ ID NO: 107302 - DNA, 525 bp, Homo sapiens
  Payload ID: 1065
  Gene Symbol: ANK1
  Gene Name: ankyrin 1, erythrocytic
  ENST ID: ENST00000335651
  CDS Start-End: 185-525
attcggtgtcctgcccacagagagagaaacagtgagagaccaagagagcaaaccagagagatagggagggggaatgcaaggggtccctgggggactcaggagtcccagtggagaatgagaggcaggccccccgtggtggccggggccctggctgccagaggaccgggctggtgaggaggcgaggatgtggactttcgtcacccagctgttggtcacgctggtgctgctgagcttcttcctggtcagctgtcagaacgtgatgcacattgtcagggggtccctgtgctttgtgctaaagcacatccaccaggagctggacaaggagctgggggagagcgagggcctcagtgacgacgaggagaccatctccaccagggtggtccggcggcgggtcttcctgaaggggaatgagtttcagaatattccaggggagcaggtgacagaggagcaattcacggatgagcagggcaacattgtcaccaagaaggtggagctgagagggagtggcctacagccggacctgat

SEQ ID NO: 107303 - DNA, 8237 bp, Homo sapiens
  Payload ID: 1065
  Gene Symbol: ANK1
  Gene Name: ankyrin 1, erythrocytic
  Uniprot ID: P16157
  ENST ID: ENST00000347528
  CDS Start-End: 85-5730
agaggctgcggtgagtccgccagccccagctgctcctcctcaagcccccaaggcccttcggcgggcccctgctgaaagaccggcatgccctattctgtgggcttccgcgaagccgatgctgctaccagctttctgagagcagcaagatcaggtaacttggacaaagctttggatcacctgcggaatggggtagatattaacacctgtaaccagaatgggttgaatggcttgcatctggcttctaaggaaggccatgtgaaaatggtggttgaacttctgcacaaagaaatcattctagaaacgacaaccaagaaggggaacacggccctgcacatcgctgctctagccgggcaggatgaggtggtccgggagcttgtcaactatggagccaacgtcaacgcccagtcacagaaaggttttacacccctgtacatggcagcacaagagaaccacttggaagtggttaagtttttactggaaaatggagctaaccagaatgtagccacagaagacggcttcacgcctctggcggtagccctgcagcagggccatgagaacgtcgtcgcgcacctcatcaactacggcaccaaggggaaggtgcgcctcccggccctgcacatcgcggcccgcaacgacgacacgcgcacggctgcggtgctgctgcagaacgaccccaacccggacgtgctttccaagacgggattcacgcccctgcacattgcggctcactacgagaacctcaacgtggcccagttgctcctcaacagaggagccagcgtcaatttcacaccacagaacggcatcacgccactgcacatcgcctcccgcaggggcaacgtgatcatggtgcggctgctgctggatcggggagcccagatagaaaccaagaccaaggacgaattgacacctctccactgtgcagctcgaaatgggcacgtgcgaatctcagagatcctgctggaccacggggcaccaatccaagccaaaaccaagaacggcctgtccccaattcacatggcggctcagggagaccacctcgactgtgtccggctcctgttgcaatacgacgcagagatagacgacatcaccctggaccacctgaccccactccacgtggctgcccactgtggacaccacagggtggctaaggtccttctggataaaggggccaaacccaactccagagccctgaatggctttacccccttacacatcgcctgcaaaaagaaccacgtccgtgtcatggagctgctgctgaagacgggagcctcgatcgacgcggtcaccgagtctggcctgacacctctccacgtggcctccttcatggggcaccttcccatcgtgaagaacctcctgcagcggggggcgtcgcccaacgtctccaacgtgaaagtggagaccccgctacacatggcagccagagccgggcacacggaagtggccaaatatttactccagaacaaagccaaagtcaatgccaaggccaaggatgaccagaccccacttcactgtgcagctcgcatcggccacacaaacatggtgaagctcctgctggaaaataacgccaaccccaacctggccaccaccgccgggcacacccccctgcacattgcagcccgtgagggccatgtggaaacagtcctggcccttctggaaaaggaagcatcccaggcctgcatgaccaagaaaggatttacccctctgcacgtggcggccaagtacgggaaggtgcgggtggcagagctgctgctggagcgggacgcacacccgaatgctgccggaaaaaatggcctgacccccctgcacgtggccgtccatcacaacaacctggacatcgtcaagctgctgcttccccggggcggctccccgcacagccctgcctggaatggctacacccctttgcacatcgctgccaagcagaaccaggtggaggtggcccgtagtctgctgcagtatgggggctcagcaaacgccgagtcggtgcaaggtgtgacgccccttcacctggccgcccaggagggccacgcagagatggtggctctgctgctctcgaaacaagccaatggcaacctggggaacaagagcggactcactcccctccatctggtagcacaagaaggccacgttccagtggcagatgtgctgatcaaacacggcgtcatggtggacgccaccacccggatgggctacactcccctccatgtggccagtcactatggaaacatcaagctggtgaagtttctgctgcagcaccaggcagatgtcaatgccaagaccaagctaggatacagccccctgcaccaggcagcccagcagggacacacagacatcgtgactctgcttctgaaaaacggtgcttccccaaacgaggtcagctcggatggaaccacacctctggccatagccaagcgcttgggctacatttctgtcaccgacgtgctcaaggtcgtcacggatgaaaccagtttcgtgttagtcagtgataagcatcgaatgagtttccctgagacagttgatgagatcctggatgtctcggaagatgaaggggaagaactcatcagcttcaaggctgagaggcgggattccagggatgttgatgaagagaaggagctgctggattttgtgccgaagctagaccaagtggtggaatctccagccatccccaggattccctgtgccatgcctgagacagtggtgatcaggtcagaagagcaggagcaggcatctaaagagtatgatgaggactccctcatccccagcagcccggccaccgagacctcagacaacatcagcccggtggccagcccggtgcatacagggtttctggtgagcttcatggttgacgcccggggtggttccatgagaggaagtcgccacaacggcctgcgagtggtgatcccgccacggacgtgcgcagcgcccacccgcatcacctgccgcctggtcaagccccagaagctcagcacgccgcccccactggccgaggaggagggcctggccagcaggatcatagcactggggcccacgggggcacagttcctgagccctgtaatcgtggagatcccgcactttgcctcccatggccgtggagaccgcgagctcgtggttctgaggagcgaaaacggctccgtgtggaaggagcacaggagccgctatggagagagctacctggatcagatcctcaacgggatggacgaagagctggggagcctggaggagctagagaagaagagggtgtgccgaatcatcaccaccgacttcccgctgtacttcgtgatcatgtcacggctctgccaggactacgacaccatcggtcccgaagggggctccctgaagagcaagctggtgcccctggtacaggcaacgttcccggagaatgccgtcaccaagagagtgaagctggctctgcaggcccagcctgtcccggatgagcttgtcactaagctcctgggcaaccaggccacattcagccccattgtcaccgtggagccccggcgccggaagttccaccgccccattgggcttcggatcccactacctccttcctggaccgacaacccgagggacagcggggagggagacaccaccagcctgcgcctgctttgcagcgtcattggaggaacagaccaagcccagtgggaagacataacaggaaccaccaaacttgtatatgccaacgagtgcgccaacttcaccaccaatgtctctgccaggttttggctgtcggactgtcctcggactgctgaggctgtgaactttgccaccctgctgtacaaagagctcactgcagtgccctacatggccaaattcgtcatctttgccaagatgaatgacccccgagaggggcgcctgcgctgctactgcatgacagatgataaagtggacaagaccctggagcagcatgagaacttcgtggaggtggcccggagcagggacatagaggtgttggaaggaatgtccctgtttgcagaactctctgggaacctggtgcctgtgaagaaagctgcccagcagcggagcttccacttccagtcatttcgggagaaccgtctggccatgcctgtaaaggtgagggacagcagtcgagagccgggagggtccctgtcgtttctgcgcaaggcgatgaagtacgaggacacccagcacattctctgccacctgaacatcaccatgcccccctgcgccaagggaagtggagccgaagataggagaaggaccccgacgcccctggccctgcgatacagcattctcagtgagtccacaccaggttctctcagtgggacagagcaggcagagatgaagatggctgttatctcagagcacctcggtctcagctgggcagagttggcccgggagctgcagttcagtgtggaagacatcaacaggatccgagtggaaaatcccaactccctgttggagcagagtgtggccttgctgaacctctgggtcatccgtgaaggccaaaacgcaaacatggagaatctgtacacagccctgcagagcattgaccgtggcgagatcgtgaacatgctggagggttccggccgacagagccgcaacttgaagccagacaggcggcacaccgaccgcgactactcgctgtcaccctcccagatgaatggttactcctcactgcaggacgagctgctgtcccctgcctccctgggctgtgcactttcctctccgctacgtgcagaccagtactggaatgaggtggccgtcctagacgccatccccttggcggccacggagcatgacaccatgctggagatgtctgacatgcaggtgtggtctgcgggcctcacgccttctctggtcactgctgaggactcctctctggagtgtagcaaggctgaggactctgatgccacaggtcacgagtggaagttggagggggcactctcagaggaaccgcggggccccgagttgggctctctggaacttgtggaggacgacacagtggattcagatgccacaaatggccttatcgatttgcttgaacaggaggaaggtcagaggtcagaagagaagctgccaggttctaagaggcaggatgacgcgacaggtgcagggcaggactcagagaatgaagtgtctcttgtttcaggccatcagagggggcaagcccgaatcacacattcccccaccgtgagtcaggtgacggagaggagtcaggacagactgcaggactgggatgcagacggctcgattgtctcatacctgcaagatgctgcacaaggttcctggcaagaggaggtcacgcaaggtccacactcattccagggaacaagtaccatgactgaagggctagagcccggtggatctcaggagtacgagaaggtcctggtgtctgtaagtgagcacacgtggacagaacagcccgaggctgagagctcccaggccgacagggaccggaggcagcaaggccaagaagagcaggtgcaggaggccaagaacaccttcacccaagtggtgcaggggaatgagtttcagaatattccaggggagcaggtgacagaggagcaattcacggatgagcagggcaacattgtcaccaagaagatcattcgcaaggtggttcgacagatagacttgtccagcgccgatgccgcccaggagcacgaggaggtgactgtagaggggcccctggaggatcccagtgagctggaggtcgatattgattactttatgaaacactccaaggatcacacctcgacacccaacccctgaaccccacacactctgccatgcacacaggaggagagctggacctgagggccaccgcagcggtgcacacattcctctgggctgacggcatgacctctgtaagggactcctgctagtcccctcttggcatgaatgactgactgtagacgcatgacctccaggcttcaatcctgcctcttgcaatgacagctgatctgtcggaaccaggacacaaaagcagcaagaagcggggagagagagggatagaaaacaagcgcaggagagcctgcgaacgcaaaagtgaatgagggctttttgtggctggggatgggttttggttttggggttttttttttaaattgttttgacttcgtacagggtactttttcccaacctcatctgtcagaaatccatgtgggcttcctggaaagaaaaaaaaaaaaaagaaaactaggcatgaaatcagtttaacaccttaatcttaagccatgtcctcatctgcccaccctccccaacccacatacctccattccacttgtgacaccccctcgactccctggtgacgctcctcccagatcgctctacatgacattcaggacacacacacacacacacacacaccactcgcctccactgaatctacacacagattttactgtgacttctgaagctgtatagactctgctgtggataaattggaattttttatgttgtctctctctctgccaatttcaatacgaatcatcttccaatggaaaatcattaccttgaagagtgcattcggggttccttgtgttagggacttaagaatctgaggcgaggacccccaggcttacctgtaggactcaaagggagccaggaccccatctgaaagggtctcctctctcagttgggggacaggccggtggctgacccaggattgcaccagcatgtccatagagaagaggttttctatgtcttcaagcactatatcatagtccgtgttcaaagtgtaaactgtacagtaatcagccttgtgtatatgaaaaacaataaatactatgcaaaccaatagaaacatttagcagtacgtacagagcctgacagcgcagctcctgaggacttctgcggctgcaggagaaggagctgtggcctgtctttcagtgaaagaggaaggaaaggagtagggctagtgaatgtatctgccaggtcttagaagtcaggaccacccagggtctcccagagtgaacttggtgctctaagtccaggcagcctgcaggctggggaccctgggtgcaggtgccaggctcgaggctgttccctgtcctgcctcagtgcctcccctctgcccagcccctgtggcctcttggagaggcgagccagggggctccccggaccgcatggccggtgagagtagagtcggaggcggagagcctggacgcccagaggccggggccaggctctgggtcaaggcaggaaggagacagacagctggcagttcctcgcctcggtgccatcagggaggagccttaagttccactagagcctccggcccagggaggccagaatcagcacaatcccggccccgccctcgcggcgggcgcccccagggccaggagagagagacagggctggctcctctcgcccctggagccgcggtgtggacggcccggccccgtccgccccgccgctctgcgggagtgtcctcgggacacacttaaaccttccaagtagcacagaagccccctccacgtcagaggccccctggccgcggggcctgtgagcggagaggggccctgcttcccacacaaatccgccccggtgcacccccggccaggcaggccccggggcggcctaggcgccttgtcggccgggggtggggctgcttttgcttcctttagaggggcgggcagggagaggaagctctagctccgggcctgagtttccccgaggctgcgtcggaggagctgcagggcgagcccggacggctgccgtctccgccagaggccaccccggcccggcctccagggcgcagaggcgcccccctccatcctcccccatcccgggggccacggcaggggggccgcacagcgcggctgggaccgattcggtgacggcccaaggaagctgggctcagggctcgcctctcccgcctcgatcctgcaccttcctctcccaggtcgctgctgcagccaacccagtagcccccttagcgcccccgcggaccccgcagctccagactccgctttggcacctctgctccggctggcatggctgcacgctccggctgctagtaggagccgttaggggaggagtttggggtctccacacgatgcctagagaatgctgcagtctgcacattagacgctttttagaagttttgaaattaccttgatttttttaattgttatgaaaatggatcttttcttgactctcccacatgctctgttatgggagagaatcccctaccctactctgatgtatagaccattctcccttcaccagccgaaccaatgtcaaaattaataaagaaatggactaatggcacaggg

SEQ ID NO: 107304 - DNA, 892 bp, Homo sapiens
  Payload ID: 1065
  Gene Symbol: ANK1
  Gene Name: ankyrin 1, erythrocytic
  ENST ID: ENST00000518061
  CDS Start-End: 1-533
acgaggacacccagcacattctctgccacctgaacatcaccatgcccccctgcgccaagggaagtggagccgaagataggagaaggaccccgacgcccctggccctgcgatacagcattctcagtgagtccacaccaggttctctcagtgggacagagcaggcagagatgaagatggctgttatctcagagcacctcggtctcagctgggcagagttggcccgggagctgcagttcagtgtggaagacatcaacaggatccgagtggaaaatcccaactccctgttggagcagagtgtggccttgctgaacctctgggtcatccgtgaaggccaaaacgcaaacatggagaatctgtacacagccctgcagagcattgaccgtggcgagatcgtgaacatgctggagggttccggccgacagagccgcaacttgaagccagacaggcggcacaccgaccgcgactactcgctgtcaccctcccagatgaatggaggaaggtcagaggtcagaagagaagctgccaggttctaagaggcaggatgacgcgacaggtgcagggcaggactcagagaatgaagtgtctcttgtttcaggccatcagagggggcaagcccgaatcacacattcccccaccgtgagtcaggtgacggagaggagtcaggacagactgcaggactgggatgcagacggctcgattgtctcatacctgcaagatgctgcacaaggttcctggcaagaggaggtcacgcaaggtccacactcattccagggaacaagtaccatgactgaagggctagagcccggtggatctcaggagtacgagaaggtcctggtgtctgtaagtgagcacacgtggacagaacagcccgaggctgagagctcccaggccg

SEQ ID NO: 107305 - DNA, 1060 bp, Homo sapiens
  Payload ID: 1065
  Gene Symbol: ANK1
  Gene Name: ankyrin 1, erythrocytic
  ENST ID: ENST00000522231
  CDS Start-End: 239-634
cctggctgctgggcagaagggcacttgggccgggctgcttcagccgagagggccattcggtgtcctgcccacagagagagaaacagtgagagaccaagagagcaaaccagagagatagggagggggaatgcaaggggtccctgggggactcaggagtcccagtggagaatgagaggcaggccccccgtggtggccggggccctggctgccagaggaccgggctggtgaggaggcgaggatgtggactttcgtcacccagctgttggtcacgctggtgctgctgagcttcttcctggtcagctgtcagaacgtgatgcacattgtcagggggtccctgtgctttgtgctaaagcacatccaccaggagctggacaaggagctgggggagagcgagggcctcagtgacgacgaggagaccatctccaccagggtggtccggcggcgggtcttcctgaaggggaatgagtttcagaatattccaggggagcaggtgacagaggagcaattcacggatgagcagggcaacattgtcaccaagaagatcattcgcaaggtggttcgacagatagacttgtccagcgccgatgccgcccaggagcacgaggaggatcacacctcgacacccaacccctgaaccccacacactctgccatgcacacaggaggagagctggacctgagggccaccgcagcggtgcacacattcctctgggctgacggcatgacctctgtaagggactcctgctagtcccctcttggcatgaatgactgactgtagacgcatgacctccaggcttcaatcctgcctcttgcaatgacagctgatctgtcggaaccaggacacaaaagcagcaagaagcggggagagagagggatagaaaacaagcgcaggagagcctgcgaacgcaaaagtgaatgagggctttttgtggctggggatgggttttggttttggggttttttttttaaattgttttgacttcgtacagggtactttttcccaacctcatctgtcagaaatccatgtgggcttcctggaaagaaaaaaaaaaaaaagaaaa

SEQ ID NO: 107306 - DNA, 3587 bp, Homo sapiens
  Payload ID: 1065
  Gene Symbol: ANK1
  Gene Name: ankyrin 1, erythrocytic
  ENST ID: ENST00000520299
  CDS Start-End: 1-3121
gatcaaacacggcgtcatggtggacgccaccacccggatgggctacactcccctccatgtggccagtcactatggaaacatcaagctggtgaagtttctgctgcagcaccaggcagatgtcaatgccaagaccaagctaggatacagccccctgcaccaggcagcccagcagggacacacagacatcgtgactctgcttctgaaaaacggtgcttccccaaacgaggtcagctcggatggaaccacacctctggccatagccaagcgcttgggctacatttctgtcaccgacgtgctcaaggtcgtcacggatgaaaccagtttcgtgttagtcagtgataagcatcgaatgagtttccctgagacagttgatgagatcctggatgtctcggaagatgaaggaactgctcatataactataatgggggaagaactcatcagcttcaaggctgagaggcgggattccagggatgttgatgaagagaaggagctgctggattttgtgccgaagctagaccaagtggtggaatctccagccatccccaggattccctgtgccatgcctgagacagtggtgatcaggtcagaagagcaggagcaggcatctaaagagtatgatgaggactccctcatccccagcagcccggccaccgagacctcagacaacatcagcccggtggccagcccggtgcatacagggtttctggtgagcttcatggttgacgcccggggtggttccatgagaggaagtcgccacaacggcctgcgagtggtgatcccgccacggacgtgcgcagcgcccacccgcatcacctgccgcctggtcaagccccagaagctcagcacgccgcccccactggccgaggaggagggcctggccagcaggatcatagcactggggcccacgggggcacagttcctgagccctgtaatcgtggagatcccgcactttgcctcccatggccgtggagaccgcgagctcgtggttctgaggagcgaaaacggctccgtgtggaaggagcacaggagccgctatggagagagctacctggatcagatcctcaacgggatggacgaagagctggggagcctggaggagctagagaagaagagggtgtgccgaatcatcaccaccgacttcccgctgtacttcgtgatcatgtcacggctctgccaggactacgacaccatcggtcccgaagggggctccctgaagagcaagctggtgcccctggtacaggcaacgttcccggagaatgccgtcaccaagagagtgaagctggctctgcaggcccagcctgtcccggatgagcttgtcactaagctcctgggcaaccaggccacattcagccccattgtcaccgtggagccccggcgccggaagttccaccgccccattgggcttcggatcccactacctccttcctggaccgacaacccgagggacagcggggagggagacaccaccagcctgcgcctgctttgcagcgtcattggaggaacagaccaagcccagtgggaagacataacaggaaccaccaaacttgtatatgccaacgagtgcgccaacttcaccaccaatgtctctgccaggttttggctgtcggactgtcctcggactgctgaggctgtgaactttgccaccctgctgtacaaagagctcactgcagtgccctacatggccaaattcgtcatctttgccaagatgaatgacccccgagaggggcgcctgcgctgctactgcatgacagatgataaagtggacaagaccctggagcagcatgagaacttcgtggaggtggcccggagcagggacatagaggtgttggaaggaatgtccctgtttgcagaactctctgggaacctggtgcctgtgaagaaagctgcccagcagcggagcttccacttccagtcatttcgggagaaccgtctggccatgcctgtaaaggtgagggacagcagtcgagagccgggagggtccctgtcgtttctgcgcaaggcgatgaagtacgaggacacccagcacattctctgccacctgaacatcaccatgcccccctgcgccaagggaagtggagccgaagataggagaaggaccccgacgcccctggccctgcgatacagcattctcagtgagtccacaccaggttctctcagtgggacagagcaggcagagatgaagatggctgttatctcagagcacctcggtctcagctgggcagagttggcccgggagctgcagttcagtgtggaagacatcaacaggatccgagtggaaaatcccaactccctgttggagcagagtgtggccttgctgaacctctgggtcatccgtgaaggccaaaacgcaaacatggagaatctgtacacagccctgcagagcattgaccgtggcgagatcgtgaacatgctggagggttccggccgacagagccgcaacttgaagccagacaggcggcacaccgaccgcgactactcgctgtcaccctcccagatgaatggccatcagagggggcaagcccgaatcacacattcccccaccgtgagtcaggtgacggagaggagtcaggacagactgcaggactgggatgcagacggctcgattgtctcatacctgcaagatgctgcacaaggttcctggcaagaggaggtcacgcaaggtccacactcattccagggaacaagtaccatgactgaagggctagagcccggtggatctcaggagtacgagaaggtcctggtgtctgtaagtgagcacacgtggacagaacagcccgaggctgagagctcccaggccgacagggaccggaggcagcaaggccaagaagagcaggtgcaggaggccaagaacaccttcacccaagtggtgcaggggaatgagtttcagaatattccaggggagcaggtgacagaggagcaattcacggatgagcagggcaacattgtcaccaagaagatcattcgcaaggtggttcgacagatagacttgtccagcgccgatgccgcccaggagcacgaggaggtggagctgagagggagtggcctacagccggacctgatagagggcaggaagggggcgcagatagtgaagcgggccagcctgaaaagggggaaacagtgaccccgagccgctctccttggagtagcctctcgggaggatcacacctcgacacccaacccctgaaccccacacactctgccatgcacacaggaggagagctggacctgagggccaccgcagcggtgcacacattcctctgggctgacggcatgacctctgtaagggactcctgctagtcccctcttggcatgaatgactgactgtagacgcatgacctccaggcttcaatcctgcctcttgcaatgacagctgatctgtcggaaccaggacacaaaagcagcaagaagcggggagagagagggatagaaaacaagcgcaggagagcctgcgaacgcaaaagtgaatgagggctttttgtggctggggatgggttttggttttggggttttttttttaaattgttttgacttcgtacagggtactttttcccaacctcatctgtcagaaatccatgtgggcttcctgg

SEQ ID NO: 107307 - DNA, 1160 bp, Homo sapiens
  Payload ID: 1065
  Gene Symbol: ANK1
  Gene Name: ankyrin 1, erythrocytic
  Uniprot ID: P16157
  ENST ID: ENST00000522543
  CDS Start-End: 264-734
gtcacccgggccactcagggcagagcctggctgctgggcagaagggcacttgggccgggctgcttcagccgagagggccattcggtgtcctgcccacagagagagaaacagtgagagaccaagagagcaaaccagagagatagggagggggaatgcaaggggtccctgggggactcaggagtcccagtggagaatgagaggcaggccccccgtggtggccggggccctggctgccagaggaccgggctggtgaggaggcgaggatgtggactttcgtcacccagctgttggtcacgctggtgctgctgagcttcttcctggtcagctgtcagaacgtgatgcacattgtcagggggtccctgtgctttgtgctaaagcacatccaccaggagctggacaaggagctgggggagagcgagggcctcagtgacgacgaggagaccatctccaccagggtggtccggcggcgggtcttcctgaaggggaatgagtttcagaatattccaggggagcaggtgacagaggagcaattcacggatgagcagggcaacattgtcaccaagaagatcattcgcaaggtggttcgacagatagacttgtccagcgccgatgccgcccaggagcacgaggaggtgactgtagaggggcccctggaggatcccagtgagctggaggtcgatattgattactttatgaaacactccaaggatcacacctcgacacccaacccctgaaccccacacactctgccatgcacacaggaggagagctggacctgagggccaccgcagcggtgcacacattcctctgggctgacggcatgacctctgtaagggactcctgctagtcccctcttggcatgaatgactgactgtagacgcatgacctccaggcttcaatcctgcctcttgcaatgacagctgatctgtcggaaccaggacacaaaagcagcaagaagcggggagagagagggatagaaaacaagcgcaggagagcctgcgaacgcaaaagtgaatgagggctttttgtggctggggatgggttttggttttggggttttttttttaaattgttttgacttcgtacagggtactttttcccaacctcatctgtcagaaatccatgtgggcttcctggaaagaaaaaaaaaaaaaagaaaa

SEQ ID NO: 107308 - DNA, 11775 bp, Homo sapiens
  Payload ID: 1066
  Gene Symbol: ANK2
  Gene Name: ankyrin 2, neuronal
  ENST ID: ENST00000264366
  CDS Start-End: 1-11775
atgatgaacgaagatgcagctcagaaaagcgacagtggagagaagttcaacggcagtagtcagaggagaaaaagacccaagaagtctgacagcaatgcaagcttcctccgtgctgccagagcaggcaacctggacaaagttgtggaatatctgaaggggggcatagacatcaatacctgcaatcagaatggactcaacgctctccatctggctgccaaggaaggccacgtggggctggtgcaggagctgctgggaagagggtcctctgtggattctgccactaagaagggaaataccgctcttcacattgcatctttggctggacaagcagaagttgtcaaagttcttgttaaggaaggagccaatattaatgcacagtctcagaatggctttactcctttatacatggctgcccaagagaatcacattgatgttgtaaaatatttgctggaaaatggagctaatcagagcactgctacagaggatggctttactcctctagctgtggcactccagcaaggacacaaccaggcggtggccatcctcttggagaatgacaccaaagggaaagtgaggctgccagctctgcatattgccgctaggaaagacgacaccaaatctgccgcacttctgcttcagaatgaccacaatgctgacgtacaatccaagatgatggtgaataggacaactgagagtggttttacccctttgcacatagctgcacattacggaaatgtcaacgtggcaactcttcttctaaaccggggagctgctgtggacttcacagccaggaatggaatcactcctctgcatgtggcttccaaaagaggaaatacaaacatggtgaagctcttactggatcgaggcggtcagatcgatgccaaaactagggatgggttgacaccacttcactgtgctgcacgaagtgggcatgaccaagtggtggaacttctgttggaacggggtgcccccttgctggcaaggactaagaatgggctgtctccactacacatggctgcccagggagaccacgtggaatgtgtgaagcacctgttacagcacaaggcacctgttgatgatgtcaccctagactacctgacagccctccacgttgctgcgcactgtggccactaccgtgtaaccaaactccttttagacaagagagccaatccgaacgccagagccctgaatggttttactccactgcacattgcctgcaagaaaaaccgcatcaaagtcatggaactgctggtgaaatatggggcttcaatccaagctataacagagtctggcctcacaccaatacatgtggctgccttcatgggccacttgaacattgtcctccttctgctgcagaacggagcctctccagatgtcactaacattcgtggtgagacggcactacacatggcagcccgagccgggcaggtggaagtggtccgatgcctcctgagaaatggtgcccttgttgatgccagagccagggaggaacagacacctttacatattgcctcccgcctgggtaagacagaaattgtccagctgcttctacaacatatggctcatccagatgcggccactacaaatgggtacacaccactgcacatctctgcccgggagggccaggtggatgtggcatcagtcctattggaagcaggagcagcccactccttagctaccaagaagggttttactcccctgcatgtagcagccaagtatggaagcctggatgtggcaaaacttctcttgcaacgccgtgctgccgcagattctgcagggaagaacggccttaccccgctccatgttgctgctcattatgacaaccagaaggtggcgctgctgttactggagaagggtgcttcccctcatgccactgccaagaatggctatactccgttacatattgctgccaagaagaatcaaatgcagatagcttccacactcctgaactatggagcagagacaaacattgtgacaaagcaaggagtaactccactccatctggcctcgcaggaggggcacacagatatggttaccttgcttctggataagggagccaatatccacatgtcaactaagagtggactcacatccttacaccttgcagcccaggaagataaagtgaatgttgctgatattctcaccaagcatggagctgatcaggatgctcatacaaagcttggttacacacctttaattgtggcctgtcactatggaaatgtgaaaatggtcaactttcttctgaagcagggagcaaatgttaacgcaaaaaccaagaacggctacacgcctttgcaccaggccgctcagcagggtcacacgcacatcatcaacgtcctgctccagcatggggccaagcccaacgccaccactgcgaatggcaacactgccttggcgattgctaagcgtctgggctacatctccgtggtcgacaccctgaaggttgtgactgaggaggtcaccaccaccaccacaactattacagaaaaacacaaactaaatgtacctgagacgatgactgaggttcttgatgtttctgatgaagagggtgatgacacaatgactggtgatgggggagaataccttaggcctgaggacctaaaagaactgggtgatgactcactacccagcagtcagttcctggatggtatgaattacctgcgatacagcttggagggaggacgatctgacagccttcgatccttcagttccgacaggtctcacactctgagccatgcctcctacctgagggacagtgccgtgatggatgactcagttgtgattcccagtcaccaggtgtcaactctagccaaggaggcagaaaggaattcttatcgcctaagctggggcactgagaacttagacaacgtggctctttcttctagtcctattcattcaggtttcctggttagttttatggtggatgcccgaggtggtgctatgcgaggatgcagacacaatgggctccgaatcattattccacctcggaaatgtactgctccaacgcgagtcacctgccgactggtcaagcgccacagactggcaacaatgcctccaatggtggaaggagaaggcctggccagtcgcctgatcgaagttggaccttctggtgctcagttccttgggcctgtgatcgtggagatccctcactttgcggcccttcgaggaaaggaaagggaactggtggtcctgcgcagtgagaatggggacagctggaaagagcatttctgtgactacactgaagatgaattgaatgaaattcttaacggcatggatgaagtactggatagcccagaagacctagaaaagaaacgaatctgccgcatcatcacccgagacttcccacagtactttgcagtggtgtctcgtatcaaacaggacagcaatctgattggcccagaaggaggtgtactgagcagcacagtggtgccccaggtgcaggccgtcttcccagagggggcactcaccaagcggatccgcgtaggcctgcaggctcaacctatgcacagtgagctggttaagaagatcctaggcaacaaagctaccttcagccctatagtcactttggaacctagaagaagaaaattccacaaaccaattaccatgaccattcctgtccccaaagcttcaagtgatgtcatgttgaatggttttgggggagatgcaccaaccttaagattactatgcagcataacaggtggaaccacccctgcccagtgggaagatattacaggaactacgccattaacatttgtcaatgaatgtgtttcctttacaacaaacgtgtctgccaggttctggctgatagattgtcgacagatccaggaatccgttacttttgcatcacaagtatacagagaaattatctgcgtaccttatatggccaaatttgtagtgtttgccaaatcacatgaccccattgaagccaggttgaggtgtttctgcatgactgatgataaagtggataagacccttgaacaacaagaaaattttgctgaggtggccagaagcagggatgtggaggtgttagaaggaaaacccatctacgttgattgtttcggcaacttggtaccattaactaaaagtggccagcatcatatattcagtttttttgccttcaaagaaaatagacttcctctatttgtcaaggtacgcgatacgactcaggaaccttgcggacgactatcatttatgaaggagccaaaatccacgagaggcctggtgcatcaagctatttgcaacttaaacatcactttgccgatttatacaaaggaatcagagtcagatcaagaacaggaggaagagatcgatatgacatcagaaaaaaatgatgagacagaatctacagaaacatctgtcctgaaaagtcacctggttaatgaagttcctgtcctagcaagtccggacttgctctctgaagtttctgagatgaaacaagatttgatcaaaatgaccgccatcttgaccacagatgtgtctgataaggcaggttctattaaagtgaaggagctggtgaaggctgctgaggaagagccaggagagccttttgaaatcgttgaaagagttaaagaggacttagagaaagtgaatgaaatcctgagaagtggaacctgcacaagagatgaaagcagtgtgcagagctctcggtctgagagaggattagttgaagaggaatgggttattgtcagtgatgaggaaatagaagaggctaggcaaaaagcacctttagaaatcactgaatatccatgtgtagaagttagaatagataaagagatcaaaggaaaagtagagaaagactcaactgggctagtgaactaccttactgatgatctgaatacctgtgtgcctcttcccaaagagcagctgcagacagttcaagataaggcagggaagaaatgtgaggctctggctgttggcaggagctctgaaaaggaagggaaagacatacccccagatgagacacagagtacacagaaacagcacaaaccaagcttgggaataaagaagccagtaagaaggaaattaaaagaaaagcagaaacaaaaagaggaaggtttacaagctagtgcagagaaagctgaacttaaaaaaggtagttcagaagagtcattaggtgaagacccaggtttagcccctgaaccccttcccactgtcaaggccacatctcctttgatagaagaaactcccattggttccataaaggacaaagtaaaggcccttcagaagcgagtggaagatgaacagaaaggtcgaagcaagttgcccatcagagtcaaaggcaaggaggacgtgccaaaaaagaccacccacaggccacatccagctgcgtcaccctctctgaagtcagagagacatgcgccagggtctccctcccctaaaacagaaagacactctactctttcctcttccgcaaaaactgaaaggcaccctccagtatcaccatcaagtaaaactgagaaacactcacctgtgtcaccctctgcaaaaacggaaagacattcacctgcgtcatcatcgagtaaaactgagaaacactcacctgtatcaccctcgacaaaaactgaaaggcactctcctgtgtcatctacaaaaacagaaagacacccacctgtttcgccttcaggcaaaacagacaaacgtccacctgtatcgccctccgggaggacagaaaaacacccgccagtatcgcctgggagaacagaaaaacgcttgcctgtttcaccctccggaagaacggacaagcaccaacctgtatcaacagctgggaaaactgagaagcacctgcctgtgtcaccttctggcaaaacagaaaagcaaccacctgtatcccccacttcaaaaacagagaggattgaggaaaccatgtctgttcgggagctgatgaaggctttccagtcaggtcaggacccttctaaacataaaactggactctttgagcacaaatcagcaaaacaaaagcagccacaagagaaaggtaaagttcgggtagaaaaagaaaaggggccgatactaacccagagagaagctcagaaaacagagaatcagacaatcaaacgaggccagagactcccggtaacgggcacagcagaatccaaaagaggagttcgtgtttcctccataggagttaagaaagaagatgcagctggaggaaaggagaaagttctcagccacaaaatacctgaacctgttcagtcagtgcctgaagaagaaagccacagagagagcgaagtgcccaaagaaaagatggctgatgagcagggagacatggatctacagatcagcccagataggaaaacctccactgacttctctgaggtcattaagcaagagttggaagacaatgacaaataccaacaattccgcctgagtgaggagacagaaaaggcacagcttcacttagaccaagtactcactagtcctttcaacacaacatttccactcgactacatgaaagatgagttccttccagctctgtctttacaaagcggtgctttagatggcagttctgaaagcctaaagaatgagggggtagccggctctccgtgtggcagcctgatggaggggacccctcagattagttcagaagaaagctataagcatgaaggcctagcagagacccctgagacgagcccagaaagcctttctttctcaccaaagaaaagtgaggagcaaactggggaaacaaaggaaagcaccaagacagaaaccaccacagaaattcgttcagaaaaagagcatcccacgaccaaagacattactggtggctctgaagagcgaggtgccacagtcactgaggactcagagacctctactgagagttttcagaaagaggccactctaggctctcccaaagacacaagccctaaaagacaagatgattgcacaggcagctgtagtgtagcattagctaaagagacacctacaggactgactgaggaggcagcctgtgatgaaggtcaacgtacctttggtagttcagcccacaagacacaaactgatagtgaggttcaagaatccacagccacctcagacgagacaaaggccttgccgctgcctgaggcttctgtaaagacagatacaggaactgaatcaaaacctcagggagtcattagaagtccccaagggttagaacttgcactccctagccgagatagcgaagtcctcagcgctgtggctgatgactcattagcagtgagccacaaagactctctggaagccagccctgtgctagaagataactcttcacacaaaacccctgattctctggagccaagtcctctgaaagaatccccttgccgtgactctctggaaagcagccctgttgaaccaaagatgaaggctggaatttttccaagtcactttcctcttcctgcagctgttgccaaaacagaactcttgacggaagtggcctctgtgcggtcccggctactccgagaccctgatggcagtgctgaggatgacagtcttgagcagacatcgctcatggagagctcagggaagagccccctttctcctgacacccccagctctgaagaagtcagctatgaggttacacccaaaaccacagatgtaagtacaccaaaaccagctgtgattcatgaatgtgcagaggaggatgattcagaaaacggggagaaaaagaggttcacacctgaagaggagatgtttaaaatggtaaccaaaatcaaaatgtttgatgaacttgaacaagaagcaaagcagaaaagggactacaaaaaagaacccaaacaagaagaatcttcttcatcttctgacccagatgctgactgttcagtagatgtggatgaaccaaaacatacaggcagtggggaggatgaaagtggtgtccctgtgttagtaacttcggagagcaggaaggtgtcttcctcctcagaaagtgaacctgagttggcacagcttaaaaaaggtgctgactcaggccttttaccagaaccagtgattcgagtacaacctccttctccacttccatcaagcatggactccaattccagtccagaagaagtacaattccagcctgtcgtttccaaacaatatactttcaagatgaatgaagatactcaggaagagccaggcaaatcagaagaagaaaaagattctgaatcccatttagctgaagaccgtcatgctgtttccactgaggctgaagacaggtcttatgataagctaaacagagacactgatcagccaaaaatctgtgatggccatggatgtgaggccatgagtcctagcagctcagctgctcctgtctcttcaggtctacagagtccgactggtgatgatgttgatgaacagccagtcatctataaagaatcattagctctccaaggcactcatgaaaaagacacagagggagaagagcttgatgtttctagagcagaatctccacaagcagattgccccagtgaaagcttttcatcttcatcctctttgcctcattgtttggtatctgaaggaaaagaattagatgaagacatatctgccacatcttctattcaaaaaacagaggtcacaaaaactgatgaaacatttgagaacttaccaaaggactgcccctctcaagactcatccattactactcaaacagatagattttccatggatgttcccgtgtctgacctagctgagaatgatgaaatctatgatccacaaatcactagcccttatgaaaatgtcccttcccaatcttttttctctagtgaagaaagcaaaacccaaacagatgcaaatcacaccacaagttttcactcttctgaagtgtattctgttaccatcacatcccctgttgaagacgttgtagtggcaagctcctctagtggaactgttttaagcaaagaatctaattttgagggccaggacataaaaatggaatcccaacaggaaagtaccttgtgggaaatgcaatcagacagtgtctcttcatctttcgagcctactatgtccgctacaacaacagttgttggtgaacaaataagcaaagtcatcatcacaaaaactgatgtggattctgattcttggagtgaaattcgggaagacgatgaagcctttgaggctcgtgtgaaagaggaagaacaaaagatatttggtttgatggtagacagacaatcacagggtaccacccctgacaccactcctgctaggaccccaactgaagaggggaccccaacaagtgagcaaaacccatttctgtttcaggaaggaaaattgtttgaaatgacccgaagtggtgccattgatatgaccaaaaggtcctatgcagatgaaagttttcactttttccaaattggtcaagaatccagggaagagactctctctgaagatgtgaaagaaggggctactggggctgatcccctaccgctggagacatcagctgaatcactagcactttcagaatcaaaagaaacagtggatgatgaggcagacttacttccagatgacgtgagtgaggaagtagaggaaatacctgcttcggatgctcaacttaactcccaaatggggatttcagcctccactgaaacacctacaaaagaagctgttagtgtagggaccaaggacctccccaccgtgcaaacgggtgatatacctcctctctctggtgtaaagcagatatcctgccccgactcttctgaaccagctgtacaagtccagttagatttttccacactcaccaggtctgtttattcagataggggtgatgattctcccgattcttccccagaagaacagaaatcagtaatcgagattcctactgcacccatggagaatgtgccttttactgaaagcaaatccaaaattcctgtaaggactatgcccacttccaccccagcacctccatctgcagagtatgagagttcagtttctgaagattttctatccagtgtagatgaggaaaataaggcggatgaagcaaaaccaaagtccaaactccctgtcaaagtacccctccaaagagttgaacagcagctctcagatctagacacctctgtccagaagacagtggctcctcagggacaggacatggcaagcatcgcaccagataatagaagcaaatctgaatctgatgctagttctttggattcaaagaccaaatgcccagtaaaaacccgaagttacactgagacagaaacagagagcagagagagggccgaggaacttgagttagaatcagaagaaggggccacaagaccaaagatacttacatcccgattgccagttaagagcagaagcactacatcttcctgcagggggggcacgagccccacaaaagaaagtaaggagcatttctttgacctttacagaaattccatagaattctttgaggagattagtgatgaggcttccaaattagtggataggctgacacagtcagagagggagcaggaaatagtttcagacgatgaaagtagtagtgccctggaagtatcagtaattgaaaatctgccacctgttgagaccgagcactcagttcctgaggacatctttgacacaaggcccatttgggatgagtctattgagactctgattgaacgcatccctgatgaaaatggccatgaccatgctgaagatccacaggatgagcaggaacggatcgaggaaaggctggcttatattgctgatcaccttggcttcagctggacagaattagcaagagaactggatttcactgaggagcaaattcatcaaattcgaattgaaaatcccaactctcttcaagaccagagtcatgcactgttgaagtactggctagagagggatgggaaacatgctacagataccaacctcgttgaatgtctcaccaagatcaaccgaatggatattgttcatctcatggagaccaacacagaacctctccaggagcgcatcagtcatagttatgcagaaattgaacagaccattacactggatcatagtgaagggttctcggtacttcaagaggagttatgcactgcacagcacaagcagaaagaggagcaagctgtttctaaagaaagtgagacctgcgatcaccctcctatcgtctcagaggaagacatttctgttggttattccacttttcaggatggcgtccccaaaactgagggggacagctcagcaacagcactctttccccaaactcacaaggagcaagttcaacaggatttctcagggaaaatgcaagacctgcctgaagagtcatctctggaatatcagcaggaatattttgtgacaactccaggaacagaaacatcagagactcagaaggctatgatagtacccagctctcccagcaagacacctgaggaagttagcacccctgcagaggaggagaagctgtacctccagaccccaacatccagcgagcggggaggctctcccatcatacaagaacccgaagagccctcagagcacagagaggagagctctccgcggaaaaccagcctcgtaatagtggagtctgccgataaccagcctgagacctgtgaaagactcgatgaagatgcagcttttgaaaagggagacgatatgcctgaaatacccccagaaacagtcacagaagaagaatacattgatgagcatggacacaccgtggtaaagaaggttactaggaaaatcattaggcggtatgtatcctctgaaggcacagagaaagaagagattatggtgcagggaatgccacaggaacctgtcaacatcgaggaaggggatggctattccaaagttataaagcgtgttgtattgaagagtgacaccgagcagtcagaggacaacaatgagtaa

SEQ ID NO: 107309 - DNA, 14196 bp, Homo sapiens
  Payload ID: 1066
  Gene Symbol: ANK2
  Gene Name: ankyrin 2, neuronal
  Uniprot ID: Q01484
  ENST ID: ENST00000357077
  CDS Start-End: 54-11927
gtacaggcggcacggtttgatggcagagatattttctttccaaactgttcaaaatgatgaacgaagatgcagctcagaaaagcgacagtggagagaagttcaacggcagtagtcagaggagaaaaagacccaagaagtctgacagcaatgcaagcttcctccgtgctgccagagcaggcaacctggacaaagttgtggaatatctgaaggggggcatagacatcaatacctgcaatcagaatggactcaacgctctccatctggctgccaaggaaggccacgtggggctggtgcaggagctgctgggaagagggtcctctgtggattctgccactaagaagggaaataccgctcttcacattgcatctttggctggacaagcagaagttgtcaaagttcttgttaaggaaggagccaatattaatgcacagtctcagaatggctttactcctttatacatggctgcccaagagaatcacattgatgttgtaaaatatttgctggaaaatggagctaatcagagcactgctacagaggatggctttactcctctagctgtggcactccagcaaggacacaaccaggcggtggccatcctcttggagaatgacaccaaagggaaagtgaggctgccagctctgcatattgccgctaggaaagacgacaccaaatctgccgcacttctgcttcagaatgaccacaatgctgacgtacaatccaagatgatggtgaataggacaactgagagtggttttacccctttgcacatagctgcacattacggaaatgtcaacgtggcaactcttcttctaaaccggggagctgctgtggacttcacagccaggaatggaatcactcctctgcatgtggcttccaaaagaggaaatacaaacatggtgaagctcttactggatcgaggcggtcagatcgatgccaaaactagggatgggttgacaccacttcactgtgctgcacgaagtgggcatgaccaagtggtggaacttctgttggaacggggtgcccccttgctggcaaggactaagaatgggctgtctccactacacatggctgcccagggagaccacgtggaatgtgtgaagcacctgttacagcacaaggcacctgttgatgatgtcaccctagactacctgacagccctccacgttgctgcgcactgtggccactaccgtgtaaccaaactccttttagacaagagagccaatccgaacgccagagccctgaatggttttactccactgcacattgcctgcaagaaaaaccgcatcaaagtcatggaactgctggtgaaatatggggcttcaatccaagctataacagagtctggcctcacaccaatacatgtggctgccttcatgggccacttgaacattgtcctccttctgctgcagaacggagcctctccagatgtcactaacattcgtggtgagacggcactacacatggcagcccgagccgggcaggtggaagtggtccgatgcctcctgagaaatggtgcccttgttgatgccagagccagggaggaacagacacctttacatattgcctcccgcctgggtaagacagaaattgtccagctgcttctacaacatatggctcatccagatgcggccactacaaatgggtacacaccactgcacatctctgcccgggagggccaggtggatgtggcatcagtcctattggaagcaggagcagcccactccttagctaccaagaagggttttactcccctgcatgtagcagccaagtatggaagcctggatgtggcaaaacttctcttgcaacgccgtgctgccgcagattctgcagggaagaacggccttaccccgctccatgttgctgctcattatgacaaccagaaggtggcgctgctgttactggagaagggtgcttcccctcatgccactgccaagaatggctatactccgttacatattgctgccaagaagaatcaaatgcagatagcttccacactcctgaactatggagcagagacaaacattgtgacaaagcaaggagtaactccactccatctggcctcgcaggaggggcacacagatatggttaccttgcttctggataagggagccaatatccacatgtcaactaagagtggactcacatccttacaccttgcagcccaggaagataaagtgaatgttgctgatattctcaccaagcatggagctgatcaggatgctcatacaaagcttggttacacacctttaattgtggcctgtcactatggaaatgtgaaaatggtcaactttcttctgaagcagggagcaaatgttaacgcaaaaaccaagaacggctacacgcctttgcaccaggccgctcagcagggtcacacgcacatcatcaacgtcctgctccagcatggggccaagcccaacgccaccactgcgaatggcaacactgccttggcgattgctaagcgtctgggctacatctccgtggtcgacaccctgaaggttgtgactgaggaggtcaccaccaccaccacaactattacagaaaaacacaaactaaatgtacctgagacgatgactgaggttcttgatgtttctgatgaagagggtgatgacacaatgactggtgatgggggagaataccttaggcctgaggacctaaaagaactgggtgatgactcactacccagcagtcagttcctggatggtatgaattacctgcgatacagcttggagggaggacgatctgacagccttcgatccttcagttccgacaggtctcacactctgagccatgcctcctacctgagggacagtgccgtgatggatgactcagttgtgattcccagtcaccaggtgtcaactctagccaaggaggcagaaaggaattcttatcgcctaagctggggcactgagaacttagacaacgtggctctttcttctagtcctattcattcaggtttcctggttagttttatggtggatgcccgaggtggtgctatgcgaggatgcagacacaatgggctccgaatcattattccacctcggaaatgtactgctccaacgcgagtcacctgccgactggtcaagcgccacagactggcaacaatgcctccaatggtggaaggagaaggcctggccagtcgcctgatcgaagttggaccttctggtgctcagttccttggtaaacttcacctgccaacggctcctcccccacttaatgagggagaaagtttggtcagccgcattcttcagctggggcctcctggaaccaaattccttgggcctgtgatcgtggagatccctcactttgcggcccttcgaggaaaggaaagggaactggtggtcctgcgcagtgagaatggggacagctggaaagagcatttctgtgactacactgaagatgaattgaatgaaattcttaacggcatggatgaagtactggatagcccagaagacctagaaaagaaacgaatctgccgcatcatcacccgagacttcccacagtactttgcagtggtgtctcgtatcaaacaggacagcaatctgattggcccagaaggaggtgtactgagcagcacagtggtgccccaggtgcaggccgtcttcccagagggggcactcaccaagcggatccgcgtaggcctgcaggctcaacctatgcacagtgagctggttaagaagatcctaggcaacaaagctaccttcagccctatagtcactttggaacctagaagaagaaaattccacaaaccaattaccatgaccattcctgtccccaaagcttcaagtgatgtcatgttgaatggttttgggggagatgcaccaaccttaagattactatgcagcataacaggtggaaccacccctgcccagtgggaagatattacaggaactacgccattaacatttgtcaatgaatgtgtttcctttacaacaaacgtgtctgccaggttctggctgatagattgtcgacagatccaggaatccgttacttttgcatcacaagtatacagagaaattatctgcgtaccttatatggccaaatttgtagtgtttgccaaatcacatgaccccattgaagccaggttgaggtgtttctgcatgactgatgataaagtggataagacccttgaacaacaagaaaattttgctgaggtggccagaagcagggatgtggaggtgttagaaggaaaacccatctacgttgattgtttcggcaacttggtaccattaactaaaagtggccagcatcatatattcagtttttttgccttcaaagaaaatagacttcctctatttgtcaaggtacgcgatacgactcaggaaccttgcggacgactatcatttatgaaggagccaaaatccacgagaggcctggtgcatcaagctatttgcaacttaaacatcactttgccgatttatacaaaggaatcagagtcagatcaagaacaggaggaagagatcgatatgacatcagaaaaaaatgatgagacagaatctacagaaacatctgtcctgaaaagtcacctggttaatgaagttcctgtcctagcaagtccggacttgctctctgaagtttctgagatgaaacaagatttgatcaaaatgaccgccatcttgaccacagatgtgtctgataaggcaggttctattaaagtgaaggagctggtgaaggctgctgaggaagagccaggagagccttttgaaatcgttgaaagagttaaagaggacttagagaaagtgaatgaaatcctgagaagtggaacctgcacaagagatgaaagcagtgtgcagagctctcggtctgagagaggattagttgaagaggaatgggttattgtcagtgatgaggaaatagaagaggctaggcaaaaagcacctttagaaatcactgaatatccatgtgtagaagttagaatagataaagagatcaaaggaaaagtagagaaagactcaactgggctagtgaactaccttactgatgatctgaatacctgtgtgcctcttcccaaagagcagctgcagacagttcaagataaggcagggaagaaatgtgaggctctggctgttggcaggagctctgaaaaggaagggaaagacatacccccagatgagacacagagtacacagaaacagcacaaaccaagcttgggaataaagaagccagtaagaaggaaattaaaagaaaagcagaaacaaaaagaggaaggtttacaagctagtgcagagaaagctgaacttaaaaaaggtagttcagaagagtcattaggtgaagacccaggtttagcccctgaaccccttcccactgtcaaggccacatctcctttgatagaagaaactcccattggttccataaaggacaaagtaaaggcccttcagaagcgagtggaagatgaacagaaaggtcgaagcaagttgcccatcagagtcaaaggcaaggaggacgtgccaaaaaagaccacccacaggccacatccagctgcgtcaccctctctgaagtcagagagacatgcgccagggtctccctcccctaaaacagaaagacactctactctttcctcttccgcaaaaactgaaaggcaccctccagtatcaccatcaagtaaaactgagaaacactcacctgtgtcaccctctgcaaaaacggaaagacattcacctgcgtcatcatcgagtaaaactgagaaacactcacctgtatcaccctcgacaaaaactgaaaggcactctcctgtgtcatctacaaaaacagaaagacacccacctgtttcgccttcaggcaaaacagacaaacgtccacctgtatcgccctccgggaggacagaaaaacacccgccagtatcgcctgggagaacagaaaaacgcttgcctgtttcaccctccggaagaacggacaagcaccaacctgtatcaacagctgggaaaactgagaagcacctgcctgtgtcaccttctggcaaaacagaaaagcaaccacctgtatcccccacttcaaaaacagagaggattgaggaaaccatgtctgttcgggagctgatgaaggctttccagtcaggtcaggacccttctaaacataaaactggactctttgagcacaaatcagcaaaacaaaagcagccacaagagaaaggtaaagttcgggtagaaaaagaaaaggggccgatactaacccagagagaagctcagaaaacagagaatcagacaatcaaacgaggccagagactcccggtaacgggcacagcagaatccaaaagaggagttcgtgtttcctccataggagttaagaaagaagatgcagctggaggaaaggagaaagttctcagccacaaaatacctgaacctgttcagtcagtgcctgaagaagaaagccacagagagagcgaagtgcccaaagaaaagatggctgatgagcagggagacatggatctacagatcagcccagataggaaaacctccactgacttctctgaggtcattaagcaagagttggaagacaatgacaaataccaacaattccgcctgagtgaggagacagaaaaggcacagcttcacttagaccaagtactcactagtcctttcaacacaacatttccactcgactacatgaaagatgagttccttccagctctgtctttacaaagcggtgctttagatggcagttctgaaagcctaaagaatgagggggtagccggctctccgtgtggcagcctgatggaggggacccctcagattagttcagaagaaagctataagcatgaaggcctagcagagacccctgagacgagcccagaaagcctttctttctcaccaaagaaaagtgaggagcaaactggggaaacaaaggaaagcaccaagacagaaaccaccacagaaattcgttcagaaaaagagcatcccacgaccaaagacattactggtggctctgaagagcgaggtgccacagtcactgaggactcagagacctctactgagagttttcagaaagaggccactctaggctctcccaaagacacaagccctaaaagacaagatgattgcacaggcagctgtagtgtagcattagctaaagagacacctacaggactgactgaggaggcagcctgtgatgaaggtcaacgtacctttggtagttcagcccacaagacacaaactgatagtgaggttcaagaatccacagccacctcagacgagacaaaggccttgccgctgcctgaggcttctgtaaagacagatacaggaactgaatcaaaacctcagggagtcattagaagtccccaagggttagaacttgcactccctagccgagatagcgaagtcctcagcgctgtggctgatgactcattagcagtgagccacaaagactctctggaagccagccctgtgctagaagataactcttcacacaaaacccctgattctctggagccaagtcctctgaaagaatccccttgccgtgactctctggaaagcagccctgttgaaccaaagatgaaggctggaatttttccaagtcactttcctcttcctgcagctgttgccaaaacagaactcttgacggaagtggcctctgtgcggtcccggctactccgagaccctgatggcagtgctgaggatgacagtcttgagcagacatcgctcatggagagctcagggaagagccccctttctcctgacacccccagctctgaagaagtcagctatgaggttacacccaaaaccacagatgtaagtacaccaaaaccagctgtgattcatgaatgtgcagaggaggatgattcagaaaacggggagaaaaagaggttcacacctgaagaggagatgtttaaaatggtaaccaaaatcaaaatgtttgatgaacttgaacaagaagcaaagcagaaaagggactacaaaaaagaacccaaacaagaagaatcttcttcatcttctgacccagatgctgactgttcagtagatgtggatgaaccaaaacatacaggcagtggggaggatgaaagtggtgtccctgtgttagtaacttcggagagcaggaaggtgtcttcctcctcagaaagtgaacctgagttggcacagcttaaaaaaggtgctgactcaggccttttaccagaaccagtgattcgagtacaacctccttctccacttccatcaagcatggactccaattccagtccagaagaagtacaattccagcctgtcgtttccaaacaatatactttcaagatgaatgaagatactcaggaagagccaggcaaatcagaagaagaaaaagattctgaatcccatttagctgaagaccgtcatgctgtttccactgaggctgaagacaggtcttatgataagctaaacagagacactgatcagccaaaaatctgtgatggccatggatgtgaggccatgagtcctagcagctcagctgctcctgtctcttcaggtctacagagtccgactggtgatgatgttgatgaacagccagtcatctataaagaatcattagctctccaaggcactcatgaaaaagacacagagggagaagagcttgatgtttctagagcagaatctccacaagcagattgccccagtgaaagcttttcatcttcatcctctttgcctcattgtttggtatctgaaggaaaagaattagatgaagacatatctgccacatcttctattcaaaaaacagaggtcacaaaaactgatgaaacatttgagaacttaccaaaggactgcccctctcaagactcatccattactactcaaacagatagattttccatggatgttcccgtgtctgacctagctgagaatgatgaaatctatgatccacaaatcactagcccttatgaaaatgtcccttcccaatcttttttctctagtgaagaaagcaaaacccaaacagatgcaaatcacaccacaagttttcactcttctgaagtgtattctgttaccatcacatcccctgttgaagacgttgtagtggcaagctcctctagtggaactgttttaagcaaagaatctaattttgagggccaggacataaaaatggaatcccaacaggaaagtaccttgtgggaaatgcaatcagacagtgtctcttcatctttcgagcctactatgtccgctacaacaacagttgttggtgaacaaataagcaaagtcatcatcacaaaaactgatgtggattctgattcttggagtgaaattcgggaagacgatgaagcctttgaggctcgtgtgaaagaggaagaacaaaagatatttggtttgatggtagacagacaatcacagggtaccacccctgacaccactcctgctaggaccccaactgaagaggggaccccaacaagtgagcaaaacccatttctgtttcaggaaggaaaattgtttgaaatgacccgaagtggtgccattgatatgaccaaaaggtcctatgcagatgaaagttttcactttttccaaattggtcaagaatccagggaagagactctctctgaagatgtgaaagaaggggctactggggctgatcccctaccgctggagacatcagctgaatcactagcactttcagaatcaaaagaaacagtggatgatgaggcagacttacttccagatgacgtgagtgaggaagtagaggaaatacctgcttcggatgctcaacttaactcccaaatggggatttcagcctccactgaaacacctacaaaagaagctgttagtgtagggaccaaggacctccccaccgtgcaaacgggtgatatacctcctctctctggtgtaaagcagatatcctgccccgactcttctgaaccagctgtacaagtccagttagatttttccacactcaccaggtctgtttattcagataggggtgatgattctcccgattcttccccagaagaacagaaatcagtaatcgagattcctactgcacccatggagaatgtgccttttactgaaagcaaatccaaaattcctgtaaggactatgcccacttccaccccagcacctccatctgcagagtatgagagttcagtttctgaagattttctatccagtgtagatgaggaaaataaggcggatgaagcaaaaccaaagtccaaactccctgtcaaagtacccctccaaagagttgaacagcagctctcagatctagacacctctgtccagaagacagtggctcctcagggacaggacatggcaagcatcgcaccagataatagaagcaaatctgaatctgatgctagttctttggattcaaagaccaaatgcccagtaaaaacccgaagttacactgagacagaaacagagagcagagagagggccgaggaacttgagttagaatcagaagaaggggccacaagaccaaagatacttacatcccgattgccagttaagagcagaagcactacatcttcctgcagggggggcacgagccccacaaaagaaagtaaggagcatttctttgacctttacagaaattccatagaattctttgaggagattagtgatgaggcttccaaattagtggataggctgacacagtcagagagggagcaggaaatagtttcagacgatgaaagtagtagtgccctggaagtatcagtaattgaaaatctgccacctgttgagaccgagcactcagttcctgaggacatctttgacacaaggcccatttgggatgagtctattgagactctgattgaacgcatccctgatgaaaatggccatgaccatgctgaagatccacaggatgagcaggaacggatcgaggaaaggctggcttatattgctgatcaccttggcttcagctggacagaattagcaagagaactggatttcactgaggagcaaattcatcaaattcgaattgaaaatcccaactctcttcaagaccagagtcatgcactgttgaagtactggctagagagggatgggaaacatgctacagataccaacctcgttgaatgtctcaccaagatcaaccgaatggatattgttcatctcatggagaccaacacagaacctctccaggagcgcatcagtcatagttatgcagaaattgaacagaccattacactggatcatagtgaagggttctcggtacttcaagaggagttatgcactgcacagcacaagcagaaagaggagcaagctgtttctaaagaaagtgagacctgcgatcaccctcctatcgtctcagaggaagacatttctgttggttattccacttttcaggatggcgtccccaaaactgagggggacagctcagcaacagcactctttccccaaactcacaaggagcaagttcaacaggatttctcagggaaaatgcaagacctgcctgaagagtcatctctggaatatcagcaggaatattttgtgacaactccaggaacagaaacatcagagactcagaaggctatgatagtacccagctctcccagcaagacacctgaggaagttagcacccctgcagaggaggagaagctgtacctccagaccccaacatccagcgagcggggaggctctcccatcatacaagaacccgaagagccctcagagcacagagaggagagctctccgcggaaaaccagcctcgtaatagtggagtctgccgataaccagcctgagacctgtgaaagactcgatgaagatgcagcttttgaaaagggagacgatatgcctgaaatacccccagaaacagtcacagaagaagaatacattgatgagcatggacacaccgtggtaaagaaggttactaggaaaatcattaggcggtatgtatcctctgaaggcacagagaaagaagagattatggtgcagggaatgccacaggaacctgtcaacatcgaggaaggggatggctattccaaagttataaagcgtgttgtattgaagagtgacaccgagcagtcagaggacaacaatgagtaaagccatcacacagaagagggctgtggtgaaggaccagcatggaaaacgcattgacttggagcacctggaggatgtaccagaagcactagaccaggacgacctccagcgcgatctccagcagctccttcggcatttctgcaaggaggacttgaagcaagaggccaagtgaggggctgcccagttctcacaccagaaaccacacattcactcaatatgcagcttcctgtttcagtaggggagtgacctaactggcctaattaatgggataccccgacatttccactgttagcaaatatacggcattttgctttagttttcccccatcctctttaactataaagctaatttgtgaccaaagatggcatccttcatactggatgctgtatccaatactttgttgtgtctgtgctaacctgggaactggccacctccattgttctttgcttctgcacaagatccatgaaaatccattgatcagaagaacttcacctgcagacctcttcaagtgacactatgtaggaatccttccaaggaatatctatgtacaatgtatatagctgaaatgctcagatgaacaacatattaaaattaaaaccactgcctattgtaactacactgggcatcagaataaaaggcctctagaaattgctgaacaatggttaattaagatattgctaacacaatcgagtgataatacagttttactgcaaaagaagcacttcaaacctattatgtccttagaacttccagagtagccactgctcccagttaaaggtgggtcagtagccttgcagaactgtcctgagaagttattgctggtgctggccagccatggcttaggactccaacagccactctgagggaggggagaagggagcagaggccacgcagaatgaaccgatggggtattcagttgctggcagctacattgtgtggcattctagcatcttcaggtctttagatcttggacaagttggcagggtattttaaaagctataactactgtagttttccagttttcattgctgctttagcaaaccacgctgtcttacagtggtactttcttctggccactgcactgtagataattcattggaaacaagatttacccactacataaaaggttaaactccttcagtatgttggagtggtttctttttttttttctttctttcttttttttcttcaggtttatatcttctctaatacctgcatgtggcgtttaaaaatcaagaccacggtcaaacccctcttctaatcacattaattgtttccattctttttaccctgagtgagcacttttcactttccagctaggtctgtttttcagcttgcagacaagattgagaaatccttgaaaatttggttttggttaaaatttttggtttatttatttgaaatccacactcccttggaaactcttaagtgcatttgtgcacttctgtttgtttgtctcaaagaagggactgtaacaatctgagtaatttccatgtcctcttccttattcctctagtggttgaagctgtgtagcattttaacatatatatattcacaaatatattcatataaacagtatacattttgaatcagtcatttgttaaagaaaagtatattcaatgaagatgaaatttaaataaaaaaggacagagtctatcctccagggattgaacattttccaattatctggtcttttcctgttgtgcaaaaatgactcattgctccgaatgtcaaaaacaaatgcgacaaacaatggcacttcatcatttaaagtaatgttgccaagagaaaaaatttcctgggagggaggtttcccacaagccaaatctcctaagcctcaaatgctagcactttttggcagttggataggaaatgagacattctttggcagccaaaataagagaggccgatggtgaaactttttgagacaccctatggccttcttgtcaaaaccttcactggagctcaagaaaagcatttctgttgtgttatttgcagtgcagatgatgtctgtgtaacaacataatggttattcacctttttttgattttgatttttgctgtgttatcaaaaacttgaatactgtgagaagaagtgaattttcagttgacgaatcagcatcttgttcccatggtgataacactaattgaatatatctatgagggcatgtattagttaatggaaaaaaaaatacaacactaacaatacatagctgcaatgtgtacaatggctgatttaattaaataaaatgtacaagtgttaaatgtggcaa

SEQ ID NO: 107310 - DNA, 6313 bp, Homo sapiens
  Payload ID: 1066
  Gene Symbol: ANK2
  Gene Name: ankyrin 2, neuronal
  Uniprot ID: Q01484
  ENST ID: ENST00000394537
  CDS Start-End: 54-5672
gtacaggcggcacggtttgatggcagagatattttctttccaaactgttcaaaatgatgaacgaagatgcagctcagaaaagcgacagtggagagaagttcaacggcagtagtcagaggagaaaaagacccaagaagtctgacagcaatgcaagcttcctccgtgctgccagagcaggcaacctggacaaagttgtggaatatctgaaggggggcatagacatcaatacctgcaatcagaatggactcaacgctctccatctggctgccaaggaaggccacgtggggctggtgcaggagctgctgggaagagggtcctctgtggattctgccactaagaagggaaataccgctcttcacattgcatctttggctggacaagcagaagttgtcaaagttcttgttaaggaaggagccaatattaatgcacagtctcagaatggctttactcctttatacatggctgcccaagagaatcacattgatgttgtaaaatatttgctggaaaatggagctaatcagagcactgctacagaggatggctttactcctctagctgtggcactccagcaaggacacaaccaggcggtggccatcctcttggagaatgacaccaaagggaaagtgaggctgccagctctgcatattgccgctaggaaagacgacaccaaatctgccgcacttctgcttcagaatgaccacaatgctgacgtacaatccaagatgatggtgaataggacaactgagagtggttttacccctttgcacatagctgcacattacggaaatgtcaacgtggcaactcttcttctaaaccggggagctgctgtggacttcacagccaggaatggaatcactcctctgcatgtggcttccaaaagaggaaatacaaacatggtgaagctcttactggatcgaggcggtcagatcgatgccaaaactagggatgggttgacaccacttcactgtgctgcacgaagtgggcatgaccaagtggtggaacttctgttggaacggggtgcccccttgctggcaaggactaagaatgggctgtctccactacacatggctgcccagggagaccacgtggaatgtgtgaagcacctgttacagcacaaggcacctgttgatgatgtcaccctagactacctgacagccctccacgttgctgcgcactgtggccactaccgtgtaaccaaactccttttagacaagagagccaatccgaacgccagagccctgaatggttttactccactgcacattgcctgcaagaaaaaccgcatcaaagtcatggaactgctggtgaaatatggggcttcaatccaagctataacagagtctggcctcacaccaatacatgtggctgccttcatgggccacttgaacattgtcctccttctgctgcagaacggagcctctccagatgtcactaacattcgtggtgagacggcactacacatggcagcccgagccgggcaggtggaagtggtccgatgcctcctgagaaatggtgcccttgttgatgccagagccagggaggaacagacacctttacatattgcctcccgcctgggtaagacagaaattgtccagctgcttctacaacatatggctcatccagatgcggccactacaaatgggtacacaccactgcacatctctgcccgggagggccaggtggatgtggcatcagtcctattggaagcaggagcagcccactccttagctaccaagaagggttttactcccctgcatgtagcagccaagtatggaagcctggatgtggcaaaacttctcttgcaacgccgtgctgccgcagattctgcagggaagaacggccttaccccgctccatgttgctgctcattatgacaaccagaaggtggcgctgctgttactggagaagggtgcttcccctcatgccactgccaagaatggctatactccgttacatattgctgccaagaagaatcaaatgcagatagcttccacactcctgaactatggagcagagacaaacattgtgacaaagcaaggagtaactccactccatctggcctcgcaggaggggcacacagatatggttaccttgcttctggataagggagccaatatccacatgtcaactaagagtggactcacatccttacaccttgcagcccaggaagataaagtgaatgttgctgatattctcaccaagcatggagctgatcaggatgctcatacaaagcttggttacacacctttaattgtggcctgtcactatggaaatgtgaaaatggtcaactttcttctgaagcagggagcaaatgttaacgcaaaaaccaagaacggctacacgcctttgcaccaggccgctcagcagggtcacacgcacatcatcaacgtcctgctccagcatggggccaagcccaacgccaccactgcgaatggcaacactgccttggcgattgctaagcgtctgggctacatctccgtggtcgacaccctgaaggttgtgactgaggaggtcaccaccaccaccacaactattacagaaaaacacaaactaaatgtacctgagacgatgactgaggttcttgatgtttctgatgaagagggtgatgacacaatgactggtgatgggggagaataccttaggcctgaggacctaaaagaactgggtgatgactcactacccagcagtcagttcctggatggtatgaattacctgcgatacagcttggagggaggacgatctgacagccttcgatccttcagttccgacaggtctcacactctgagccatgcctcctacctgagggacagtgccgtgatggatgactcagttgtgattcccagtcaccaggtgtcaactctagccaaggaggcagaaaggaattcttatcgcctaagctggggcactgagaacttagacaacgtggctctttcttctagtcctattcattcaggtttcctggttagttttatggtggatgcccgaggtggtgctatgcgaggatgcagacacaatgggctccgaatcattattccacctcggaaatgtactgctccaacgcgagtcacctgccgactggtcaagcgccacagactggcaacaatgcctccaatggtggaaggagaaggcctggccagtcgcctgatcgaagttggaccttctggtgctcagttccttggtaaacttcacctgccaacggctcctcccccacttaatgagggagaaagtttggtcagccgcattcttcagctggggcctcctggaaccaaattccttgggcctgtgatcgtggagatccctcactttgcggcccttcgaggaaaggaaagggaactggtggtcctgcgcagtgagaatggggacagctggaaagagcatttctgtgactacactgaagatgaattgaatgaaattcttaacggcatggatgaagtactggatagcccagaagacctagaaaagaaacgaatctgccgcatcatcacccgagacttcccacagtactttgcagtggtgtctcgtatcaaacaggacagcaatctgattggcccagaaggaggtgtactgagcagcacagtggtgccccaggtgcaggccgtcttcccagagggggcactcaccaagcggatccgcgtaggcctgcaggctcaacctatgcacagtgagctggttaagaagatcctaggcaacaaagctaccttcagccctatagtcactttggaacctagaagaagaaaattccacaaaccaattaccatgaccattcctgtccccaaagcttcaagtgatgtcatgttgaatggttttgggggagatgcaccaaccttaagattactatgcagcataacaggtggaaccacccctgcccagtgggaagatattacaggaactacgccattaacatttgtcaatgaatgtgtttcctttacaacaaacgtgtctgccaggttctggctgatagattgtcgacagatccaggaatccgttacttttgcatcacaagtatacagagaaattatctgcgtaccttatatggccaaatttgtagtgtttgccaaatcacatgaccccattgaagccaggttgaggtgtttctgcatgactgatgataaagtggataagacccttgaacaacaagaaaattttgctgaggtggccagaagcagggatgtggaggtgttagaaggaaaacccatctacgttgattgtttcggcaacttggtaccattaactaaaagtggccagcatcatatattcagtttttttgccttcaaagaaaatagacttcctctatttgtcaaggtacgcgatacgactcaggaaccttgcggacgactatcatttatgaaggagccaaaatccacgagaggcctggtgcatcaagctatttgcaacttaaacatcactttgccgatttatacaaaggaatcagagtcagatcaagaacaggaggaagagatcgatatgacatcagaaaaaaatccacaggatgagcaggaacggatcgaggaaaggctggcttatattgctgatcaccttggcttcagctggacagaattagcaagagaactggatttcactgaggagcaaattcatcaaattcgaattgaaaatcccaactctcttcaagaccagagtcatgcactgttgaagtactggctagagagggatgggaaacatgctacagataccaacctcgttgaatgtctcaccaagatcaaccgaatggatattgttcatctcatggagaccaacacagaacctctccaggagcgcatcagtcatagttatgcagaaattgaacagaccattacactggatcatagtgaagggttctcggtacttcaagaggagttatgcactgcacagcacaagcagaaagaggagcaagctgtttctaaagaaagtgagacctgcgatcaccctcctatcgtctcagaggaagacatttctgttggttattccacttttcaggatggcgtccccaaaactgagggggacagctcagcaacagcactctttccccaaactcacaaggagcaagttcaacaggatttctcagggaaaatgcaagacctgcctgaagagtcatctctggaatatcagcaggaatattttgtgacaactccaggaacagaaacatcagagactcagaaggctatgatagtacccagctctcccagcaagacacctgaggaagttagcacccctgcagaggaggagaagctgtacctccagaccccaacatccagcgagcggggaggctctcccatcatacaagaacccgaagagccctcagagcacagagaggagagctctccgcggaaaaccagcctcgtaatagtggagtctgccgataaccagcctgagacctgtgaaagactcgatgaagatgcagcttttgaaaagggagacgatatgcctgaaatacccccagaaacagtcacagaagaagaatacattgatgagcatggacacaccgtggtaaagaaggttactaggaaaatcattaggcggtatgtatcctctgaaggcacagagaaagaagagattatggtgcagggaatgccacaggaacctgtcaacatcgaggaaggggatggctattccaaagttataaagcgtgttgtattgaagagtgacaccgagcagtcagaggacaacaatgagtaaagccatcacacagaagagggctgtggtgaaggaccagcatggaaaacgcattgacttggagcacctggaggatgtaccagaagcactagaccaggacgacctccagcgcgatctccagcagctccttcggcatttctgcaaggaggacttgaagcaagaggccaagtgaggggctgcccagttctcacaccagaaaccacacattcactcaatatgcagcttcctgtttcagtaggggagtgacctaactggcctaattaatgggataccccgacatttccactgttagcaaatatacggcattttgctttagttttcccccatcctctttaactataaagctaatttgtgaccaaagatggcatccttcatactggatgctgtatccaatactttgttgtgtctgtgctaacctgggaactggccacctccattgttctttgcttctgcacaagatccatgaaaatccattgatcagaagaacttcacctgcagacctcttcaagtgacactatgtaggaatccttccaaggaatatctatgtacaatgtatatagctgaaatgctcagatgaacaacatattaaaattaaaaccactgcctattgtaactacactgggcatcagaataaaaggcctcta

SEQ ID NO: 107311 - DNA, 5029 bp, Homo sapiens
  Payload ID: 1066
  Gene Symbol: ANK2
  Gene Name: ankyrin 2, neuronal
  ENST ID: ENST00000503423
  CDS Start-End: 196-5029
acagtctgaggctgtaatgggaaagtcggttcctgggctgctgtctcatagacatcagcttgcagggaagctgggggctctccgaattgccctgctccggggcccctcctgctgcgtgactcacaggcacattgcagagagaagctgccgctcccagtaagtaatgaaaagagacatgaagaattggtatttcaaatgaccaccatgttgcaaaagtctgacagcaatgcaagcttcctccgtgctgccagagcaggcaacctggacaaagttgtggaatatctgaaggggggcatagacatcaatacctgcaatcagaatggactcaacgctctccatctggctgccaaggaaggccacgtggggctggtgcaggagctgctgggaagagggtcctctgtggattctgccactaagaagggaaataccgctcttcacattgcatctttggctggacaagcagaagttgtcaaagttcttgttaaggaaggagccaatattaatgcacagtctcagaatggctttactcctttatacatggctgcccaagagaatcacattgatgttgtaaaatatttgctggaaaatggagctaatcagagcactgctacagaggatggctttactcctctagctgtggcactccagcaaggacacaaccaggcggtggccatcctcttggagaatgacaccaaagggaaagtgaggctgccagctctgcatattgccgctaggaaagacgacaccaaatctgccgcacttctgcttcagaatgaccacaatgctgacgtacaatccaagatgatggtgaataggacaactgagagtggttttacccctttgcacatagctgcacattacggaaatgtcaacgtggcaactcttcttctaaaccggggagctgctgtggacttcacagccaggaatggaatcactcctctgcatgtggcttccaaaagaggaaatacaaacatggtgaagctcttactggatcgaggcggtcagatcgatgccaaaactagggatgggttgacaccacttcactgtgctgcacgaagtgggcatgaccaagtggtggaacttctgttggaacggggtgcccccttgctggcaaggactaagaatgggctgtctccactacacatggctgcccagggagaccacgtggaatgtgtgaagcacctgttacagcacaaggcacctgttgatgatgtcaccctagactacctgacagccctccacgttgctgcgcactgtggccactaccgtgtaaccaaactccttttagacaagagagccaatccgaacgccagagccctgaatggttttactccactgcacattgcctgcaagaaaaaccgcatcaaagtcatggaactgctggtgaaatatggggcttcaatccaagctataacagagtctggcctcacaccaatacatgtggctgccttcatgggccacttgaacattgtcctccttctgctgcagaacggagcctctccagatgtcactaacattcgtggtgagacggcactacacatggcagcccgagccgggcaggtggaagtggtccgatgcctcctgagaaatggtgcccttgttgatgccagagccagggaggaacagacacctttacatattgcctcccgcctgggtaagacagaaattgtccagctgcttctacaacatatggctcatccagatgcggccactacaaatgggtacacaccactgcacatctctgcccgggagggccaggtggatgtggcatcagtcctattggaagcaggagcagcccactccttagctaccaagaagggttttactcccctgcatgtagcagccaagtatggaagcctggatgtggcaaaacttctcttgcaacgccgtgctgccgcagattctgcagggaagaatggctatactccgttacatattgctgccaagaagaatcaaatgcagatagcttccacactcctgaactatggagcagagacaaacattgtgacaaagcaaggagtaactccactccatctggcctcgcaggaggggcacacagatatggttaccttgcttctggataagggagccaatatccacatgtcaactaagagtggactcacatccttacaccttgcagcccaggaagataaagtgaatgttgctgatattctcaccaagcatggagctgatcaggatgctcatacaaagcttggttacacacctttaattgtggcctgtcactatggaaatgtgaaaatggtcaactttcttctgaagcagggagcaaatgttaacgcaaaaaccaagaacggctacacgcctttgcaccaggccgctcagcagggtcacacgcacatcatcaacgtcctgctccagcatggggccaagcccaacgccaccactgcgaatggcaacactgccttggcgattgctaagcgtctgggctacatctccgtggtcgacaccctgaaggttgtgactgaggaggtcaccaccaccaccacaactattacagaaaaacacaaactaaatgtacctgagacgatgactgaggttcttgatgtttctgatgaagagggtgatgacacaatgactggtgatgggggagaataccttaggcctgaggacctaaaagaactgggtgatgactcactacccagcagtcagttcctggatggtatgaattacctgcgatacagcttggagggaggacgatctgacagccttcgatccttcagttccgacaggtctcacactctgagccatgcctcctacctgagggacagtgccgtgatggatgactcagttgtgattcccagtcaccaggtgtcaactctagccaaggaggcagaaaggaattcttatcgcctaagctggggcactgagaacttagacaacgtggctctttcttctagtcctattcattcaggtttcctggttagttttatggtggatgcccgaggtggtgctatgcgaggatgcagacacaatgggctccgaatcattattccacctcggaaatgtactgctccaacgcgagtcacctgccgactggtcaagcgccacagactggcaacaatgcctccaatggtggaaggagaaggcctggccagtcgcctgatcgaagttggaccttctggtgctcagttccttgggcctgtgatcgtggagatccctcactttgcggcccttcgaggaaaggaaagggaactggtggtcctgcgcagtgagaatggggacagctggaaagagcatttctgtgactacactgaagatgaattgaatgaaattcttaacggcatggatgaagtactggatagcccagaagacctagaaaagaaacgaatctgccgcatcatcacccgagacttcccacagtactttgcagtggtgtctcgtatcaaacaggacagcaatctgattggcccagaaggaggtgtactgagcagcacagtggtgccccaggtgcaggccgtcttcccagagggggcactcaccaagcggatccgcgtaggcctgcaggctcaacctatgcacagtgagctggttaagaagatcctaggcaacaaagctaccttcagccctatagtcactttggaacctagaagaagaaaattccacaaaccaattaccatgaccattcctgtccccaaagcttcaagtgatgtcatgttgaatggttttgggggagatgcaccaaccttaagattactatgcagcataacaggtggaaccacccctgcccagtgggaagatattacaggaactacgccattaacatttgtcaatgaatgtgtttcctttacaacaaacgtgtctgccaggttctggctgatagattgtcgacagatccaggaatccgttacttttgcatcacaagtatacagagaaattatctgcgtaccttatatggccaaatttgtagtgtttgccaaatcacatgaccccattgaagccaggttgaggtgtttctgcatgactgatgataaagtggataagacccttgaacaacaagaaaattttgctgaggtggccagaagcagggatgtggaggtgttagaaggaaaacccatctacgttgattgtttcggcaacttggtaccattaactaaaagtggccagcatcatatattcagtttttttgccttcaaagaaaatagacttcctctatttgtcaaggtacgcgatacgactcaggaaccttgcggacgactatcatttatgaaggagccaaaatccacgagaggcctggtgcatcaagctatttgcaacttaaacatcactttgccgatttatacaaaggaatcagagtcagatcaagaacaggaggaagagatcgatatgacatcagaaaaaaatgatgagacagaatctacagaaacatctgtcctgaaaagtcacctggttaatgaagttcctgtcctagcaagtccggacttgctctctgaagtttctgagatgaaacaagatttgatcaaaatgaccgccatcttgaccacagatgtgtctgataaggcaggttctattaaagtgaaggagctggtgaaggctgctgaggaagagccaggagagccttttgaaatcgttgaaagagttaaagaggacttagagaaagtgaatgaaatcctgagaagtggaacctgcacaagagatgaaagcagtgtgcagagctctcggtctgagagaggattagttgaagaggaatgggttattgtcagtgatgaggaaatagaagaggctaggcaaaaagcacctttagaaatcactgaatatccatgtgtagaagttagaatagataaagagatcaaaggaaaagtagagaaagactcaactgggctagtgaactaccttactgatgatctgaatacctgtgtgcctcttcccaaagagcagctgcagacagttcaagataaggcagggaagaaatgtgaggctctggctgttggcaggagctctgaaaaggaagggaaagacatacccccagatgagacacagagtacacagaaacagcacaaaccaagcttgg

SEQ ID NO: 107312 - DNA, 1770 bp, Homo sapiens
  Payload ID: 1066
  Gene Symbol: ANK2
  Gene Name: ankyrin 2, neuronal
  Uniprot ID: Q01484
  ENST ID: ENST00000510275
  CDS Start-End: 7-1674
ttctgcatgactgatgataaagtggataagacccttgaacaacaagaaaattttgctgaggtggccagaagcagggatgtggaggtgttagaaggaaaacccatctacgttgattgtttcggcaacttggtaccattaactaaaagtggccagcatcatatattcagtttttttgccttcaaagaaaatagacttcctctatttgtcaaggtacgcgatacgactcaggaaccttgcggacgactatcatttatgaaggagccaaaatccacgagaggcctggtgcatcaagctatttgcaacttaaacatcactttgccgatttatacaaaggaatcagagtcagatcaagaacaggaggaagagatcgatatgacatcagaaaaaaatccacaggatgagcaggaacggatcgaggaaaggctggcttatattgctgatcaccttggcttcagctggacagaattagcaagagaactggatttcactgaggagcaaattcatcaaattcgaattgaaaatcccaactctcttcaagaccagagtcatgcactgttgaagtactggctagagagggatgggaaacatgctacagataccaacctcgttgaatgtctcaccaagatcaaccgaatggatattgttcatctcatggagaccaacacagaacctctccaggagcgcatcagtcatagttatgcagaaattgaacagaccattacactggatcatagtgaagggttctcggtacttcaagaggagttatgcactgcacagcacaagcagaaagaggagcaagctgtttctaaagaaagtgagacctgcgatcaccctcctatcgtctcagaggaagacatttctgttggttattccacttttcaggatggcgtccccaaaactgagggggacagctcagcaacagcactctttccccaaactcacaaggagcaagttcaacaggatttctcagggaaaatgcaagacctgcctgaagagtcatctctggaatatcagcaggaatattttgtgacaactccaggaacagaaacatcagagactcagaaggctatgatagtacccagctctcccagcaagacacctgaggaagttagcacccctgcagaggaggagaagctgtacctccagaccccaacatccagcgagcggggaggctctcccatcatacaagaacccgaagagccctcagagcacagagaggagagctctccgcggaaaaccagcctcgtaatagtggagtctgccgataaccagcctgagacctgtgaaagactcgatgaagatgcagcttttgaaaaggagctaacagaggaattaggggagctggaggccagctcagatgaggaggcgatggtaactaccagggttgtccgccggcgagtgattattcagggagacgatatgcctgaaatacccccagaaacagtcacagaagaagaatacattgatgagcatggacacaccgtggtaaagaaggttactaggaaaatcattaggcggtatgtatcctctgaaggcacagagaaagaagagattatggtgcagggaatgccacaggaacctgtcaacatcgaggaaggggatggctattccaaagttataaagcgtgttgtattgaagagtgacaccgagcagtcagaggacaacaatgagtaaagccatcacacagaagagggctgtggtgaaggaccagcatggaaaacgcattgacttggagcacctggaggatgtaccagaagcactagaccagga

SEQ ID NO: 107313 - DNA, 545 bp, Homo sapiens
  Payload ID: 1066
  Gene Symbol: ANK2
  Gene Name: ankyrin 2, neuronal
  ENST ID: ENST00000515034
  CDS Start-End: 349-545
agctttctgattcttttttgacttgagtctgacagcaatgcaagcttcctccgtgctgccagagcaggcaacctggacaaagttgtggaatatctgaaggggggcatagacatcaatacctgcaatcagaatggactcaacgctctccatctggctgccaaggaaggccacgtggggctggtgcaggagctgctgggaagagggtcctctgtggattctgccactaagaagggaaataccgctcttcacattgcatctttggctggacaagcagaagttgtcaaagttcttgttaaggaaggagccaatattaatgcacagtctcagaatggctttactcctttatacatggctgcccaagagaatcacattgatgttgtaaaatatttgctggaaaatggagctaatcagagcactgctacagaggatggctttactcctctagctgtggcactccagcaaggacacaaccaggcggtggccatcctcttggagaatgacaccaaagggaaagtgaggctgccagctctgcatattgccgctag

SEQ ID NO: 107314 - DNA, 8051 bp, Homo sapiens
  Payload ID: 1066
  Gene Symbol: ANK2
  Gene Name: ankyrin 2, neuronal
  Uniprot ID: Q01484
  ENST ID: ENST00000506722
  CDS Start-End: 196-5787
acagtctgaggctgtaatgggaaagtcggttcctgggctgctgtctcatagacatcagcttgcagggaagctgggggctctccgaattgccctgctccggggcccctcctgctgcgtgactcacaggcacattgcagagagaagctgccgctcccagtaagtaatgaaaagagacatgaagaattggtatttcaaatgaccaccatgttgcaaaagtctgacagcaatgcaagcttcctccgtgctgccagagcaggcaacctggacaaagttgtggaatatctgaaggggggcatagacatcaatacctgcaatcagaatggactcaacgctctccatctggctgccaaggaaggccacgtggggctggtgcaggagctgctgggaagagggtcctctgtggattctgccactaagaagggaaataccgctcttcacattgcatctttggctggacaagcagaagttgtcaaagttcttgttaaggaaggagccaatattaatgcacagtctcagaatggctttactcctttatacatggctgcccaagagaatcacattgatgttgtaaaatatttgctggaaaatggagctaatcagagcactgctacagaggatggctttactcctctagctgtggcactccagcaaggacacaaccaggcggtggccatcctcttggagaatgacaccaaagggaaagtgaggctgccagctctgcatattgccgctaggaaagacgacaccaaatctgccgcacttctgcttcagaatgaccacaatgctgacgtacaatccaagatgatggtgaataggacaactgagagtggttttacccctttgcacatagctgcacattacggaaatgtcaacgtggcaactcttcttctaaaccggggagctgctgtggacttcacagccaggaatggaatcactcctctgcatgtggcttccaaaagaggaaatacaaacatggtgaagctcttactggatcgaggcggtcagatcgatgccaaaactagggatgggttgacaccacttcactgtgctgcacgaagtgggcatgaccaagtggtggaacttctgttggaacggggtgcccccttgctggcaaggactaagaatgggctgtctccactacacatggctgcccagggagaccacgtggaatgtgtgaagcacctgttacagcacaaggcacctgttgatgatgtcaccctagactacctgacagccctccacgttgctgcgcactgtggccactaccgtgtaaccaaactccttttagacaagagagccaatccgaacgccagagccctgaatggttttactccactgcacattgcctgcaagaaaaaccgcatcaaagtcatggaactgctggtgaaatatggggcttcaatccaagctataacagagtctggcctcacaccaatacatgtggctgccttcatgggccacttgaacattgtcctccttctgctgcagaacggagcctctccagatgtcactaacattcgtggtgagacggcactacacatggcagcccgagccgggcaggtggaagtggtccgatgcctcctgagaaatggtgcccttgttgatgccagagccagggaggaacagacacctttacatattgcctcccgcctgggtaagacagaaattgtccagctgcttctacaacatatggctcatccagatgcggccactacaaatgggtacacaccactgcacatctctgcccgggagggccaggtggatgtggcatcagtcctattggaagcaggagcagcccactccttagctaccaagaagggttttactcccctgcatgtagcagccaagtatggaagcctggatgtggcaaaacttctcttgcaacgccgtgctgccgcagattctgcagggaagaacggccttaccccgctccatgttgctgctcattatgacaaccagaaggtggcgctgctgttactggagaagggtgcttcccctcatgccactgccaagaatggctatactccgttacatattgctgccaagaagaatcaaatgcagatagcttccacactcctgaactatggagcagagacaaacattgtgacaaagcaaggagtaactccactccatctggcctcgcaggaggggcacacagatatggttaccttgcttctggataagggagccaatatccacatgtcaactaagagtggactcacatccttacaccttgcagcccaggaagataaagtgaatgttgctgatattctcaccaagcatggagctgatcaggatgctcatacaaagcttggttacacacctttaattgtggcctgtcactatggaaatgtgaaaatggtcaactttcttctgaagcagggagcaaatgttaacgcaaaaaccaagaacggctacacgcctttgcaccaggccgctcagcagggtcacacgcacatcatcaacgtcctgctccagcatggggccaagcccaacgccaccactgcgaatggcaacactgccttggcgattgctaagcgtctgggctacatctccgtggtcgacaccctgaaggttgtgactgaggaggtcaccaccaccaccacaactattacagaaaaacacaaactaaatgtacctgagacgatgactgaggttcttgatgtttctgatgaagagggtgatgacacaatgactggtgatgggggagaataccttaggcctgaggacctaaaagaactgggtgatgactcactacccagcagtcagttcctggatggtatgaattacctgcgatacagcttggagggaggacgatctgacagccttcgatccttcagttccgacaggtctcacactctgagccatgcctcctacctgagggacagtgccgtgatggatgactcagttgtgattcccagtcaccaggtgtcaactctagccaaggaggcagaaaggaattcttatcgcctaagctggggcactgagaacttagacaacgtggctctttcttctagtcctattcattcaggccgcgcctctccatgtcttgaacgtgacaacagcagtttcctggttagttttatggtggatgcccgaggtggtgctatgcgaggatgcagacacaatgggctccgaatcattattccacctcggaaatgtactgctccaacgcgagtcacctgccgactggtcaagcgccacagactggcaacaatgcctccaatggtggaaggagaaggcctggccagtcgcctgatcgaagttggaccttctggtgctcagttccttggtaaacttcacctgccaacggctcctcccccacttaatgagggagaaagtttggtcagccgcattcttcagctggggcctcctggaaccaaattccttgggcctgtgatcgtggagatccctcactttgcggcccttcgaggaaaggaaagggaactggtggtcctgcgcagtgagaatggggacagctggaaagagcatttctgtgactacactgaagatgaattgaatgaaattcttaacggcatggatgaagtactggatagcccagaagacctagaaaagaaacgaatctgccgcatcatcacccgagacttcccacagtactttgcagtggtgtctcgtatcaaacaggacagcaatctgattggcccagaaggaggtgtactgagcagcacagtggtgccccaggtgcaggccgtcttcccagagggggcactcaccaagcggatccgcgtaggcctgcaggctcaacctatgcacagtgagctggttaagaagatcctaggcaacaaagctaccttcagccctatagtcactttggaacctagaagaagaaaattccacaaaccaattaccatgaccattcctgtccccaaagcttcaagtgatgtcatgttgaatggttttgggggagatgcaccaaccttaagattactatgcagcataacaggtggaaccacccctgcccagtgggaagatattacaggaactacgccattaacatttgtcaatgaatgtgtttcctttacaacaaacgtgtctgccaggttctggctgatagattgtcgacagatccaggaatccgttacttttgcatcacaagtatacagagaaattatctgcgtaccttatatggccaaatttgtagtgtttgccaaatcacatgaccccattgaagccaggttgaggtgtttctgcatgactgatgataaagtggataagacccttgaacaacaagaaaattttgctgaggtggccagaagcagggatgtggaggtgttagaaggaaaacccatctacgttgattgtttcggcaacttggtaccattaactaaaagtggccagcatcatatattcagtttttttgccttcaaagaaaatagacttcctctatttgtcaaggtacgcgatacgactcaggaaccttgcggacgactatcatttatgaaggagccaaaatccacgagaggcctggtgcatcaagctatttgcaacttaaacatcactttgccgatttatacaaaggaatcagagtcagatcaagaacaggaggaagagatcgatatgacatcagaaaaaaatccacaggatgagcaggaacggatcgaggaaaggctggcttatattgctgatcaccttggcttcagctggacagaattagcaagagaactggatttcactgaggagcaaattcatcaaattcgaattgaaaatcccaactctcttcaagaccagagtcatgcactgttgaagtactggctagagagggatgggaaacatgctacagataccaacctcgttgaatgtctcaccaagatcaaccgaatggatattgttcatctcatggagaccaacacagaacctctccaggagcgcatcagtcatagttatgcagaaattgaacagaccattacactggatcatagtgaagggttctcggtacttcaagaggagttatgcactgcacagcacaagcagaaagaggagcaagctgtttctaaagaaagtgagacctgcgatcaccctcctatcgtctcagaggaagacatttctgttggttattccacttttcaggatggcgtccccaaaactgagggggacagctcagcaacagcactctttccccaaactcacaaggagcaagttcaacaggatttctcagggaaaatgcaagacctgcctgaagagtcatctctggaatatcagcaggaatattttgtgacaactccaggaacagaaacatcagagactcagaaggctatgatagtacccagctctcccagcaagacacctgaggaagttagcacccctgcagaggaggagaagctgtacctccagaccccaacatccagcgagcggggaggctctcccatcatacaagaacccgaagagccctcagagcacagagaggagagctctccgcggaaaaccagcctcgtaatagtggagtctgccgataaccagcctgagacctgtgaaagactcgatgaagatgcagcttttgaaaagggagacgatatgcctgaaatacccccagaaacagtcacagaagaagaatacattgatgagcatggacacaccgtggtaaagaaggttactaggaaaatcattaggcggtatgtatcctctgaaggcacagagaaagaagagattatggtgcagggaatgccacaggaacctgtcaacatcgaggaaggggatggctattccaaagttataaagcgtgttgtattgaagagtgacaccgagcagtcagaggacaacaatgagtaaagccatcacacagaagagggctgtggtgaaggaccagcatggaaaacgcattgacttggagcacctggaggatgtaccagaagcactagaccaggacgacctccagcgcgatctccagcagctccttcggcatttctgcaaggaggacttgaagcaagaggccaagtgaggggctgcccagttctcacaccagaaaccacacattcactcaatatgcagcttcctgtttcagtaggggagtgacctaactggcctaattaatgggataccccgacatttccactgttagcaaatatacggcattttgctttagttttcccccatcctctttaactataaagctaatttgtgaccaaagatggcatccttcatactggatgctgtatccaatactttgttgtgtctgtgctaacctgggaactggccacctccattgttctttgcttctgcacaagatccatgaaaatccattgatcagaagaacttcacctgcagacctcttcaagtgacactatgtaggaatccttccaaggaatatctatgtacaatgtatatagctgaaatgctcagatgaacaacatattaaaattaaaaccactgcctattgtaactacactgggcatcagaataaaaggcctctagaaattgctgaacaatggttaattaagatattgctaacacaatcgagtgataatacagttttactgcaaaagaagcacttcaaacctattatgtccttagaacttccagagtagccactgctcccagttaaaggtgggtcagtagccttgcagaactgtcctgagaagttattgctggtgctggccagccatggcttaggactccaacagccactctgagggaggggagaagggagcagaggccacgcagaatgaaccgatggggtattcagttgctggcagctacattgtgtggcattctagcatcttcaggtctttagatcttggacaagttggcagggtattttaaaagctataactactgtagttttccagttttcattgctgctttagcaaaccacgctgtcttacagtggtactttcttctggccactgcactgtagataattcattggaaacaagatttacccactacataaaaggttaaactccttcagtatgttggagtggtttctttttttttttctttctttcttttttttcttcaggtttatatcttctctaatacctgcatgtggcgtttaaaaatcaagaccacggtcaaacccctcttctaatcacattaattgtttccattctttttaccctgagtgagcacttttcactttccagctaggtctgtttttcagcttgcagacaagattgagaaatccttgaaaatttggttttggttaaaatttttggtttatttatttgaaatccacactcccttggaaactcttaagtgcatttgtgcacttctgtttgtttgtctcaaagaagggactgtaacaatctgagtaatttccatgtcctcttccttattcctctagtggttgaagctgtgtagcattttaacatatatatattcacaaatatattcatataaacagtatacattttgaatcagtcatttgttaaagaaaagtatattcaatgaagatgaaatttaaataaaaaaggacagagtctatcctccagggattgaacattttccaattatctggtcttttcctgttgtgcaaaaatgactcattgctccgaatgtcaaaaacaaatgcgacaaacaatggcacttcatcatttaaagtaatgttgccaagagaaaaaatttcctgggagggaggtttcccacaagccaaatctcctaagcctcaaatgctagcactttttggcagttggataggaaatgagacattctttggcagccaaaataagagaggccgatggtgaaactttttgagacaccctatggccttcttgtcaaaaccttcactggagctcaagaaaagcatttctgttgtgttatttgcagtgcagatgatgtctgtgtaacaacataatggttattcacctttttttgattttgatttttgctgtgttatcaaaaacttgaatactgtgagaagaagtgaattttcagttgacgaatcagcatcttgttcccatggtgataacactaattgaatatatctatgagggcatgtattagttaatggaaaaaaaaatacaacactaacaatacatagctgcaatgtgtacaatggctgatttaattaaataaaatgtacaagtgttaaatgt

SEQ ID NO: 107315 - DNA, 243 bp, Homo sapiens
  Payload ID: 1066
  Gene Symbol: ANK2
  Gene Name: ankyrin 2, neuronal
  ENST ID: ENST00000514167
  CDS Start-End: 1-243
gccacaggaacctgtcaacatcgaggaaggggatggctattccaaagttataaagcgtgttgtattgaagagtgacaccgagcagtcagaggctttgagttacacaggtagccacatgaaagtccacttacccagtttagtagagaatgaaatcctgaaagaggatggatcaataattaaaaggacaacaatgagtaaagccatcacacagaagagggctgtggtgaaggaccagcatggaaa

SEQ ID NO: 107316 - DNA, 5356 bp, Homo sapiens
  Payload ID: 1066
  Gene Symbol: ANK2
  Gene Name: ankyrin 2, neuronal
  ENST ID: ENST00000505342
  CDS Start-End: 1-3087
caggacataaaaatggaatcccaacaggaaagtaccttgtgggaaatgcaatcagacagtgtctcttcatctttcgagcctactatgtccgctacaacaacagttgttggtgaacaaataagcaaagtcatcatcacaaaaactgatgtggattctgattcttggagtgaaattcgggaagacgatgaagcctttgaggctcgtgtgaaagaggaagaacaaaagatatttggtttgatggtagacagacaatcacagggtaccacccctgacaccactcctgctaggaccccaactgaagaggggaccccaacaagtgagcaaaacccatttctgtttcaggaaggaaaattgtttgaaatgacccgaagtggtgccattgatatgaccaaaaggtcctatgcagatgaaagttttcactttttccaaattggtcaagaatccagggaagagactctctctgaagatgtgaaagaaggggctactggggctgatcccctaccgctggagacatcagctgaatcactagcactttcagaatcaaaagaaacagtggatgatgaggcagacttacttccagatgacgtgagtgaggaagtagaggaaatacctgcttcggatgctcaacttaactcccaaatggggatttcagcctccactgaaacacctacaaaagaagctgttagtgtagggaccaaggacctccccaccgtgcaaacgggtgatatacctcctctctctggtgtaaagcagatatcctgccccgactcttctgaaccagctgtacaagtccagttagatttttccacactcaccaggtctgtttattcagataggggtgatgattctcccgattcttccccagaagaacagaaatcagtaatcgagattcctactgcacccatggagaatgtgccttttactgaaagcaaatccaaaattcctgtaaggactatgcccacttccaccccagcacctccatctgcagagtatgagagttcagtttctgaagattttctatccagtgtagatgaggaaaataaggcggatgaagcaaaaccaaagtccaaactccctgtcaaagtacccctccaaagagttgaacagcagctctcagatctagacacctctgtccagaagacagtggctcctcagggacaggacatggcaagcatcgcaccagataatagaagcaaatctgaatctgatgctagttctttggattcaaagaccaaatgcccagtaaaaacccgaagttacactgagacagaaacagagagcagagagagggccgaggaacttgagttagaatcagaagaaggggccacaagaccaaagatacttacatcccgattgccagttaagagcagaagcactacatcttcctgcagggggggcacgagccccacaaaagaaagtaaggagcatttctttgacctttacagaaattccatagaattctttgaggagattagtgatgaggcttccaaattagtggataggctgacacagtcagagagggagcaggaaatagtttcagacgatgaaagtagtagtgccctggaagtatcagtaattgaaaatctgccacctgttgagaccgagcactcagttcctgaggacatctttgacacaaggcccatttgggatgagtctattgagactctgattgaacgcatccctgatgaaaatggccatgaccatgctgaagatccacaggatgagcaggaacggatcgaggaaaggctggcttatattgctgatcaccttggcttcagctggacagaattagcaagagaactggatttcactgaggagcaaattcatcaaattcgaattgaaaatcccaactctcttcaagaccagagtcatgcactgttgaagtactggctagagagggatgggaaacatgctacagataccaacctcgttgaatgtctcaccaagatcaaccgaatggatattgttcatctcatggagaccaacacagaacctctccaggagcgcatcagtcatagttatgcagaaattgaacagaccattacactggatcatagtgaagggttctcggtacttcaagaggagttatgcactgcacagcacaagcagaaagaggagcaagctgtttctaaagaaagtgagacctgcgatcaccctcctatcgtctcagaggaagacatttctgttggttattccacttttcaggatggcgtccccaaaactgagggggacagctcagcaacagcactctttccccaaactcacaaggagcaagttcaacaggatttctcagggaaaatgcaagacctgcctgaagagtcatctctggaatatcagcaggaatattttgtgacaactccaggaacagaaacatcagagactcagaaggctatgatagtacccagctctcccagcaagacacctgaggaagttagcacccctgcagaggaggagaagctgtacctccagaccccaacatccagcgagcggggaggctctcccatcatacaagaacccgaagagccctcagagcacagagaggagagctctccgcggaaaaccagcctcgtaatagtggagtctgccgataaccagcctgagacctgtgaaagactcgatgaagatgcagcttttgaaaagggagacgatatgcctgaaatacccccagaaacagtcacagaagaagaatacattgatgagcatggacacaccgtggtaaagaaggttactaggaaaatcattaggcggtatgtatcctctgaaggcacagagaaagaagagattatggtgcagggaatgccacaggaacctgtcaacatcgaggaaggggatggctattccaaagttataaagcgtgttgtattgaagagtgacaccgagcagtcagaggtcactttgtgtgagcccagcattttgtccagtacctcacaatttcaggctgagccagtggaaggccgtagagtcagcaaagttgttaaaacaactgtggtacttggagagaggatggagaaacatctgggggattctagtttagccactgatcttccttcagccaaagatgactttgaagaggacaacaatgagtaaagccatcacacagaagagggctgtggtgaaggaccagcatggaaaacgcattgacttggagcacctggaggatgtaccagaagcactagaccaggacgacctccagcgcgatctccagcagctccttcggcatttctgcaaggaggacttgaagcaagaggccaagtgaggggctgcccagttctcacaccagaaaccacacattcactcaatatgcagcttcctgtttcagtaggggagtgacctaactggcctaattaatgggataccccgacatttccactgttagcaaatatacggcattttgctttagttttcccccatcctctttaactataaagctaatttgtgaccaaagatggcatccttcatactggatgctgtatccaatactttgttgtgtctgtgctaacctgggaactggccacctccattgttctttgcttctgcacaagatccatgaaaatccattgatcagaagaacttcacctgcagacctcttcaagtgacactatgtaggaatccttccaaggaatatctatgtacaatgtatatagctgaaatgctcagatgaacaacatattaaaattaaaaccactgcctattgtaactacactgggcatcagaataaaaggcctctagaaattgctgaacaatggttaattaagatattgctaacacaatcgagtgataatacagttttactgcaaaagaagcacttcaaacctattatgtccttagaacttccagagtagccactgctcccagttaaaggtgggtcagtagccttgcagaactgtcctgagaagttattgctggtgctggccagccatggcttaggactccaacagccactctgagggaggggagaagggagcagaggccacgcagaatgaaccgatggggtattcagttgctggcagctacattgtgtggcattctagcatcttcaggtctttagatcttggacaagttggcagggtattttaaaagctataactactgtagttttccagttttcattgctgctttagcaaaccacgctgtcttacagtggtactttcttctggccactgcactgtagataattcattggaaacaagatttacccactacataaaaggttaaactccttcagtatgttggagtggtttctttttttttttctttctttcttttttttcttcaggtttatatcttctctaatacctgcatgtggcgtttaaaaatcaagaccacggtcaaacccctcttctaatcacattaattgtttccattctttttaccctgagtgagcacttttcactttccagctaggtctgtttttcagcttgcagacaagattgagaaatccttgaaaatttggttttggttaaaatttttggtttatttatttgaaatccacactcccttggaaactcttaagtgcatttgtgcacttctgtttgtttgtctcaaagaagggactgtaacaatctgagtaatttccatgtcctcttccttattcctctagtggttgaagctgtgtagcattttaacatatatatattcacaaatatattcatataaacagtatacattttgaatcagtcatttgttaaagaaaagtatattcaatgaagatgaaatttaaataaaaaaggacagagtctatcctccagggattgaacattttccaattatctggtcttttcctgttgtgcaaaaatgactcattgctccgaatgtcaaaaacaaatgcgacaaacaatggcacttcatcatttaaagtaatgttgccaagagaaaaaatttcctgggagggaggtttcccacaagccaaatctcctaagcctcaaatgctagcactttttggcagttggataggaaatgagacattctttggcagccaaaataagagaggccgatggtgaaactttttgagacaccctatggccttcttgtcaaaaccttcactggagctcaagaaaagcatttctgttgtgttatttgcagtgcagatgatgtctgtgtaacaacataatggttattcacctttttttgattttgatttttgctgtgttatcaaaaacttgaatactgtgagaagaagtgaattttcagttgacgaatcagcatcttgttcccatggtgataacactaattgaatatatctatgagggcatgtattagttaatggaaaaaaaaatacaacactaacaatacatagctgcaatgtgtacaatggctgatttaattaaataaaatgtacaagtgttaaatgtggcaa

SEQ ID NO: 107317 - DNA, 5160 bp, Homo sapiens
  Payload ID: 1066
  Gene Symbol: ANK2
  Gene Name: ankyrin 2, neuronal
  ENST ID: ENST00000514960
  CDS Start-End: 1-2899
caacgtggctctttcttctagtcctattcattcaggtttcctggttagttttatggtggatgcccgaggtggtgctatgcgaggatgcagacacaatgggctccgaatcattattccacctcggaaatgtactgctccaacgcgagtcacctgccgactggtcaagcgccacagactggcaacaatgcctccaatggtggaaggagaaggcctggccagtcgcctgatcgaagttggaccttctggtgctcagttccttgggcctgtgatcgtggagatccctcactttgcggcccttcgaggaaaggaaagggaactggtggtcctgcgcagtgagaatggggacagctggaaagagcatttctgtgactacactgaagatgaattgaatgaaattcttaacggcatggatgaagtactggatagcccagaagacctagaaaagaaacgaatctgccgcatcatcacccgagacttcccacagtactttgcagtggtgtctcgtatcaaacaggacagcaatctgattggcccagaaggaggtgtactgagcagcacagtggtgccccaggtgcaggccgtcttcccagagggggcactcaccaagcggatccgcgtaggcctgcaggctcaacctatgcacagtgagctggttaagaagatcctaggcaacaaagctaccttcagccctatagtcactttggaacctagaagaagaaaattccacaaaccaattaccatgaccattcctgtccccaaagcttcaagtgatgtcatgttgaatggttttgggggagatgcaccaaccttaagattactatgcagcataacaggtggaaccacccctgcccagtgggaagatattacaggaactacgccattaacatttgtcaatgaatgtgtttcctttacaacaaacgtgtctgccaggttctggctgatagattgtcgacagatccaggaatccgttacttttgcatcacaagtatacagagaaattatctgcgtaccttatatggccaaatttgtagtgtttgccaaatcacatgaccccattgaagccaggttgaggtgtttctgcatgactgatgataaagtggataagacccttgaacaacaagaaaattttgctgaggtggccagaagcagggatgtggaggtgttagaaggaaaacccatctacgttgattgtttcggcaacttggtaccattaactaaaagtggccagcatcatatattcagtttttttgccttcaaagaaaatagacttcctctatttgtcaaggtacgcgatacgactcaggaaccttgcggacgactatcatttatgaaggagccaaaatccacgagaggcctggtgcatcaagctatttgcaacttaaacatcactttgccgatttatacaaagatcgatatgacatcagaaaaaaatccacaggatgagcaggaacggatcgaggaaaggctggcttatattgctgatcaccttggcttcagctggacagaattagcaagagaactggatttcactgaggagcaaattcatcaaattcgaattgaaaatcccaactctcttcaagaccagagtcatgcactgttgaagtactggctagagagggatgggaaacatgctacagataccaacctcgttgaatgtctcaccaagatcaaccgaatggatattgttcatctcatggagaccaacacagaacctctccaggagcgcatcagtcatagttatgcagaaattgaacagaccattacactggatcatagtgaagggttctcggtacttcaagaggagttatgcactgcacagcacaagcagaaagaggagcaagctgtttctaaagaaagtgagacctgcgatcaccctcctatcgtctcagaggaagacatttctgttggttattccacttttcaggatggcgtccccaaaactgagggggacagctcagcaacagcactctttccccaaactcacaaggagcaagttcaacaggatttctcagggaaaatgcaagacctgcctgaagagtcatctctggaatatcagcaggaatattttgtgacaactccaggaacagaaacatcagagactcagaaggctatgatagtacccagctctcccagcaagacacctgaggaagttagcacccctgcagaggaggagaagctgtacctccagaccccaacatccagcgagcggggaggctctcccatcatacaagaacccgaagagccctcagagcacagagaggagagctctccgcggaaaaccagcctcgtaatagtggagtctgccgataaccagcctgagacctgtgaaagactcgatgaagatgcagcttttgaaaaggagctaacagaggaattaggggagctggaggccagctcagatgaggaggcgatggtaactaccagggttgtccgccggcgagtgattattcagggagacgatatgcctgaaatacccccagaaacagtcacagaagaagaatacattgatgagcatggacacaccgtggtaaagaaggttactaggaaaatcattaggcggtatgtatcctctgaaggcacagagaaagaagagattatggtgcagggaatgccacaggaacctgtcaacatcgaggaaggggatggctattccaaagttataaagcgtgttgtattgaagagtgacaccgagcagtcagaggtcactttgtgtgagcccagcattttgtccagtacctcacaatttcaggctgagccagtggaaggccgtagagtcagcaaagttgttaaaacaactgtggtacttggagagaggatggagaaacatctgggggattctagtttagccactgatcttccttcagccaaagatgactttgaagaggacaacaatgagtaaagccatcacacagaagagggctgtggtgaaggaccagcatggaaaacgcattgacttggagcacctggaggatgtaccagaagcactagaccaggacgacctccagcgcgatctccagcagctccttcggcatttctgcaaggaggacttgaagcaagaggccaagtgaggggctgcccagttctcacaccagaaaccacacattcactcaatatgcagcttcctgtttcagtaggggagtgacctaactggcctaattaatgggataccccgacatttccactgttagcaaatatacggcattttgctttagttttcccccatcctctttaactataaagctaatttgtgaccaaagatggcatccttcatactggatgctgtatccaatactttgttgtgtctgtgctaacctgggaactggccacctccattgttctttgcttctgcacaagatccatgaaaatccattgatcagaagaacttcacctgcagacctcttcaagtgacactatgtaggaatccttccaaggaatatctatgtacaatgtatatagctgaaatgctcagatgaacaacatattaaaattaaaaccactgcctattgtaactacactgggcatcagaataaaaggcctctagaaattgctgaacaatggttaattaagatattgctaacacaatcgagtgataatacagttttactgcaaaagaagcacttcaaacctattatgtccttagaacttccagagtagccactgctcccagttaaaggtgggtcagtagccttgcagaactgtcctgagaagttattgctggtgctggccagccatggcttaggactccaacagccactctgagggaggggagaagggagcagaggccacgcagaatgaaccgatggggtattcagttgctggcagctacattgtgtggcattctagcatcttcaggtctttagatcttggacaagttggcagggtattttaaaagctataactactgtagttttccagttttcattgctgctttagcaaaccacgctgtcttacagtggtactttcttctggccactgcactgtagataattcattggaaacaagatttacccactacataaaaggttaaactccttcagtatgttggagtggtttctttttttttttctttctttcttttttttcttcaggtttatatcttctctaatacctgcatgtggcgtttaaaaatcaagaccacggtcaaacccctcttctaatcacattaattgtttccattctttttaccctgagtgagcacttttcactttccagctaggtctgtttttcagcttgcagacaagattgagaaatccttgaaaatttggttttggttaaaatttttggtttatttatttgaaatccacactcccttggaaactcttaagtgcatttgtgcacttctgtttgtttgtctcaaagaagggactgtaacaatctgagtaatttccatgtcctcttccttattcctctagtggttgaagctgtgtagcattttaacatatatatattcacaaatatattcatataaacagtatacattttgaatcagtcatttgttaaagaaaagtatattcaatgaagatgaaatttaaataaaaaaggacagagtctatcctccagggattgaacattttccaattatctggtcttttcctgttgtgcaaaaatgactcattgctccgaatgtcaaaaacaaatgcgacaaacaatggcacttcatcatttaaagtaatgttgccaagagaaaaaatttcctgggagggaggtttcccacaagccaaatctcctaagcctcaaatgctagcactttttggcagttggataggaaatgagacattctttggcagccaaaataagagaggccgatggtgaaactttttgagacaccctatggccttcttgtcaaaaccttcactggagctcaagaaaagcatttctgttgtgttatttgcagtgcagatgatgtctgtgtaacaacataatggttattcacctttttttgattttgatttttgctgtgttatcaaaaacttgaatactgtgagaagaagtgaattttcagttgacgaatcagcatcttgttcccatggtgataacactaattgaatatatctatgagggcatgtattagttaatggaaaaaaaaatacaacactaacaatacatagctgcaatgtgtacaatggctgatttaattaaataaaatgtacaagtgttaaa

SEQ ID NO: 107318 - DNA, 895 bp, Homo sapiens
  Payload ID: 1066
  Gene Symbol: ANK2
  Gene Name: ankyrin 2, neuronal
  ENST ID: ENST00000506344
  CDS Start-End: 1-592
ctctgaaggcacagagaaagaagagattatggtgcagggaatgccacaggaacctgtcaacatcgaggaaggggatggctattccaaagttataaagcgtgttgtattgaagagtgacaccgagcagtcagaggtcactttgtgtgagcccagcattttgtccagtacctcacaatttcaggctgagccagtggaaggccgtagagtcagcaaagttgttaaaacaactgtggtacttggagagaggatggagaaacatctgggggattctagtttagccactgatcttccttcagccaaagatgactttgaagaggctttgagttacacaggtagccacatgaaagtccacttacccagtttagtagagaatgaaatcctgaaagaggatggatcaataattaaaaggacaacaatgagtaaagccatcacacagaagagggctgtggtgaaggaccagcatggaaaacgcattgacttggagcacctggaggatgtaccagaagcactagaccaggacgacctccagcgcgatctccagcagctccttcggcatttctgcaaggaggacttgaagcaagaggccaagtgaggggctgcccagttctcacaccagaaaccacacattcactcaatatgcagcttcctgtttcagtaggggagtgacctaactggcctaattaatgggataccccgacatttccactgttagcaaatatacggcattttgctttagttttcccccatcctctttaactataaagctaatttgtgaccaaagatggcatccttcatactggatgctgtatccaatactttgttgtgtctgtgctaacctgggaactggccacctccattgttctttgcttctgcacaagatccatgaaaatccatt

SEQ ID NO: 107319 - DNA, 829 bp, Homo sapiens
  Payload ID: 1066
  Gene Symbol: ANK2
  Gene Name: ankyrin 2, neuronal
  ENST ID: ENST00000508613
  CDS Start-End: 298-829
ccccgggaccatttctgagtgtgggtgcacacctatgcctgtgtgcgtgcaggtgtgtgctgctggaggtctcggtttgggaccttagttcattgtagtgagttgtgggtgctgcagaggctggagcaagattatgacctagctcgggggcggagtggattatcttgtgagtgttctggctgccagccattgccctggtggggaaaatcacatctccatagagctctgaaatcacctggattgctggggagtggaaactgatcctctgctactgcttctgctgatttcctctgcaaaatggctcacgctgctgcttctattaaaaaagttcgagaggctgatctggatgaaaaggaaaaaaatcttgagagagacagaaaaaaacaacggaaaatccccagagaacgtatggaacgaaaaagaaagtctgacagcaatgcaagcttcctccgtgctgccagagcaggcaacctggacaaagttgtggaatatctgaaggggggcatagacatcaatacctgcaatcagaatggactcaacgctctccatctggctgccaaggaaggccacgtggggctggtgcaggagctgctgggaagagggtcctctgtggattctgccactaagaagggaaataccgctcttcacattgcatctttggctggacaagcagaagttgtcaaagttcttgttaaggaaggagccaatattaatgcacagtctcagaatggctttactcctttatacatggctgcccaagagaatcacattgatgttgtaaaatatttgctggaaaatggagctaatcagagcactgctacagaggatg

SEQ ID NO: 107320 - DNA, 3537 bp, Homo sapiens
  Payload ID: 1066
  Gene Symbol: ANK2
  Gene Name: ankyrin 2, neuronal
  ENST ID: ENST00000503271
  CDS Start-End: 196-3537
acagtctgaggctgtaatgggaaagtcggttcctgggctgctgtctcatagacatcagcttgcagggaagctgggggctctccgaattgccctgctccggggcccctcctgctgcgtgactcacaggcacattgcagagagaagctgccgctcccagtaagtaatgaaaagagacatgaagaattggtatttcaaatgaccaccatgttgcaaaagtctgacagcaatgcaagcttcctccgtgctgccagagcaggcaacctggacaaagttgtggaatatctgaaggggggcatagacatcaatacctgcaatcagaatggactcaacgctctccatctggctgccaaggaaggccacgtggggctggtgcaggagctgctgggaagagggtcctctgtggattctgccactaagaagggaaataccgctcttcacattgcatctttggctggacaagcagaagttgtcaaagttcttgttaaggaaggagccaatattaatgcacagtctcagaatggctttactcctttatacatggctgcccaagagaatcacattgatgttgtaaaatatttgctggaaaatggagctaatcagagcactgctacagaggatggctttactcctctagctgtggcactccagcaaggacacaaccaggcggtggccatcctcttggagaatgacaccaaagggaaagtgaggctgccagctctgcatattgccgctaggaaagacgacaccaaatctgccgcacttctgcttcagaatgaccacaatgctgacgtacaatccaagatgatggtgaataggacaactgagagtggttttacccctttgcacatagctgcacattacggaaatgtcaacgtggcaactcttcttctaaaccggggagctgctgtggacttcacagccaggaatggaatcactcctctgcatgtggcttccaaaagaggaaatacaaacatggtgaagctcttactggatcgaggcggtcagatcgatgccaaaactagggatgggttgacaccacttcactgtgctgcacgaagtgggcatgaccaagtggtggaacttctgttggaacggggtgcccccttgctggcaaggactaagaatgggctgtctccactacacatggctgcccagggagaccacgtggaatgtgtgaagcacctgttacagcacaaggcacctgttgatgatgtcaccctagactacctgacagccctccacgttgctgcgcactgtggccactaccgtgtaaccaaactccttttagacaagagagccaatccgaacgccagagccctgaatggttttactccactgcacattgcctgcaagaaaaaccgcatcaaagtcatggaactgctggtgaaatatggggcttcaatccaagctataacagagtctggcctcacaccaatacatgtggctgccttcatgggccacttgaacattgtcctccttctgctgcagaacggagcctctccagatgtcactaacattcgtggtgagacggcactacacatggcagcccgagccgggcaggtggaagtggtccgatgcctcctgagaaatggtgcccttgttgatgccagagccagggaggaacagacacctttacatattgcctcccgcctgggtaagacagaaattgtccagctgcttctacaacatatggctcatccagatgcggccactacaaatgggtacacaccactgcacatctctgcccgggagggccaggtggatgtggcatcagtcctattggaagcaggagcagcccactccttagctaccaagaagggttttactcccctgcatgtagcagccaagtatggaagcctggatgtggcaaaacttctcttgcaacgccgtgctgccgcagattctgcagggaagaacggccttaccccgctccatgttgctgctcattatgacaaccagaaggtggcgctgctgttactggagaagggtgcttcccctcatgccactgccaagaatggctatactccgttacatattgctgccaagaagaatcaaatgcagatagcttccacactcctgaactatggagcagagacaaacattgtgacaaagcaaggagtaactccactccatctggcctcgcaggaggggcacacagatatggttaccttgcttctggataagggagccaatatccacatgtcaactaagagtggactcacatccttacaccttgcagcccaggaagataaagtgaatgttgctgatattctcaccaagcatggagctgatcaggatgctcatacaaagcttggttacacacctttaattgtggcctgtcactatggaaatgtgaaaatggtcaactttcttctgaagcagggagcaaatgttaacgcaaaaaccaagaacggctacacgcctttgcaccaggccgctcagcagggtcacacgcacatcatcaacgtcctgctccagcatggggccaagcccaacgccaccactgcgaatggcaacactgccttggcgattgctaagcgtctgggctacatctccgtggtcgacaccctgaaggttgtgactgaggaggtcaccaccaccaccacaactattacagaaaaacacaaactaaatgtacctgagacgatgactgaggttcttgatgtttctgatgaagagggtgatgacacaatgactggtgatgggggagaataccttaggcctgaggacctaaaagaactgggtgatgactcactacccagcagtcagttcctggatggtatgaattacctgcgatacagcttggagggaggacgatctgacagccttcgatccttcagttccgacaggtctcacactctgagccatgcctcctacctgagggacagtgccgtgatggatgactcagttgtgattcccagtcaccaggtgtcaactctagccaaggaggcagaaaggaattcttatcgcctaagctggggcactgagaacttagacaacgtggctctttcttctagtcctattcattcaggtttcctggttagttttatggtggatgcccgaggtggtgctatgcgaggatgcagacacaatgggctccgaatcattattccacctcggaaatgtactgctccaacgcgagtcacctgccgactggtcaagcgccacagactggcaacaatgcctccaatggtggaaggagaaggcctggccagtcgcctgatcgaagttggaccttctggtgctcagttccttggtaaacttcacctgccaacggctcctcccccacttaatgagggagaaagtttggtcagccgcattcttcagctggggcctcctggaaccaaattccttgggcctgtgatcgtggagatccctcactttgcggcccttcgaggaaaggaaagggaactggtggtcctgcgcagtgagaatggggacagctggaaagagcatttctgtgactacactgaagatgaattgaatgaaattcttaacggcatggatgaagtactggatagcccagaagacctagaa

SEQ ID NO: 107321 - DNA, 5270 bp, Homo sapiens
  Payload ID: 1066
  Gene Symbol: ANK2
  Gene Name: ankyrin 2, neuronal
  ENST ID: ENST00000504454
  CDS Start-End: 80-5270
agtaagtgcatacccgctagtggtctgtacaggcggcacggtttgatggcagagatattttctttccaaactgttcaaaatgatgaacgaagatgcagctcagaaaagcgacagtggagagaagttcaacggcagtagtcagaggagaaaaagacccaagaaggtgacatgcccccagatgaaaccagaggccgccaacattgaaaagtctgacagcaatgcaagcttcctccgtgctgccagagcaggcaacctggacaaagttgtggaatatctgaaggggggcatagacatcaatacctgcaatcagaatggactcaacgctctccatctggctgccaaggaaggccacgtggggctggtgcaggagctgctgggaagagggtcctctgtggattctgccactaagaagggaaataccgctcttcacattgcatctttggctggacaagcagaagttgtcaaagttcttgttaaggaaggagccaatattaatgcacagtctcagaatggctttactcctttatacatggctgcccaagagaatcacattgatgttgtaaaatatttgctggaaaatggagctaatcagagcactgctacagaggatggctttactcctctagctgtggcactccagcaaggacacaaccaggcggtggccatcctcttggagaatgacaccaaagggaaagtgaggctgccagctctgcatattgccgctaggaaagacgacaccaaatctgccgcacttctgcttcagaatgaccacaatgctgacgtacaatccaagatgatggtgaataggacaactgagagtggttttacccctttgcacatagctgcacattacggaaatgtcaacgtggcaactcttcttctaaaccggggagctgctgtggacttcacagccaggaatggaatcactcctctgcatgtggcttccaaaagaggaaatacaaacatggtgaagctcttactggatcgaggcggtcagatcgatgccaaaactagggatgggttgacaccacttcactgtgctgcacgaagtgggcatgaccaagtggtggaacttctgttggaacggggtgcccccttgctggcaaggactaagaatgggctgtctccactacacatggctgcccagggagaccacgtggaatgtgtgaagcacctgttacagcacaaggcacctgttgatgatgtcaccctagactacctgacagccctccacgttgctgcgcactgtggccactaccgtgtaaccaaactccttttagacaagagagccaatccgaacgccagagccctgaatggttttactccactgcacattgcctgcaagaaaaaccgcatcaaagtcatggaactgctggtgaaatatggggcttcaatccaagctataacagagtctggcctcacaccaatacatgtggctgccttcatgggccacttgaacattgtcctccttctgctgcagaacggagcctctccagatgtcactaacattcgtggtgagacggcactacacatggcagcccgagccgggcaggtggaagtggtccgatgcctcctgagaaatggtgcccttgttgatgccagagccagggaggaacagacacctttacatattgcctcccgcctgggtaagacagaaattgtccagctgcttctacaacatatggctcatccagatgcggccactacaaatgggtacacaccactgcacatctctgcccgggagggccaggtggatgtggcatcagtcctattggaagcaggagcagcccactccttagctaccaagaagggttttactcccctgcatgtagcagccaagtatggaagcctggatgtggcaaaacttctcttgcaacgccgtgctgccgcagattctgcagggaagaacggccttaccccgctccatgttgctgctcattatgacaaccagaaggtggcgctgctgttactggagaagggtgcttcccctcatgccactgccaagaatggctatactccgttacatattgctgccaagaagaatcaaatgcagatagcttccacactcctgaactatggagcagagacaaacattgtgacaaagcaaggagtaactccactccatctggcctcgcaggaggggcacacagatatggttaccttgcttctggataagggagccaatatccacatgtcaactaagagtggactcacatccttacaccttgcagcccaggaagataaagtgaatgttgctgatattctcaccaagcatggagctgatcaggatgctcatacaaagcttggttacacacctttaattgtggcctgtcactatggaaatgtgaaaatggtcaactttcttctgaagcagggagcaaatgttaacgcaaaaaccaagaacggctacacgcctttgcaccaggccgctcagcagggtcacacgcacatcatcaacgtcctgctccagcatggggccaagcccaacgccaccactgcgaatggcaacactgccttggcgattgctaagcgtctgggctacatctccgtggtcgacaccctgaaggttgtgactgaggaggtcaccaccaccaccacaactattacagaaaaacacaaactaaatgtacctgagacgatgactgaggttcttgatgtttctgatgaagagggtgatgacacaatgactggtgatgggggagaataccttaggcctgaggacctaaaagaactgggtgatgactcactacccagcagtcagttcctggatggtatgaattacctgcgatacagcttggagggaggacgatctgacagccttcgatccttcagttccgacaggtctcacactctgagccatgcctcctacctgagggacagtgccgtgatggatgactcagttgtgattcccagtcaccaggtgtcaactctagccaaggaggcagaaaggaattcttatcgcctaagctggggcactgagaacttagacaacgtggctctttcttctagtcctattcattcaggtttcctggttagttttatggtggatgcccgaggtggtgctatgcgaggatgcagacacaatgggctccgaatcattattccacctcggaaatgtactgctccaacgcgagtcacctgccgactggtcaagcgccacagactggcaacaatgcctccaatggtggaaggagaaggcctggccagtcgcctgatcgaagttggaccttctggtgctcagttccttggtaaacttcacctgccaacggctcctcccccacttaatgagggagaaagtttggtcagccgcattcttcagctggggcctcctggaaccaaattccttgggcctgtgatcgtggagatccctcactttgcggcccttcgaggaaaggaaagggaactggtggtcctgcgcagtgagaatggggacagctggaaagagcatttctgtgactacactgaagatgaattgaatgaaattcttaacggcatggatgaagtactggatagcccagaagacctagaaaagaaacgaatctgccgcatcatcacccgagacttcccacagtactttgcagtggtgtctcgtatcaaacaggacagcaatctgattggcccagaaggaggtgtactgagcagcacagtggtgccccaggtgcaggccgtcttcccagagggggcactcaccaagcggatccgcgtaggcctgcaggctcaacctatgcacagtgagctggttaagaagatcctaggcaacaaagctaccttcagccctatagtcactttggaacctagaagaagaaaattccacaaaccaattaccatgaccattcctgtccccaaagcttcaagtgatgtcatgttgaatggttttgggggagatgcaccaaccttaagattactatgcagcataacaggtggaaccacccctgcccagtgggaagatattacaggaactacgccattaacatttgtcaatgaatgtgtttcctttacaacaaacgtgtctgccaggttctggctgatagattgtcgacagatccaggaatccgttacttttgcatcacaagtatacagagaaattatctgcgtaccttatatggccaaatttgtagtgtttgccaaatcacatgaccccattgaagccaggttgaggtgtttctgcatgactgatgataaagtggataagacccttgaacaacaagaaaattttgctgaggtggccagaagcagggatgtggaggtgttagaaggaaaacccatctacgttgattgtttcggcaacttggtaccattaactaaaagtggccagcatcatatattcagtttttttgccttcaaagaaaatagacttcctctatttgtcaaggtacgcgatacgactcaggaaccttgcggacgactatcatttatgaaggagccaaaatccacgagaggcctggtgcatcaagctatttgcaacttaaacatcactttgccgatttatacaaaggaatcagagtcagatcaagaacaggaggaagagatcgatatgacatcagaaaaaaatgatgagacagaatctacagaaacatctgtcctgaaaagtcacctggttaatgaagttcctgtcctagcaagtccggacttgctctctgaagtttctgagatgaaacaagatttgatcaaaatgaccgccatcttgaccacagatgtgtctgataaggcaggttctattaaagtgaaggagctggtgaaggctgctgaggaagagccaggagagccttttgaaatcgttgaaagagttaaagaggacttagagaaagtgaatgaaatcctgagaagtggaacctgcacaagagatgaaagcagtgtgcagagctctcggtctgagagaggattagttgaagaggaatgggttattgtcagtgatgaggaaatagaagaggctaggcaaaaagcacctttagaaatcactgaatatccatgtgtagaagttagaatagataaagagatcaaaggaaaagtagagaaagactcaactgggctagtgaactaccttactgatgatctgaatacctgtgtgcctcttcccaaagagcagctgcagacagttcaagataaggcagggaagaaatgtgaggctctggctgttggcaggagctctgaaaaggaagggaaagacatacccccagatgagacacagagtacacagaaacagcacaaaccaagcttgggaataaagaagccagtaagaaggaaattaaaagaaaagcagaaacaaaaag

SEQ ID NO: 107322 - DNA, 573 bp, Homo sapiens
  Payload ID: 1066
  Gene Symbol: ANK2
  Gene Name: ankyrin 2, neuronal
  ENST ID: ENST00000511380
  CDS Start-End: 238-573
ctgcactggaaatggtcactgaatgcagcctgcagttgccgggggttttgagttctctctgacaccagcaagccagctagcagatggggagaactggtgaggggcgtggaagggaactgagcagaggagccaaggatcatcttgatgaattgcccacattagtgtacccctgggagccctggacagagtgcagagggcaaggacgggcccactgacagcaggaactgtagagctgagatggggaatgcagccctctgctcttcttgccatgcggataagagcataagagcacaaggaaacatgcaggaactggataaaaccccagactactatggctgtaacagtgaggacgtcaaagaacctggagtgtggtctgacagcaatgcaagcttcctccgtgctgccagagcaggcaacctggacaaagttgtggaatatctgaaggggggcatagacatcaatacctgcaatcagaatggactcaacgctctccatctggctgccaaggaaggccacgtggggctggtgcaggagctgctgggaagagggtcctctgtggattctgccactaag

SEQ ID NO: 107323 - DNA, 3638 bp, Homo sapiens
  Payload ID: 1066
  Gene Symbol: ANK2
  Gene Name: ankyrin 2, neuronal
  ENST ID: ENST00000509550
  CDS Start-End: 316-3462
ttttgctgcacagtgagcttctgcacagctgtagctaaatatgttaccgtgttcccgatggtaacatcttacctgcagcagatggcctgacttctgatgagggataagtgtacctggtacttgctaacaggttttggagacgtcatgaggcactttcttaagtgcaatacagtatttgtagaagatatttgacaaccttagggttaaagcgtcaagtgcttcttattaaaaagagcaagcagatgcaagcttgttgtgttaccatggtgacctggcctatagtctgaagaagttacaaagacagatttagacgtaatgaatggcaacactgccttggcgattgctaagcgtctgggctacatctccgtggtcgacaccctgaaggttgtgactgaggaggtcaccaccaccaccacaactattacagaaaaacacaaactaaatgtacctgagacgatgactgaggttcttgatgtttctgatgaagagggtgatgacacaatgactggtgatgggggagaataccttaggcctgaggacctaaaagaactgggtgatgactcactacccagcagtcagttcctggatggtatgaattacctgcgatacagcttggagggaggacgatctgacagccttcgatccttcagttccgacaggtctcacactctgagccatgcctcctacctgagggacagtgccgtgatggatgactcagttgtgattcccagtcaccaggtgtcaactctagccaaggaggcagaaaggaattcttatcgcctaagctggggcactgagaacttagacaacgtggctctttcttctagtcctattcattcaggtttcctggttagttttatggtggatgcccgaggtggtgctatgcgaggatgcagacacaatgggctccgaatcattattccacctcggaaatgtactgctccaacgcgagtcacctgccgactggtcaagcgccacagactggcaacaatgcctccaatggtggaaggagaaggcctggccagtcgcctgatcgaagttggaccttctggtgctcagttccttgggcctgtgatcgtggagatccctcactttgcggcccttcgaggaaaggaaagggaactggtggtcctgcgcagtgagaatggggacagctggaaagagcatttctgtgactacactgaagatgaattgaatgaaattcttaacggcatggatgaagtactggatagcccagaagacctagaaaagaaacgaatctgccgcatcatcacccgagacttcccacagtactttgcagtggtgtctcgtatcaaacaggacagcaatctgattggcccagaaggaggtgtactgagcagcacagtggtgccccaggtgcaggccgtcttcccagagggggcactcaccaagcggatccgcgtaggcctgcaggctcaacctatgcacagtgagctggttaagaagatcctaggcaacaaagctaccttcagccctatagtcactttggaacctagaagaagaaaattccacaaaccaattaccatgaccattcctgtccccaaagcttcaagtgatgtcatgttgaatggttttgggggagatgcaccaaccttaagattactatgcagcataacaggtggaaccacccctgcccagtgggaagatattacaggaactacgccattaacatttgtcaatgaatgtgtttcctttacaacaaacgtgtctgccaggttctggctgatagattgtcgacagatccaggaatccgttacttttgcatcacaagtatacagagaaattatctgcgtaccttatatggccaaatttgtagtgtttgccaaatcacatgaccccattgaagccaggttgaggtgtttctgcatgactgatgataaagtggataagacccttgaacaacaagaaaattttgctgaggtggccagaagcagggatgtggaggtgttagaaggaaaacccatctacgttgattgtttcggcaacttggtaccattaactaaaagtggccagcatcatatattcagtttttttgccttcaaagaaaatagacttcctctatttgtcaaggtacgcgatacgactcaggaaccttgcggacgactatcatttatgaaggagccaaaatccacgagaggcctggtgcatcaagctatttgcaacttaaacatcactttgccgatttatacaaaggaatcagagtcagatcaagaacaggaggaagagatcgatatgacatcagaaaaaaatccacaggatgagcaggaacggatcgaggaaaggctggcttatattgctgatcaccttggcttcagctggacagaattagcaagagaactggatttcactgaggagcaaattcatcaaattcgaattgaaaatcccaactctcttcaagaccagagtcatgcactgttgaagtactggctagagagggatgggaaacatgctacagataccaacctcgttgaatgtctcaccaagatcaaccgaatggatattgttcatctcatggagaccaacacagaacctctccaggagcgcatcagtcatagttatgcagaaattgaacagaccattacactggatcatagtgaagggttctcggtacttcaagaggagttatgcactgcacagcacaagcagaaagaggagcaagctgtttctaaagaaagtgagacctgcgatcaccctcctatcgtctcagaggaagacatttctgttggttattccacttttcaggatggcgtccccaaaactgagggggacagctcagcaacagcactctttccccaaactcacaaggagcaagttcaacaggatttctcagggaaaatgcaagacctgcctgaagagtcatctctggaatatcagcaggaatattttgtgacaactccaggaacagaaacatcagagactcagaaggctatgatagtacccagctctcccagcaagacacctgaggaagttagcacccctgcagaggaggagaagctgtacctccagaccccaacatccagcgagcggggaggctctcccatcatacaagaacccgaagagccctcagagcacagagaggagagctctccgcggaaaaccagcctcgtaatagtggagtctgccgataaccagcctgagacctgtgaaagactcgatgaagatgcagcttttgaaaagggagacgatatgcctgaaatacccccagaaacagtcacagaagaagaatacattgatgagcatggacacaccgtggtaaagaaggttactaggaaaatcattaggcggtatgtatcctctgaaggcacagagaaagaagagattatggtgcagggaatgccacaggaacctgtcaacatcgaggaaggggatggctattccaaagttataaagcgtgttgtattgaagagtgacaccgagcagtcagaggacaacaatgagtaaagccatcacacagaagagggctgtggtgaaggaccagcatggaaaacgcattgacttggagcacctggaggatgtaccagaagcactagaccaggacgacctccagcgcgatctccagcagctccttcggcatttctgcaaggaggacttgaagcaagaggccaagtgaggggctg

SEQ ID NO: 107324 - DNA, 561 bp, Homo sapiens
  Payload ID: 1066
  Gene Symbol: ANK2
  Gene Name: ankyrin 2, neuronal
  ENST ID: ENST00000504415
  CDS Start-End: 1-561
gatccaggaatccgttacttttgcatcacaagtatacagagaaattatctgcgtaccttatatggccaaatttgtagtgtttgccaaatcacatgaccccattgaagccaggttgaggtgtttctgcatgactgatgataaagtggataagacccttgaacaacaagaaaattttgctgaggtggccagaagcagggatgtggaggtacgcgatacgactcaggaaccttgcggacgactatcatttatgaaggagccaaaatccacgagaggcctggtgcatcaagctatttgcaacttaaacatcactttgccgatttatacaaaggaatcagagtcagatcaagaacaggaggaagagatcgatatgacatcagaaaaaaatccacaggatgagcaggaacggatcgaggaaaggctggcttatattgctgatcaccttggcttcagctggacagaattagcaagagaactggatttcactgaggagcaaattcatcaaattcgaattgaaaatcccaactctcttcaagaccagagtcatgcactgttgaagtactg

SEQ ID NO: 107325 - DNA, 6134 bp, Homo sapiens
  Payload ID: 1066
  Gene Symbol: ANK2
  Gene Name: ankyrin 2, neuronal
  ENST ID: ENST00000612754
  CDS Start-End: 99-641
agtgaggttcaagaatccacagccacctcagacgagacaaaggccttttaccagaaccagtgattcgagtacaacctccttctccacttccatcaagcatggactccaattccagtccagaagaagtacaattccagcctgtcgtttccaaacaatatactttcaagatgaatgaagatactcaggaagagccaggcaaatcagaagaagaaaaagattctgaatcccatttagctgaagaccgtcatgctgtttccactgaggctgaagacaggtcttatgataagctaaacagagacactgatcagccaaaaatctgtgatggccatggatgtgaggccatgagtcctagcagctcagctgctcctgtctcttcaggtctacagagtccgactggtgatgatgttgatgaacagccagtcatctataaagaatcattagctctccaaggcactcatgaaaaagacacagagggagaagagcttgatgtttctagagcagaatctccacaagcagattgccccagtgaaagcttttcatcttcatcctctttgcctcattgtttggtatctgaaggaaaagaattagatgaagacatatctgccacatcttctattcaaaaaacaggtcacaaaaactgatgaaacatttgagaacttaccaaaggactgcccctctcaagactcatccattactactcaaacagatagattttccatggatgttcccgtgtctgacctagctgagaatgatgaaatctatgatccacaaatcactagcccttatgaaaatgtcccttcccaatcttttttctctagtgaagaaagcaaaacccaaacagatgcaaatcacaccacaagttttcactcttctgaagtgtattctgttaccatcacatcccctgttgaagacgttgtagtggcaagctcctctagtggaactgttttaagcaaagaatctaattttgagggccaggacataaaaatggaatcccaacaggaaagtaccttgtgggaaatgcaatcagacagtgtctcttcatctttcgagcctactatgtccgctacaacaacagttgttggtgaacaaataagcaaagtcatcatcacaaaaactgatgtggattctgattcttggagtgaaattcgggaagacgatgaagcctttgaggctcgtgtgaaagaggaagaacaaaagatatttggtttgatggtagacagacaatcacagggtaccacccctgacaccactcctgctaggaccccaactgaagaggggaccccaacaagtgagcaaaacccatttctgtttcaggaaggaaaattgtttgaaatgacccgaagtggtgccattgatatgaccaaaaggtcctatgcagatgaaagttttcactttttccaaattggtcaagaatccagggaagagactctctctgaagatgtgaaagaaggggctactggggctgatcccctaccgctggagacatcagctgaatcactagcactttcagaatcaaaagaaacagtggatgatgaggcagacttacttccagatgacgtgagtgaggaagtagaggaaatacctgcttcggatgctcaacttaactcccaaatggggatttcagcctccactgaaacacctacaaaagaagctgttagtgtagggaccaaggacctccccaccgtgcaaacgggtgatatacctcctctctctggtgtaaagcagatatcctgccccgactcttctgaaccagctgtacaagtccagttagatttttccacactcaccaggtctgtttattcagataggggtgatgattctcccgattcttccccagaagaacagaaatcagtaatcgagattcctactgcacccatggagaatgtgccttttactgaaagcaaatccaaaattcctgtaaggactatgcccacttccaccccagcacctccatctgcagagtatgagagttcagtttctgaagattttctatccagtgtagatgaggaaaataaggcggatgaagcaaaaccaaagtccaaactccctgtcaaagtacccctccaaagagttgaacagcagctctcagatctagacacctctgtccagaagacagtggctcctcagggacaggacatggcaagcatcgcaccagataatagaagcaaatctgaatctgatgctagttctttggattcaaagaccaaatgcccagtaaaaacccgaagttacactgagacagaaacagagagcagagagagggccgaggaacttgagttagaatcagaagaaggggccacaagaccaaagatacttacatcccgattgccagttaagagcagaagcactacatcttcctgcagggggggcacgagccccacaaaagaaagtaaggagcatttctttgacctttacagaaattccatagaattctttgaggagattagtgatgaggcttccaaattagtggataggctgacacagtcagagagggagcaggaaatagtttcagacgatgaaagtagtagtgccctggaagtatcagtaattgaaaatctgccacctgttgagaccgagcactcagttcctgaggacatctttgacacaaggcccatttgggatgagtctattgagactctgattgaacgcatccctgatgaaaatggccatgaccatgctgaagatccacaggatgagcaggaacggatcgaggaaaggctggcttatattgctgatcaccttggcttcagctggacagaattagcaagagaactggatttcactgaggagcaaattcatcaaattcgaattgaaaatcccaactctcttcaagaccagagtcatgcactgttgaagtactggctagagagggatgggaaacatgctacagataccaacctcgttgaatgtctcaccaagatcaaccgaatggatattgttcatctcatggagaccaacacagaacctctccaggagcgcatcagtcatagttatgcagaaattgaacagaccattacactggatcatagtgaagggttctcggtacttcaagaggagttatgcactgcacagcacaagcagaaagaggagcaagctgtttctaaagaaagtgagacctgcgatcaccctcctatcgtctcagaggaagacatttctgttggttattccacttttcaggatggcgtccccaaaactgagggggacagctcagcaacagcactctttccccaaactcacaaggagcaagttcaacaggatttctcagggaaaatgcaagacctgcctgaagagtcatctctggaatatcagcaggaatattttgtgacaactccaggaacagaaacatcagagactcagaaggctatgatagtacccagctctcccagcaagacacctgaggaagttagcacccctgcagaggaggagaagctgtacctccagaccccaacatccagcgagcggggaggctctcccatcatacaagaacccgaagagccctcagagcacagagaggagagctctccgcggaaaaccagcctcgtaatagtggagtctgccgataaccagcctgagacctgtgaaagactcgatgaagatgcagcttttgaaaagggagacgatatgcctgaaatacccccagaaacagtcacagaagaagaatacattgatgagcatggacacaccgtggtaaagaaggttactaggaaaatcattaggcggtatgtatcctctgaaggcacagagaaagaagagattatggtgcagggaatgccacaggaacctgtcaacatcgaggaaggggatggctattccaaagttataaagcgtgttgtattgaagagtgacaccgagcagtcagaggacaacaatgagtaaagccatcacacagaagagggctgtggtgaaggaccagcatggaaaacgcattgacttggagcacctggaggatgtaccagaagcactagaccaggacgacctccagcgcgatctccagcagctccttcggcatttctgcaaggaggacttgaagcaagaggccaagtgaggggctgcccagttctcacaccagaaaccacacattcactcaatatgcagcttcctgtttcagtaggggagtgacctaactggcctaattaatgggataccccgacatttccactgttagcaaatatacggcattttgctttagttttcccccatcctctttaactataaagctaatttgtgaccaaagatggcatccttcatactggatgctgtatccaatactttgttgtgtctgtgctaacctgggaactggccacctccattgttctttgcttctgcacaagatccatgaaaatccattgatcagaagaacttcacctgcagacctcttcaagtgacactatgtaggaatccttccaaggaatatctatgtacaatgtatatagctgaaatgctcagatgaacaacatattaaaattaaaaccactgcctattgtaactacactgggcatcagaataaaaggcctctagaaattgctgaacaatggttaattaagatattgctaacacaatcgagtgataatacagttttactgcaaaagaagcacttcaaacctattatgtccttagaacttccagagtagccactgctcccagttaaaggtgggtcagtagccttgcagaactgtcctgagaagttattgctggtgctggccagccatggcttaggactccaacagccactctgagggaggggagaagggagcagaggccacgcagaatgaaccgatggggtattcagttgctggcagctacattgtgtggcattctagcatcttcaggtctttagatcttggacaagttggcagggtattttaaaagctataactactgtagttttccagttttcattgctgctttagcaaaccacgctgtcttacagtggtactttcttctggccactgcactgtagataattcattggaaacaagatttacccactacataaaaggttaaactccttcagtatgttggagtggtttctttttttttttctttctttcttttttttcttcaggtttatatcttctctaatacctgcatgtggcgtttaaaaatcaagaccacggtcaaacccctcttctaatcacattaattgtttccattctttttaccctgagtgagcacttttcactttccagctaggtctgtttttcagcttgcagacaagattgagaaatccttgaaaatttggttttggttaaaatttttggtttatttatttgaaatccacactcccttggaaactcttaagtgcatttgtgcacttctgtttgtttgtctcaaagaagggactgtaacaatctgagtaatttccatgtcctcttccttattcctctagtggttgaagctgtgtagcattttaacatatatatattcacaaatatattcatataaacagtatacattttgaatcagtcatttgttaaagaaaagtatattcaatgaagatgaaatttaaataaaaaaggacagagtctatcctccagggattgaacattttccaattatctggtcttttcctgttgtgcaaaaatgactcattgctccgaatgtcaaaaacaaatgcgacaaacaatggcacttcatcatttaaagtaatgttgccaagagaaaaaatttcctgggagggaggtttcccacaagccaaatctcctaagcctcaaatgctagcactttttggcagttggataggaaatgagacattctttggcagccaaaataagagaggccgatggtgaaactttttgagacaccctatggccttcttgtcaaaaccttcactggagctcaagaaaagcatttctgttgtgttatttgcagtgcagatgatgtctgtgtaacaacataatggttattcacctttttttgattttgatttttgctgtgttatcaaaaacttgaatactgtgagaagaagtgaattttcagttgacgaatcagcatcttgttcccatggtgataacactaattgaatatatctatgagggcatgtattagttaatggaaaaaaaaatacaacactaacaatacatagctgcaatgtgtacaatggctgatttaattaaataaaatgtacaagtgtt

SEQ ID NO: 107326 - DNA, 3584 bp, Homo sapiens
  Payload ID: 1066
  Gene Symbol: ANK2
  Gene Name: ankyrin 2, neuronal
  ENST ID: ENST00000634436
  CDS Start-End: 1-3584
tctgacagcaatgcaagcttcctccgtgctgccagagcaggcaacctggacaaagttgtggaatatctgaaggggggcatagacatcaatacctgcaatcagaatggactcaacgctctccatctggctgccaaggaaggccacgtggggctggtgcaggagctgctgggaagagggtcctctgtggattctgccactaagaagggaaataccgctcttcacattgcatctttggctggacaagcagaagttgtcaaagttcttgttaaggaaggagccaatattaatgcacagtctcagaatggctttactcctttatacatggctgcccaagagaatcacattgatgttgtaaaatatttgctggaaaatggagctaatcagagcactgctacagaggatggctttactcctctagctgtggcactccagcaaggacacaaccaggcggtggccatcctcttggagaatgacaccaaagggaaagtgaggctgccagctctgcatattgccgctaggaaagacgacaccaaatctgccgcacttctgcttcagaatgaccacaatgctgacgtacaatccaagatgatggtgaataggacaactgagagtggttttacccctttgcacatagctgcacattacggaaatgtcaacgtggcaactcttcttctaaaccggggagctgctgtggacttcacagccaggaatggaatcactcctctgcatgtggcttccaaaagaggaaatacaaacatggtgaagctcttactggatcgaggcggtcagatcgatgccaaaactagggatgggttgacaccacttcactgtgctgcacgaagtgggcatgaccaagtggtggaacttctgttggaacggggtgcccccttgctggcaaggactaagaatgggctgtctccactacacatggctgcccagggagaccacgtggaatgtgtgaagcacctgttacagcacaaggcacctgttgatgatgtcaccctagactacctgacagccctccacgttgctgcgcactgtggccactaccgtgtaaccaaactccttttagacaagagagccaatccgaacgccagagccctgaatggttttactccactgcacattgcctgcaagaaaaaccgcatcaaagtcatggaactgctggtgaaatatggggcttcaatccaagctataacagagtctggcctcacaccaatacatgtggctgccttcatgggccacttgaacattgtcctccttctgctgcagaacggagcctctccagatgtcactaacattcgtggtgagacggcactacacatggcagcccgagccgggcaggtggaagtggtccgatgcctcctgagaaatggtgcccttgttgatgccagagccagggaggaacagacacctttacatattgcctcccgcctgggtaagacagaaattgtccagctgcttctacaacatatggctcatccagatgcggccactacaaatgggtacacaccactgcacatctctgcccgggagggccaggtggatgtggcatcagtcctattggaagcaggagcagcccactccttagctaccaagaagggttttactcccctgcatgtagcagccaagtatggaagcctggatgtggcaaaacttctcttgcaacgccgtgctgccgcagattctgcagggaagaacggccttaccccgctccatgttgctgctcattatgacaaccagaaggtggcgctgctgttactggagaagggtgcttcccctcatgccactgccaagaatggctatactccgttacatattgctgccaagaagaatcaaatgcagatagcttccacactcctgaactatggagcagagacaaacattgtgacaaagcaaggagtaactccactccatctggcctcgcaggaggggcacacagatatggttaccttgcttctggataagggagccaatatccacatgtcaactaagagtggactcacatccttacaccttgcagcccaggaagataaagtgaatgttgctgatattctcaccaagcatggagctgatcaggatgctcatacaaagcttggttacacacctttaattgtggcctgtcactatggaaatgtgaaaatggtcaactttcttctgaagcagggagcaaatgttaacgcaaaaaccaagaacggctacacgcctttgcaccaggccgctcagcagggtcacacgcacatcatcaacgtcctgctccagcatggggccaagcccaacgccaccactgcgaatggcaacactgccttggcgattgctaagcgtctgggctacatctccgtggtcgacaccctgaaggttgtgactgaggaggtcaccaccaccaccacaactattacagaaaaacacaaactaaatgtacctgagacgatgactgaggttcttgatgtttctgatgaagagggtgatgacacaatgactggtgatgggggagaataccttaggcctgaggacctaaaagaactgggtgatgactcactacccagcagtcagttcctggatggtatgaattacctgcgatacagcttggagggaggacgatctgacagcaccatgcccagttccgacaggtctcacactctgagccatgcctcctacctgagggacagtgccgtgatggatgactcagttgtgattcccagtcaccaggtgtcaactctagccaaggaggcagaaaggaattcttatcgcctaagctggggcactgagaacttagacaacgtggctctttcttctagtcctattcattcaggtttcctggttagttttatggtggatgcccgaggtggtgctatgcgaggatgcagacacaatgggctccgaatcattattccacctcggaaatgtactgctccaacgcgagtcacctgccgactggtcaagcgccacagactggcaacaatgcctccaatggtggaaggagaaggcctggccagtcgcctgatcgaagttggaccttctggtgctcagttccttggtaaacttcacctgccaacggctcctcccccacttaatgagggagaaagtttggtcagccgcattcttcagctggggcctcctggaaccaaattccttgggcctgtgatcgtggagatccctcactttgcggcccttcgaggaaaggaaagggaactggtggtcctgcgcagtgagaatggggacagctggaaagagcatttctgtgactacactgaagatgaattgaatgaaattcttaacggcatggatgaagtactggatagcccagaagacctagaaaagaaacgaatctgccgcatcatcacccgagacttcccacagtactttgcagtggtgtctcgtatcaaacaggacagcaatctgattggcccagaaggaggtgtactgagcagcacagtggtgccccaggtgcaggccgtcttcccagagggggcactcaccaagcggatccgcgtaggcctgcaggctcaacctatgcacagtgagctggttaagaagatcctaggcaacaaagctaccttcagccctatagtcactttggaacc

SEQ ID NO: 107327 - DNA, 16874 bp, Homo sapiens
  Payload ID: 1067
  Gene Symbol: ANK3
  Gene Name: ankyrin 3, node of Ranvier (ankyrin G)
  Uniprot ID: Q12955
  ENST ID: ENST00000280772
  CDS Start-End: 193-13326
ggacaccatcatttgggtttttaaaagcttcagcttctccagcatctttgcattgtgaatatcttcctgcttctagtcaaagctttctctctagtgattggaatgctgctgtaagcctgattagaggtgcctgaggatatcaccttttacaaggaagccgtgtgtgcttgagaggatctttttaaatgcattatggctcatgcagcctcacaattaaagaaaaacagggatttagaaatcaatgctgaagaagagcctgagaaaaaaaggaaacaccgcaaacggtcccgggatcggaagaaaaagtctgatgccaatgcaagttacttaagagcagctcgagctggacaccttgaaaaggccctcgactacataaaaaatggagttgacatcaacatttgcaatcagaatgggttgaacgctctccaccttgcttccaaagaaggccatgtagaggttgtttctgagctgctgcagagagaagccaatgtggatgcagctacaaagaaaggaaacacagcattgcacatcgcatctttggctgggcaagcagaggtggtaaaagtcttggttacaaatggagccaatgtcaatgcacaatctcagaatggtttcacgccattgtatatggcagcccaggaaaatcacctggaagttgtcaagtttcttcttgacaatggtgcaagccagagcctagccacagaggatggcttcacaccattggcagtggctttgcaacaaggtcacgaccaagtcgtttcgctcctgctagagaatgacaccaaaggaaaagtgcgtctcccagctcttcatatcgcggcccgaaaagacgacacgaaagccgccgccctgctgctgcagaatgacaacaatgcagatgtggaatcaaagagtggcttcactccgctccacatagctgctcactatggaaatatcaatgtagccacgttgctgttaaaccgagcggctgctgtggatttcaccgcaaggaatgacatcactcctttacatgttgcatcaaaaagaggaaatgcaaatatggtaaaactattgctcgatcgaggagctaaaatcgatgccaaaaccagggatggtctgacaccactgcactgtggagcaaggagtggccacgagcaggtggtagaaatgttgcttgatcgagctgcccccattctttcaaaaaccaagaatggattatctccattgcacatggccacacaaggggatcatttaaactgcgtccagcttctcctccagcataatgtacccgtggatgatgtcaccaatgactacctgactgccctacacgtggctgcccactgtggccattacaaagttgccaaggttctcttggataagaaagctaaccccaatgccaaagccctgaatggctttacccctcttcatattgcctgcaagaagaatcgaattaaagtaatggaactccttctgaaacacggtgcatccatccaagctgtaaccgagtcgggccttaccccaatccatgttgctgccttcatggggcatgtaaatattgtatcacaactaatgcatcatggagcctcaccaaacaccaccaatgtgagaggagaaacagcactgcacatggcagctcgctccggccaagctgaagttgtgcggtatctggtacaagacggagctcaggtagaagctaaagctaaggatgaccaaacaccactccacatttcagcccgactggggaaagcagacatagtacaacagctgttgcagcaaggggcatctccaaatgcagccacaacttctgggtacaccccacttcacctttccgcccgagaggggcatgaggatgtggccgcgttccttttggatcatggagcgtctttatctataacaacaaagaaaggatttactcctcttcatgtggcagcaaaatatggaaagcttgaagtcgccaatctcctgctacagaaaagtgcatctccagatgctgctgggaagagcgggctaacaccactgcatgtagctgcacattacgataatcagaaagtggcccttctgcttttggaccaaggagcctcacctcacgcagccgcaaagaatggttatacgccactgcacatcgctgccaaaaagaaccagatggacatagcgacaactctgctggaatatggtgctgatgccaacgcagttacccggcaaggaattgcttccgtccatctcgcagctcaggaagggcacgtggacatggtgtcgctgctcctcggtagaaatgcgaatgtgaacctgagcaataagagcggcctgaccccactccatttggctgctcaagaagatcgagtgaatgtggcagaagtcctcgtaaaccaaggggctcatgtggacgcccagacaaagatgggatacacaccactgcatgtgggctgccactatggaaatatcaagattgttaatttcctgctccagcattctgcaaaagttaatgccaaaacaaagaatgggtatacgccattacatcaagcagcacagcaggggcatacgcatataataaatgtcttacttcagaacaacgcctcccccaatgaactcactgtgaatgggaatactgcccttggcattgcccggcgcctcggctacatctcagtagtggacaccctgaagatagtgaccgaagagaccatgaccacaactactgtcacagagaagcacaaaatgaatgttccagaaacgatgaatgaagttcttgatatgtctgatgatgaagttcgtaaagccaatgcccctgaaatgctcagtgatggcgaatatatctcagatgttgaagaaggtgaagatgcaatgaccggggacacagacaaatatcttgggccacaggaccttaaggaattgggtgatgattccctgcctgcagagggttacatgggctttagtctcggagcgcgttctgccagcctccgctccttcagttcggataggtcttacaccttgaacagaagctcctatgcacgggacagcatgatgattgaagaactccttgtgccatccaaagagcagcatctaacattcacaagggaatttgattcagattctcttagacattacagctgggctgcagacaccttagacaatgtcaatcttgtttcaagccccattcattctgggtttctggttagctttatggtggacgcgagagggggctccatgagaggaagccgtcatcacgggatgagaatcatcattcctccacgcaagtgtacggcccccactcgaatcacctgccgtttggtaaagagacataaactggccaacccaccccccatggtggaaggagagggattagccagtaggctggtagaaatgggtcctgcaggggcacaatttttaggccctgtcatagtggaaatccctcactttgggtccatgagaggaaaagagagagaactcattgttcttcgaagtgaaaatggtgaaacttggaaggagcatcagtttgacagcaaaaatgaagatttaaccgagttacttaatggcatggatgaagaacttgatagcccagaagagttagggaaaaagcgtatctgcaggattatcacgaaagatttcccccagtattttgcagtggtttcccggattaagcaggaaagcaaccagattggtcctgaaggtggaattctgagcagcaccacagtgccccttgttcaagcatctttcccagagggtgccctaactaaaagaattcgagtgggcctccaggcccagcctgttccagatgaaattgtgaaaaagatccttggaaacaaagcaacttttagcccaattgtcactgtggaaccaagaagacggaaattccataaaccaatcacaatgaccattccggtgcccccgccctcaggagaaggtgtatccaatggatacaaaggggacactacacccaatctgcgtcttctctgtagcattacagggggcacttcgcctgctcagtgggaagacatcacaggaacaactcctttgacgtttataaaagattgtgtctcctttacaaccaatgtttcagccagattttggcttgcagactgccatcaagttttagaaactgtggggttagccacgcaactgtacagagaattgatatgtgttccatatatggccaagtttgttgtttttgccaaaatgaatgatcccgtagaatcttccttgcgatgtttctgcatgacagatgacaaagtggacaaaactttagagcaacaagagaattttgaggaagtcgcaagaagcaaagatattgaggttctggaaggaaaacctatttatgttgattgttatggaaatttggccccacttaccaaaggaggacagcaacttgtttttaacttttattctttcaaagaaaatagactgccattttccatcaagattagagacaccagccaagagccctgtggtcgtctgtcttttctgaaagaaccaaagacaacaaaaggactgcctcaaacagcggtttgcaacttaaatatcactctgccagcacataaaaaggagacagagtcagatcaagatgatgagattgagaaaacagatagacgacagagcttcgcatccttagctttacgtaagcgctacagctacttgactgagcctggaatgattgaacggagtacaggagcaacaagatccctccccaccacttactcatacaagccattcttttctacaagaccataccagtcctggacaacagctccgattacagtgcctgggccagccaagtcaggcttcacttccttatcaagttcttcctctaatacgccatcagcttctccgttaaaatcaatatggtctgtttcgacaccttctccaatcaaatccacattaggcgcgtcaactacatcttcagttaaatccattagtgacgtggcatctccaattagatcctttcggacaatgtcttcgccgataaaaactgtggtgtcacaatctccatacaatatccaagtttcctctggtaccctggctagagctccagcagtcacggaagctacgcccttaaaagggctggcatccaattctacgttttcctctcgaacctctccagtgactacagcagggtctcttttggagaggtcatcaattactatgacaccccctgcctcccccaaatcaaacattaatatgtattcctcaagtttgccatttaagtcaattattacatcagcagcaccgctaatatcttcacctttaaagtcagtggtgtctccagttaaatcagcagttgatgtcatttcatcagccaaaattacaatggcatcttctctctcatcacctgtgaagcagatgcctggacatgcagaggtagcattagtcaatggatctatttcccctctaaaatatccatcatcctcaactttaattaatggatgcaaagccactgccacgttacaggaaaaaatttcttctgctacaaactctgtgagctctgtggtcagtgcagccactgacacagttgagaaagtgttttctaccacgactgcaatgccattttccccactcaggtcatatgtttctgcagcaccatcagcttttcagtctctaagaactccttccgcaagtgcactctatacatcccttgggtcgtcaatatctgcaactacctcatctgtaacttcatcaattataacagtgccagtatactctgtagtcaatgttttgccagaaccagcattaaagaaacttccagactctaattcatttacaaaatcagcagcagccttgctgtcacccattaaaacattgactacggagacacatcctcagcctcacttcagtcgaacttcatctccagttaagtcatctttgttccttgcaccctctgcccttaagttgtctacaccatcttctttatcttccagtcaggagatactaaaagatgtagctgaaatgaaagaggacctaatgcggatgaccgcaatactacagacagatgtgcctgaggagaagccattccaacctgaactcccaaaggaagggagaatagatgatgaagaacctttcaaaattgtagagaaagtaaaggaagacttagtgaaagttagtgaaatccttaaaaaggatgtatgtgtagataataaaggatcacccaaatcaccaaagagtgacaaaggacactctcctgaagatgactggatagaatttagttcggaagaaatccgggaagccagacaacaagctgctgcgagccagtctccatctctgccagagagagtgcaagtaaaagcaaaagccgcctccgaaaaggattataacttgaccaaagttattgattacctaacaaatgatattgggagtagttcactgacaaacttaaaatacaagtttgaggatgcaaagaaggatggtgaggagagacagaaaagagttttaaaaccagcaattgctttgcaggaacacaaactcaaaatgcctccagcctccatgaggacttccacctctgagaaagaattgtgtaaaatggctgattccttttttggaacagatactattttagagtctcctgatgacttttctcaacacgaccaagataaaagtcccttgtctgacagtggctttgaaacaagaagtgaaaagacaccttcagccccacaaagcgctgaaagcactggtcctaaaccactttttcatgaagttcccatccctcctgtcattacagaaacaagaactgaagtggttcatgttatcaggagctatgatccctcagctggggatgttccccagacccaaccagaggagcctgtgtcacctaaaccttcacctacttttatggaattggaaccaaagcccaccacctctagtattaaagaaaaggttaaagcatttcaaatgaaagccagtagtgaagaagatgaccacaatcgggttttaagcaaaggcatgcgtgttaaagaagagactcacataaccacaaccaccagaatggtttatcattctccaccaggcggtgaaggtgcatctgaaagaattgaagaaaccatgtcagtccatgacatcatgaaggcctttcagtccgggcgggatccttccaaagaactggcaggtctgtttgaacataagtcggcagtgtctccagatgttcacaagtctgctgctgaaacctcagcccagcatgcagagaaggacaaccaaatgaaacccaaactggagcgtataatagaagtccacatcgaaaaaggtaaccaagctgagcccactgaagtcattattagagaaaccaaaaagcatccagaaaaagaaatgtatgtatatcagaaagacttatcccggggagatattaacctaaaagattttctgccagaaaaacacgatgcttttccttgttcagaggaacagggtcagcaagaagaagaagaacttactgctgaagagtcattgccttcttatctggagtcttccagagtaaacactcctgtgtcccaagaagaagatagccgccctagttctgctcaactcatatctgatgactcttataaaacattgaagcttttgagtcaacactcaatagaataccatgacgatgagttgtcagaactaagaggggagtcttacaggtttgctgagaaaatgcttctgtcagaaaagctagatgtgtctcattctgatactgaggaatcggttacagaccatgcaggaccccctagctcagagttacaggggtctgataagcggtccagagaaaaaatagccactgcccccaaaaaagaaattctctccaaaatctataaagatgtttctgaaaatggtgtaggtaaagtgtctaaagatgagcattttgataaagtgacagtgttgcactattctggcaatgttagtagtccaaaacatgccatgtggatgcgctttactgaggacagattagacagaggtagagagaagttgatatatgaagatagggtggacaggactgtgaaggaggctgaagaaaaactgactgaagtgtcacagttttttcgtgacaaaactgaaaagctaaatgatgaactgcagtccccagagaaaaaggcacgccctaaaaatggcaaagaatattcttctcaaagccctaccagtagcagccctgagaaagtgctactgacagaactgctggcatccaatgatgagtgggttaaggcaagacagcatggccctgatggacaaggcttccccaaggccgaggagaaggcacccagtctgcccagcagcccagagaagatggttctctcccaacagactgaggacagcaagtccacagtggaagccaaaggaagtatttcacagagcaaagcaccagatgggccccagtctggattccagctcaaacaatctaaactcagttccattagattaaaatttgaacaaggcacacacgcaaaaagtaaggacatgtctcaagaagacagaaagtcagatggccagtccagaatcccagttaaaaaaatacaggagagcaagctacccgtctaccaagtttttgctagagaaaaacagcagaaggccatagacctcccagatgaaagtgtatctgtgcaaaaagattttatggtattaaaaaccaaagatgagcatgcccaaagcaacgaaattgttgtaaatgattctggctctgataatgtgaaaaaacagagaactgaaatgtcaagtaaagcaatgcctgactctttttctgagcagcaggctaaagacttggcatgtcatataacctcagatttagcaactaggggaccatgggacaaaaaggtctttagaacatgggagagttcgggagccactaacaataagtctcagaaagaaaaactttcgcatgtacttgttcatgatgtaagagagaatcacattggtcaccctgagagtaaaagtgttgatcaaaagaatgaatttatgtctgtgactgagagagaacgcaaattgttaacaaacggctctctctcagaaattaaagaaatgactgtaaaatctccctccaaaaaagtcttatatagggaatatgttgtgaaagaaggggaccatccaggcggattgcttgatcagccttccaggaggagcgagagctcagcagtgtcacacattcccgtcagagttgctgatgagaggagaatgctgtcttctaatattcccgatggtttttgtgaacagtcggcatttccaaaacatgaactatcacaaaaattgtcccagtcaagcatgagtaaagagacagttgagacacagcactttaattctatagaagatgaaaaagttacctattcagaaatcagcaaagtttccaaacaccagagttatgtaggtttatgcccacctctcgaggaaaccgaaacctcccccaccaaatctcctgattctttagagtttagcccaggaaaggaatctccctctagtgatgtattcgaccacagtcccattgatggattggaaaaactcgcaccactagcccagacagagggagggaaagagataaaaactttacccgtttatgtcagttttgtacaagtggggaagcaatatgaaaaggagatacaacaaggaggtgtaaaaaaaatcataagtcaggaatgtaagacagtacaagaaaccagggggaccttttatacaactagacagcaaaagcaacctccttctccccaaggtagtccagaagatgatactctagagcaagtatcctttctagacagctctgggaaaagccctttaaccccagaaacacccagttcagaggaagtgagttatgaatttacatctaagacacctgactcgctcatagcttatataccaggcaaacccagcccaattcccgaggtttctgaggagtcagaggaggaggaacaggccaagtcaacctcccttaagcagactacagtggaggaaacagcagttgagcgtgaaatgcctaatgacgtgagcaaagactctaaccaaagacccaaaaataacagagttgcctatattgaatttccccctcctccaccactggatgcggaccagattgagtcagataagaagcatcattatctcccagaaaaagaggttgacatgattgaagtcaatctgcaagatgagcatgacaagtaccagctggctgaacctgtcattagagtgcagccaccttcaccagttcctcccggggcagacgtcagtgattcaagcgatgacgaatctatttatcagccagtcccagttaaaaaatataccttcaaattaaaggaagtggacgatgaacaaaaagaaaaacccaaagcttctgctgaaaaggcttccaaccagaaagaactggaaagtaatggatctggaaaagataatgaatttggccttggccttgattcacctcagaatgaaattgcccagaatgggaacaacgaccagtccatcacagagtgttccattgccaccacagcagagttttctcatgacacggatgccacagagatcgactctctggatggctatgacctgcaagatgaagatgatggcttgacagagagtgattctaaactcccaattcaagccatggaaattaagaaagatatctggaacacagagggcattctgaagccagctgaccgctcttttagccaaagtaaacttgaagttatcgaggaggagggaaaggtgggaccagatgaggacaagccaccttctaaaagttcttcatctgaaaagactcctgataagactgatcagaagtcaggggcccagttcttcacactggaaggcagacatcctgacagatcagtgtttcctgatacttacttcagttacaaagtagatgaagaatttgccactccttttaaaacagtagctaccaaaggtctagattttgacccttggtctaataaccgaggggatgatgaagtttttgacagtaaatcacgggaagatgaaactaagccatttgggctggcggtagaagaccgctctccagcaacaacccctgatacaacgccagccagaacgccaactgatgaaagtaccccaactagtgagcctaaccccttcccatttcatgaaggaaaaatgtttgagatgactcgcagtggtgcaattgacatgagcaagagggattttgttgaagagaggctccaatttttccagattggtgagcatacttctgaagggaagtcaggggaccagggggaaggggataaaagtatggtcactgccacaccacagccacagtcaggggacaccactgtagaaaccaatctagagagaaatgtagagacacctacagtggaacctaaccccagcatcccgaccagcggagagtgtcaggaaggcacatccagtagtggctccctggagaaatcagcagcagccactaacacctctaaagttgaccccaagttgcgcacgcctataaaaatgggaatttctgcatccaccatgaccatgaagaaagaaggccctggagaaataacagataagatagaagcggtgatgaccagttgtcagggattagaaaatgaaactataacaatgatttcaaatacagccaatagccagatgggcgttaggccccatgaaaaacatgattttcaaaaagataactttaataacaacaacaatttggattcttccactatacagacagataacattatgagtaatatagttctgacagaacattctgcacccacttgtaccacagagaaagataacccagtgaaagtctcatcaggaaaaaagacaggggtactacaaggacactgtgtaagagataagcagaaagttcttggagaacagcaaaaaacaaaggaattgatagggattaggcaaaaatccaaacttcccataaaggccacttcaccaaaagataccttcccaccgaaccatatgtcaaacactaaagcaagtaaaatgaagcaggttagtcaatccgagaaaaccaaagcccttactacttcttcatgtgtagatgtaaagtccagaattccagtgaaaaacacacacagggataacataattgcagttagaaaagcatgtgccacacaaaagcaagggcagccagagaaaggcaaggccaaacagcttccatccaagttgccagtaaaggtaagatccacctgtgtcactaccaccaccaccactgccaccaccaccaccactaccaccactaccaccaccaccagctgcacagttaaagttaggaaaagtcagctcaaggaagtatgtaaacattccattgaatattttaagggaattagtggtgagaccttaaagcttgtggaccgcctctctgaagaagaaaaaaagatgcagtccgagttgtccgatgaggaagaaagtacctcaagaaacacgtcgttgtccgagacttcccggggtggccagccttcggttacaacgaagtctgctagagataagaaaacagaggcagcacctttaaaatcaaagagtgaaaaggccggcagtgagaaaaggagcagtagaaggactggtccacagagtccatgtgaacggacagatatcaggatggcaatagtagccgatcacctgggacttagttggacagaactggcaagggaactgaatttttcagtggatgaaatcaatcaaatacgtgtggaaaatccaaattctttaatttctcagagcttcatgttattaaaaaaatgggttaccagagacggaaaaaatgccacaactgatgccttaacttcggtcttgacaaaaattaatcgaatagatatagtgacactgctagaaggaccaatatttgattatggaaatatttcaggcaccagaagttttgcagatgagaacaatgttttccatgaccctgttgatggttggcagaatgagacatcaagtggaaacctagagtcctgcgctcaagctcgaagagtaactggtgggttactagatcgactggatgacagccctgaccagtgtagagattccattacctcatatctcaaaggagaagctggcaaatttgaagcaaatggaagccatacagaaatcactccagaagcaaagacaaaatcttactttccagaatcccaaaatgatgtaggaaaacagagtaccaaggaaactctgaaaccaaaaatacatggatctggtcatgttgaagaaccagcatcaccactagcagcatatcagaaatctctagaagaaaccagcaagcttataatagaagagactaaaccctgtgtgcctgtcagtatgaaaaagatgagtaggacttctccagcagatggcaagccaaggcttagcctccatgaagaagaggggtccagtgggtctgagcaaaagcagggagaaggttttaaggtgaaaacgaagaaagaaatccggcatgtggaaaagaagagccactcgtaacagcgaacggtcagtcaaggatcataagtttttactgccagtattgagaaattcgtggaagaaatgtcagcaggaagtaaaaattcaccgagaagtgtgtgtgtgttcgctgcttccacacattaatggcatgattttttttatgcaaaaagaaaagaaaagaaaaccacccacattttaatttagcatgagccaatttacagagcatggaaatcactttcatttccggattggcgcgtgtgcaattagcaatgcagtgtatatacaagaagccatgctgttaacagtttatctcaagtaatttggtgtcatttacaaaaggaagaaattcctgccatcagaagggacagaaggagatggaatgatcaaatcacagagaaacactaaaattactaaatctacaacagctcgccttatttttcttggacccaaactgtcagggtataaacactatttgtttcttttttaaaacatcgatagttttgctgtaaataataacactgtataaattctaacagaaaaatagaataaaatgttgataaggcactgcctcttagaacacaaacagaatattgcaaatgcatttaacaaataggggtctcaagtgacttcaccctagaagaggagggagggattctgggtgggggtgactcttcactgattcttgtatattagcaattataatgtttgtatatgcaaaactgctagcttgattttaaaaaaaaacaaatctttaaaatctgctgcaaatttaaataattcccaaaatgaggaattctgtagttctgtgaaaaatttttttcttcagaatactaatattttgatgcatgtgtatcaccttattttgattaaatcttttccaattttgcaaacactacagtatactgcaacacaaaagattttatctgtaaacacaaagcccttcatctaatatttgttgctattgccaatttttcaatgaaatgacctaaaaacaacaaaaaaaaataacctatacggtagttgctttagggggtggggggatgctatctgttagtgcttaaaagggggtaaatgcttgccgctttagaggtggatggtgctcataaaaggccccagtcgggggtatttaaaaaggactgaacagaaatccttagctagtagaatggcagcacgctgtaaaattattactgtattgtgtactggctataagatgtagacacctttcagtaagccaatcatttgtaaccattctagcagtgtcatattaggttaataaggctgctgtgttttaaagggcatttttatttgggttttggtgaaattctttaatttgttgattatattcacataaaatcagcattcattgacacatagctctaatgacatatgtatgaaaaaccatacactggatgacctagtcgattatttaagcataaaataaattgtgttaaactcttcacctatctgtgctctacagtctccttgtgttttctggcaaaaggtagttgtctaatcccttgtcatatgagtcctggccaatccaccccattggtcctctttgtgcctctgtggtcactgaagagataatctctaacattcatatgtgccctgcaagctcccagcttataaattctgtgcatttcatgggggagccaagaattaaagattaattgacaagtaagctttgcccacatctgttcaggccttcttgaaaagtgaagaattggagatactatagccagcatgtcaaaaagttgactggcacttctaggaaccatcaacatgcagttgcttttagcccacagagcttgtttttgttttgttttattaatttacatttattgtccattcttacaagttgggacatttcacataattaagttgctaacatctcttaaaaagcaagatttggcaacaatggacctcattcccagaaggtaacaacctgctagagccaagttgtccctgccctctccagccaggtgtggggtctacaggtatcactgccacagcctcatttcttatatttgtacaacctgactgtgaatttgcaacccatacactgcgtgaatctaaattctactgaggcagagaccatggctgttttaacttttattctagttaccagcttagcatatggtagtagtgatagtagtaactgtgatcatcatcactaaaactggagtgctcactacatgctattctctgttctaagcacattccatttacttacttagtcctcatatctactttatgaattaggtactgtctttctttgatggtaatgatccttttataaaattaaattagtgctaagagactttcagcaatgttatatattgcctgtccattaaagattgttgccaaatggagtgagttgtccccagtaaggattcactatcaatgcagaagaaatgcacggataatctactttgcataaagaatggggctaggttgcatctgcatggtatcccaaataaataaaatgtgccactacccttgcaccaaaattattttatgatgggtaaagttagacccttgagaggttttttttttaaaaaaaaaaaaaaaaaaaaactttcccaaaatgcctctctgtaaagccaggatcagaatataggtgtcctaacttcctatctaagagttacgaatttctgactcagtctttgagagaaggtgtttatcctgaaccagaaactcaatgatgtatacctgtttaggtattaaatagttgtgtttatatgcccaaaaatttgactttaggtatatgtgatatgctttggttccgatcaagcaggaggtcataagtttactcagaagtatccaaaatatgacattcaagatttaacttgcatatgtgtgtatatgcatatatttatacatgtatatgtagattgaatgtgacattatgtatttctaacataatatttggcctgccagcttataaatatgtatttaagcttttcattgattgacattactgtaaaaaatgaattatgattgagaagttctggatatttgctgtttttttcattttatattcttactaaattattgaatttgttaaattaaaatgtgctatcactgtattgccaaattatggcaatacactatgcagtattatttcaatactttaagaggcatctattacttcattgaacacataagcagctagcctcctttcctctgtaaataaggactttttggcatcctgatgttcctcgctgttcatttggtatcatcctggagttccatcaagactgaggattttctccatggccaataaactattgtcagcatcagctcacgtttggctgtatgacagggatatgtgagaagcccagaaataaatcacaaaaataataaggcatcttctgagtctctctgaagaagccagtgatccaaaaactaacttcatatctgagtgagtcttggtattcttgatttgcttgaagaggctgtgacatattacaaggtgtgtaatttcccaggcatatcacactgcttctgtttcatgaattgatcaaattgtccagaagtaaacatttacaagattgagatttgaa

SEQ ID NO: 107328 - DNA, 3811 bp, Homo sapiens
  Payload ID: 1067
  Gene Symbol: ANK3
  Gene Name: ankyrin 3, node of Ranvier (ankyrin G)
  Uniprot ID: Q12955
  ENST ID: ENST00000355288
  CDS Start-End: 650-3655
agctgagaacaaagttgaaagtttgcctggagctccatgccactccccgcctgggccactgctttgttttcttctaatgtttttcctctacctgggttggctgtttcttcattcatatttgagaagaatcacctcctaattaaatgtagcacttcgctctctccctacatgaaggctgtcttggttacccgactaggcaacgcgcattggtatcaaattaccgaaagtctacaccggagcagtcctcatatttacatacaaataactcaggggcttgcatttatgtcaccattctgtcctgctagaggcttgccagaggagtttttaatccaatcagaaggagctttaaaaggatgtctgcgaagtggtcaaaaggatcttaacctcaattaagtggggttttttaaaaagatttttttgggggcctgaaattttgaaaatcttcgaactctgagtggggaaagatgtataattcctcaattgcctacgaggatatcaagatgctgagaggaattcagcggtggtgaagagagtggatacaaaccagggattggtttccttgagctgttttggaggttgattctaaatcactgcttaaggaattcctggaaacatcaggaaaacatttgatcatccaagcctagtggaaatggctttaccgcagagtgaagatgcaatgaccggggacacagacaaatatcttgggccacaggaccttaaggaattgggtgatgattccctgcctgcagagggttacatgggctttagtctcggagcgcgttctgccagcctccgctccttcagttcggataggtcttacaccttgaacagaagctcctatgcacgggacagcatgatgattgaagaactccttgtgccatccaaagagcagcatctaacattcacaagggaatttgattcagattctcttagacattacagctgggctgcagacaccttagacaatgtcaatcttgtttcaagccccattcattctgggtttctggttagctttatggtggacgcgagagggggctccatgagaggaagccgtcatcacgggatgagaatcatcattcctccacgcaagtgtacggcccccactcgaatcacctgccgtttggtaaagagacataaactggccaacccaccccccatggtggaaggagagggattagccagtaggctggtagaaatgggtcctgcaggggcacaatttttaggccctgtcatagtggaaatccctcactttgggtccatgagaggaaaagagagagaactcattgttcttcgaagtgaaaatggtgaaacttggaaggagcatcagtttgacagcaaaaatgaagatttaaccgagttacttaatggcatggatgaagaacttgatagcccagaagagttagggaaaaagcgtatctgcaggattatcacgaaagatttcccccagtattttgcagtggtttcccggattaagcaggaaagcaaccagattggtcctgaaggtggaattctgagcagcaccacagtgccccttgttcaagcatctttcccagagggtgccctaactaaaagaattcgagtgggcctccaggcccagcctgttccagatgaaattgtgaaaaagatccttggaaacaaagcaacttttagcccaattgtcactgtggaaccaagaagacggaaattccataaaccaatcacaatgaccattccggtgcccccgccctcaggagaaggtgtatccaatggatacaaaggggacactacacccaatctgcgtcttctctgtagcattacagggggcacttcgcctgctcagtgggaagacatcacaggaacaactcctttgacgtttataaaagattgtgtctcctttacaaccaatgtttcagccagattttggcttgcagactgccatcaagttttagaaactgtggggttagccacgcaactgtacagagaattgatatgtgttccatatatggccaagtttgttgtttttgccaaaatgaatgatcccgtagaatcttccttgcgatgtttctgcatgacagatgacaaagtggacaaaactttagagcaacaagagaattttgaggaagtcgcaagaagcaaagatattgaggttctggaaggaaaacctatttatgttgattgttatggaaatttggccccacttaccaaaggaggacagcaacttgtttttaacttttattctttcaaagaaaatagactgccattttccatcaagattagagacaccagccaagagccctgtggtcgtctgtcttttctgaaagaaccaaagacaacaaaaggactgcctcaaacagcggtttgcaacttaaatatcactctgccagcacataaaaagattgagaaaacagatagacgacagagcttcgcatccttagctttacgtaagcgctacagctacttgactgagcctggaatgagtccacagagtccatgtgaacggacagatatcaggatggcaatagtagccgatcacctgggacttagttggacagaactggcaagggaactgaatttttcagtggatgaaatcaatcaaatacgtgtggaaaatccaaattctttaatttctcagagcttcatgttattaaaaaaatgggttaccagagacggaaaaaatgccacaactgatgccttaacttcggtcttgacaaaaattaatcgaatagatatagtgacactgctagaaggaccaatatttgattatggaaatatttcaggcaccagaagttttgcagatgagaacaatgttttccatgaccctgttgatggttatccttcccttcaagtggaactggaaacccccacagggttgcactacacaccacctacccctttccagcaagatgattattttagtgatatctctagcatagaatctccccttagaacccctagtagactgagtgatgggctagtgccttcccaggggaacatagagcattccgcagatggacctccagtcgtaactgcagaagacgcttccttagaagacagcaaactggaagactcagtgcctttaacagaaatgcctgaagcagtggatgtagatgagagccagttggagaatgtatgtctgagttggcagaatgagacatcaagtggaaacctagagtcctgcgctcaagctcgaagagtaactggtgggttactagatcgactggatgacagccctgaccagtgtagagattccattacctcatatctcaaaggagaagctggcaaatttgaagcaaatggaagccatacagaaatcactccagaagcaaagacaaaatcttactttccagaatcccaaaatgatgtaggaaaacagagtaccaaggaaactctgaaaccaaaaatacatggatctggtcatgttgaagaaccagcatcaccactagcagcatatcagaaatctctagaagaaaccagcaagcttataatagaagagactaaaccctgtgtgcctgtcagtatgaaaaagatgagtaggacttctccagcagatggcaagccaaggcttagcctccatgaagaagaggggtccagtgggtctgagcaaaagcagggagaaggttttaaggtgaaaacgaagaaagaaatccggcatgtggaaaagaagagccactcgtaacagcgaacggtcagtcaaggatcataagtttttactgccagtattgagaaattcgtggaagaaatgtcagcaggaagtaaaaattcaccgagaagtgtgtgtgtgttcgctgcttccacacattaatggcatgattttttttatgcaaaaagaaaa

SEQ ID NO: 107329 - DNA, 660 bp, Homo sapiens
  Payload ID: 1067
  Gene Symbol: ANK3
  Gene Name: ankyrin 3, node of Ranvier (ankyrin G)
  ENST ID: ENST00000373815
  CDS Start-End: 75-660
aactgacataaaacatccacctttctagtcagctgaggcttacagggaagcaaagggatacgggtgaagatgcaatgaccggggacacagacaaatatcttgggccacaggaccttaaggaattgggtgatgattccctgcctgcagagggttacatgggctttagtctcggagcgcgttctgccagcctccgctccttcagttcggataggtcttacaccttgaacagaagctcctatgcacgggacagcatgatgattgaagaactccttgtgccatccaaagagcagcatctaacattcacaagggaatttgattcagattctcttagacattacagctgggctgcagacaccttagacaatgtcaatcttgtttcaagccccattcattctgggtttctggttagctttatggtggacgcgagagggggctccatgagaggaagccgtcatcacgggatgagaatcatcattcctccacgcaagtgtacggcccccactcgaatcacctgccgtttggtaaagagacataaactggccaacccaccccccatggtggaaggagagggattagccagtaggctggtagaaatgggtcctgcaggggcacaatttttaggccctgtcatagtggaaatccctcactttgggtccatga

SEQ ID NO: 107330 - DNA, 2358 bp, Homo sapiens
  Payload ID: 1067
  Gene Symbol: ANK3
  Gene Name: ankyrin 3, node of Ranvier (ankyrin G)
  ENST ID: ENST00000373820
  CDS Start-End: 1-1380
ccaaagacaacaaaaggactgcctcaaacagcggtttgcaacttaaatatcactctgccagcacataaaaaggagacagagtcagatcaagatgatgagattgagaaaacagatagacgacagagcttcgcatccttagctttacgtaagcgctacagctacttgactgagcctggaatgagtccacagagtccatgtgaacggacagatatcaggatggcaatagtagccgatcacctgggacttagttggacagaactggcaagggaactgaatttttcagtggatgaaatcaatcaaatacgtgtggaaaatccaaattctttaatttctcagagcttcatgttattaaaaaaatgggttaccagagacggaaaaaatgccacaactgatgccttaacttcggtcttgacaaaaattaatcgaatagatatagtgacactgctagaaggaccaatatttgattatggaaatatttcaggcaccagaagttttgcagatgagaacaatgttttccatgaccctgttgatggttatccttcccttcaagtggaactggaaacccccacagggttgcactacacaccacctacccctttccagcaagatgattattttagtgatatctctagcatagaatctccccttagaacccctagtagactgagtgatgggctagtgccttcccaggggaacatagagcattccgcagatggacctccagtcgtaactgcagaagacgcttccttagaagacagcaaactggaagactcagtgcctttaacagaaatgcctgaagcagtggatgtagatgagagccagttggagaatgtatgtctgagttggcagaatgagacatcaagtggaaacctagagtcctgcgctcaagctcgaagagtaactggtgggttactagatcgactggatgacagccctgaccagtgtagagattccattacctcatatctcaaaggagaagctggcaaatttgaagcaaatggaagccatacagaaatcactccagaagcaaagacaaaatcttactttccagaatcccaaaatgatgtaggaaaacagagtaccaaggaaactctgaaaccaaaaatacatggatctggtcatgttgaagaaccagcatcaccactagcagcatatcagaaatctctagaagaaaccagcaagcttataatagaagagactaaaccctgtgtgcctgtcagtatgaaaaagatgagtaggacttctccagcagatggcaagccaaggcttagcctccatgaagaagaggggtccagtgggtctgagcaaaagcagggagaaggttttaaggtgaaaacgaagaaagaaatccggcatgtggaaaagaagagccactcgtaacagcgaacggtcagtcaaggatcataagtttttactgccagtattgagaaattcgtggaagaaatgtcagcaggaagtaaaaattcaccgagaagtgtgtgtgtgttcgctgcttccacacattaatggcatgattttttttatgcaaaaagaaaagaaaagaaaaccacccacattttaatttagcatgagccaatttacagagcatggaaatcactttcatttccggattggcgcgtgtgcaattagcaatgcagtgtatatacaagaagccatgctgttaacagtttatctcaagtaatttggtgtcatttacaaaaggaagaaattcctgccatcagaagggacagaaggagatggaatgatcaaatcacagagaaacactaaaattactaaatctacaacagctcgccttatttttcttggacccaaactgtcagggtataaacactatttgtttcttttttaaaacatcgatagttttgctgtaaataataacactgtataaattctaacagaaaaatagaataaaatgttgataaggcactgcctcttagaacacaaacagaatattgcaaatgcatttaacaaataggggtctcaagtgacttcaccctagaagaggagggagggattctgggtgggggtgactcttcactgattcttgtatattagcaattataatgtttgtatatgcaaaactgctagcttgattttaaaaaaaaacaaatctttaaaatctgctgcaaatttaaataattcccaaaatgaggaattctgtagttctgtgaaaaatttttttcttcagaatactaatattttgatgcatgtgtatcaccttattttgattaaatcttttccaattttgcaaacactacagtatactgcaacacaaaagattttatctgtaaacacaaagcccttcatctaatatttgttgctattgccaatttttcaatgaaatgacctaaaaacaac

SEQ ID NO: 107331 - DNA, 7202 bp, Homo sapiens
  Payload ID: 1067
  Gene Symbol: ANK3
  Gene Name: ankyrin 3, node of Ranvier (ankyrin G)
  Uniprot ID: Q12955
  ENST ID: ENST00000373827
  CDS Start-End: 172-5757
acagcaggaggaggataggccgcgctgggcgggcgtcgcggggccgcgcttggtgttcctgagccgcggccgaactttttcccaagaagtcccacgtttggaggcccgaggagcgggacggggaggagagactggagttcctggaaggagcagcagcagcagccccacaacatggcctcctccgcctcctcctctcccgcgggcaccgaggactccgctcctgcccagggtggctttggatcagattattcacgaagctctagaaagtctgatgccaatgcaagttacttaagagcagctcgagctggacaccttgaaaaggccctcgactacataaaaaatggagttgacatcaacatttgcaatcagaatgggttgaacgctctccaccttgcttccaaagaaggccatgtagaggttgtttctgagctgctgcagagagaagccaatgtggatgcagctacaaagaaaggaaacacagcattgcacatcgcatctttggctgggcaagcagaggtggtaaaagtcttggttacaaatggagccaatgtcaatgcacaatctcagaatggtttcacgccattgtatatggcagcccaggaaaatcacctggaagttgtcaagtttcttcttgacaatggtgcaagccagagcctagccacagaggatggcttcacaccattggcagtggctttgcaacaaggtcacgaccaagtcgtttcgctcctgctagagaatgacaccaaaggaaaagtgcgtctcccagctcttcatatcgcggcccgaaaagacgacacgaaagccgccgccctgctgctgcagaatgacaacaatgcagatgtggaatcaaagagtggcttcactccgctccacatagctgctcactatggaaatatcaatgtagccacgttgctgttaaaccgagcggctgctgtggatttcaccgcaaggaatgacatcactcctttacatgttgcatcaaaaagaggaaatgcaaatatggtaaaactattgctcgatcgaggagctaaaatcgatgccaaaaccagggatggtctgacaccactgcactgtggagcaaggagtggccacgagcaggtggtagaaatgttgcttgatcgagctgcccccattctttcaaaaaccaagaatggattatctccattgcacatggccacacaaggggatcatttaaactgcgtccagcttctcctccagcataatgtacccgtggatgatgtcaccaatgactacctgactgccctacacgtggctgcccactgtggccattacaaagttgccaaggttctcttggataagaaagctaaccccaatgccaaagccctgaatggctttacccctcttcatattgcctgcaagaagaatcgaattaaagtaatggaactccttctgaaacacggtgcatccatccaagctgtaaccgagtcgggccttaccccaatccatgttgctgccttcatggggcatgtaaatattgtatcacaactaatgcatcatggagcctcaccaaacaccaccaatgtgagaggagaaacagcactgcacatggcagctcgctccggccaagctgaagttgtgcggtatctggtacaagacggagctcaggtagaagctaaagctaaggatgaccaaacaccactccacatttcagcccgactggggaaagcagacatagtacaacagctgttgcagcaaggggcatctccaaatgcagccacaacttctgggtacaccccacttcacctttccgcccgagaggggcatgaggatgtggccgcgttccttttggatcatggagcgtctttatctataacaacaaagaaaggatttactcctcttcatgtggcagcaaaatatggaaagcttgaagtcgccaatctcctgctacagaaaagtgcatctccagatgctgctgggaagagcgggctaacaccactgcatgtagctgcacattacgataatcagaaagtggcccttctgcttttggaccaaggagcctcacctcacgcagccgcaaagaatggttatacgccactgcacatcgctgccaaaaagaaccagatggacatagcgacaactctgctggaatatggtgctgatgccaacgcagttacccggcaaggaattgcttccgtccatctcgcagctcaggaagggcacgtggacatggtgtcgctgctcctcggtagaaatgcgaatgtgaacctgagcaataagagcggcctgaccccactccatttggctgctcaagaagatcgagtgaatgtggcagaagtcctcgtaaaccaaggggctcatgtggacgcccagacaaagatgggatacacaccactgcatgtgggctgccactatggaaatatcaagattgttaatttcctgctccagcattctgcaaaagttaatgccaaaacaaagaatgggtatacgccattacatcaagcagcacagcaggggcatacgcatataataaatgtcttacttcagaacaacgcctcccccaatgaactcactgtgaatgggaatactgcccttggcattgcccggcgcctcggctacatctcagtagtggacaccctgaagatagtgaccgaagagaccatgaccacaactactgtcacagagaagcacaaaatgaatgttccagaaacgatgaatgaagttcttgatatgtctgatgatgaagttcgtaaagccaatgcccctgaaatgctcagtgatggcgaatatatctcagatgttgaagaaggtgaagatgcaatgaccggggacacagacaaatatcttgggccacaggaccttaaggaattgggtgatgattccctgcctgcagagggttacatgggctttagtctcggagcgcgttctgccagcctccgctccttcagttcggataggtcttacaccttgaacagaagctcctatgcacgggacagcatgatgattgaagaactccttgtgccatccaaagagcagcatctaacattcacaagggaatttgattcagattctcttagacattacagctgggctgcagacaccttagacaatgtcaatcttgtttcaagccccattcattctgggtttctggttagctttatggtggacgcgagagggggctccatgagaggaagccgtcatcacgggatgagaatcatcattcctccacgcaagtgtacggcccccactcgaatcacctgccgtttggtaaagagacataaactggccaacccaccccccatggtggaaggagagggattagccagtaggctggtagaaatgggtcctgcaggggcacaatttttaggccctgtcatagtggaaatccctcactttgggtccatgagaggaaaagagagagaactcattgttcttcgaagtgaaaatggtgaaacttggaaggagcatcagtttgacagcaaaaatgaagatttaaccgagttacttaatggcatggatgaagaacttgatagcccagaagagttagggaaaaagcgtatctgcaggattatcacgaaagatttcccccagtattttgcagtggtttcccggattaagcaggaaagcaaccagattggtcctgaaggtggaattctgagcagcaccacagtgccccttgttcaagcatctttcccagagggtgccctaactaaaagaattcgagtgggcctccaggcccagcctgttccagatgaaattgtgaaaaagatccttggaaacaaagcaacttttagcccaattgtcactgtggaaccaagaagacggaaattccataaaccaatcacaatgaccattccggtgcccccgccctcaggagaaggtgtatccaatggatacaaaggggacactacacccaatctgcgtcttctctgtagcattacagggggcacttcgcctgctcagtgggaagacatcacaggaacaactcctttgacgtttataaaagattgtgtctcctttacaaccaatgtttcagccagattttggcttgcagactgccatcaagttttagaaactgtggggttagccacgcaactgtacagagaattgatatgtgttccatatatggccaagtttgttgtttttgccaaaatgaatgatcccgtagaatcttccttgcgatgtttctgcatgacagatgacaaagtggacaaaactttagagcaacaagagaattttgaggaagtcgcaagaagcaaagatattgaggttctggaaggaaaacctatttatgttgattgttatggaaatttggccccacttaccaaaggaggacagcaacttgtttttaacttttattctttcaaagaaaatagactgccattttccatcaagattagagacaccagccaagagccctgtggtcgtctgtcttttctgaaagaaccaaagacaacaaaaggactgcctcaaacagcggtttgcaacttaaatatcactctgccagcacataaaaagattgagaaaacagatagacgacagagcttcgcatccttagctttacgtaagcgctacagctacttgactgagcctggaatgagtccacagagtccatgtgaacggacagatatcaggatggcaatagtagccgatcacctgggacttagttggacagaactggcaagggaactgaatttttcagtggatgaaatcaatcaaatacgtgtggaaaatccaaattctttaatttctcagagcttcatgttattaaaaaaatgggttaccagagacggaaaaaatgccacaactgatgccttaacttcggtcttgacaaaaattaatcgaatagatatagtgacactgctagaaggaccaatatttgattatggaaatatttcaggcaccagaagttttgcagatgagaacaatgttttccatgaccctgttgatggttatccttcccttcaagtggaactggaaacccccacagggttgcactacacaccacctacccctttccagcaagatgattattttagtgatatctctagcatagaatctccccttagaacccctagtagactgagtgatgggctagtgccttcccaggggaacatagagcattccgcagatggacctccagtcgtaactgcagaagacgcttccttagaagacagcaaactggaagactcagtgcctttaacagaaatgcctgaagcagtggatgtagatgagagccagttggagaatgtatgtctgagttggcagaatgagacatcaagtggaaacctagagtcctgcgctcaagctcgaagagtaactggtgggttactagatcgactggatgacagccctgaccagtgtagagattccattacctcatatctcaaaggagaagctggcaaatttgaagcaaatggaagccatacagaaatcactccagaagcaaagacaaaatcttactttccagaatcccaaaatgatgtaggaaaacagagtaccaaggaaactctgaaaccaaaaatacatggatctggtcatgttgaagaaccagcatcaccactagcagcatatcagaaatctctagaagaaaccagcaagcttataatagaagagactaaaccctgtgtgcctgtcagtatgaaaaagatgagtaggacttctccagcagatggcaagccaaggcttagcctccatgaagaagaggggtccagtgggtctgagcaaaagcagggagaaggttttaaggtgaaaacgaagaaagaaatccggcatgtggaaaagaagagccactcgtaacagcgaacggtcagtcaaggatcataagtttttactgccagtattgagaaattcgtggaagaaatgtcagcaggaagtaaaaattcaccgagaagtgtgtgtgtgttcgctgcttccacacattaatggcatgattttttttatgcaaaaagaaaagaaaagaaaaccacccacattttaatttagcatgagccaatttacagagcatggaaatcactttcatttccggattggcgcgtgtgcaattagcaatgcagtgtatatacaagaagccatgctgttaacagtttatctcaagtaatttggtgtcatttacaaaaggaagaaattcctgccatcagaagggacagaaggagatggaatgatcaaatcacagagaaacactaaaattactaaatctacaacagctcgccttatttttcttggacccaaactgtcagggtataaacactatttgtttcttttttaaaacatcgatagttttgctgtaaataataacactgtataaattctaacagaaaaatagaataaaatgttgataaggcactgcctcttagaacacaaacagaatattgcaaatgcatttaacaaataggggtctcaagtgacttcaccctagaagaggagggagggattctgggtgggggtgactcttcactgattcttgtatattagcaattataatgtttgtatatgcaaaactgctagcttgattttaaaaaaaaacaaatctttaaaatctgctgcaaatttaaataattcccaaaatgaggaattctgtagttctgtgaaaaatttttttcttcagaatactaatattttgatgcatgtgtatcaccttattttgattaaatcttttccaattttgcaaacactacagtatactgcaacacaaaagattttatctgtaaacacaaagcccttcatctaatatttgttgctattgccaatttttcaatgaaatgacctaaaaacaacaaaaaaaaataacctatacggtagttgctttagggggtggggggatgctatctgttagtgcttaaaagggggtaaatgcttgccgctttagaggtggatggtgctcataaaaggccccagtcgggggtatttaaaaaggactgaacagaaatccttagctagtagaatggcagcacgctgtaaaattattactgtattgtgtactggctataagatgtagacacctttcagtaagccaatcatttgtaaccattctagcagtgtcatattaggttaataaggctgctgtgttttaaagggcatttttatttgggttttggtgaaattctttaatttgttgattatattcacataaaatcagcattcattgacacatagctctaatgacatatgtatgaaaaaccatacactggatgacctagtcgattatttaagcataaaataaattgtgttaaactcttcaccta

SEQ ID NO: 107332 - DNA, 569 bp, Homo sapiens
  Payload ID: 1067
  Gene Symbol: ANK3
  Gene Name: ankyrin 3, node of Ranvier (ankyrin G)
  ENST ID: ENST00000506635
  CDS Start-End: 354-569
aaagtgctaaagcacccatattatctctggagaaggctgtgttgctttccatgtagatttcaagcattgggacagttgggctgttgttaatttgataggtttagaagcatttcaaaattgatgtgttccaaggctctccaaccaagcaagttatagttcacataacttgctagtttcttacttaagccccaaactgaaatcctgtgtgtgagaaaaccagttttttttttaaatgtctgtttccttcccacatataatttcaagaacagtaatgaagaggtggttcttattttgtaatccatgtccattcaaacaagctgccctcatcgtgggtgaggtgaggtgaagatgcaatgaccggggacacagacaaatatcttgggccacaggaccttaaggaattgggtgatgattccctgcctgcagagggttacatgggctttagtctcggagcgcgttctgccagcctccgctccttcagttcggataggtcttacaccttgaacagaagctcctatgcacgggacagcatgatgattgaagaactccttgtgccatccaaagagcag

SEQ ID NO: 107333 - DNA, 761 bp, Homo sapiens
  Payload ID: 1067
  Gene Symbol: ANK3
  Gene Name: ankyrin 3, node of Ranvier (ankyrin G)
  ENST ID: ENST00000474360
  CDS Start-End: 1-345
actgtcacagagaagcacaaaatgaatgttccagaaacgatgaatgaagttcttgatatgtctgatgatgaagttcgtaaagccaatgcccctgaaatgctcagtgatggcgaatatatctcagatgttgaagaaggtaatagatgcacatggtacaaaattcccaaggtacaagagtttacggtgaaaagtgaagatgcaatgaccggggacacagacaaatatcttgggccacaggaccttaaggaattgggtgatgattccctgcctgcagagggttacatgggctttagtctcggagcgcgttctgccaggtacttcgttgttgctgtctttcatagttaatttaaaacaaccatgatttgtcataaatcaaaatcatgttcatttttcacattatcccaaaatgtgttctttggatgaagatgtgaatttagcgaaatgttctcgacgcaaatacacatgctctgctattttcttttgtggtttgcggttgttaatttcatgtgattgaacatgttaattgtgtgttctttttttttttcccactttgcagtcatgctgccagcacagtagcaaaagagctcactgacaaaactgggagaaccaatctgagtcacatatttcaaaattaagttttgttccatattgaaagaaagtattatttgctaataagtgagaaatatgtgtatagattgttcactattctctgttactgaaataataattcatgattaaaagagagcatttttgaaaaaaaa

SEQ ID NO: 107334 - DNA, 657 bp, Homo sapiens
  Payload ID: 1067
  Gene Symbol: ANK3
  Gene Name: ankyrin 3, node of Ranvier (ankyrin G)
  ENST ID: ENST00000502769
  CDS Start-End: 1-501
agccctgaccagtgtagagattccattacctcatatctcaaaggagaagctggcaaatttgaagcaaatggaagccatacagaaatcactccagaagcaaagacaaaatcttactttccagaatcccaaaatgatgtaggaaaacagagtaccaaggaaactctgaaaccaaaaatacatggatctggtcatgttgaagaaccagcatcaccactagcagcatatcagaaatctctagaagaaaccagcaagcttataatagaagagactaaaccctgtgtgcctgtcagtatgaaaaagatgagtaggacttctccagcagatggcaagccaaggcttagcctccatgaagaagaggggtccagtgggtctgagcaaaaggtcaaaagtccgggtgcggctcctacacggatgactgcctgctgttataagcagggagaaggttttaaggtgaaaacgaagaaagaaatccggcatgtggaaaagaagagccactcgtaacagcgaacggtcagtcaaggatcataagtttttactgccagtattgagaaattcgtggaagaaatgtcagcaggaagtaaaaattcaccgagaagtgtgtgtgtgttcgctgcttccacacattaatggcatgattttttttatgcaaaaagaaaa

SEQ ID NO: 107335 - DNA, 587 bp, Homo sapiens
  Payload ID: 1067
  Gene Symbol: ANK3
  Gene Name: ankyrin 3, node of Ranvier (ankyrin G)
  ENST ID: ENST00000467420
  CDS Start-End: 1-587
tttcaagccccattcattctgggtttctggttagctttatggtggacgcgagagggggctccatgagaggaagccgtcatcacgggatgagaatcatcattcctccacgcaagtgtacggcccccactcgaatcacctgccgtttggtaaagagacataaactggccaacccaccccccatggtggaaggagagggattagccagtaggctggtagaaatgggtcctgcaggggcacaatttttaggtaaactgcatcttcctaccaatcctccccctgtaaatgagggtgagagcttggttagccgaatcctgcagcttgggcctcaaggaacaaaatttattggccctgtcatagtggaaatccctcactttgggtccatgagaggaaaagagagagaactcattgttcttcgaagtgaaaatggtgaaacttggaaggagcatcagtttgacagcaaaaatgaagatttaaccgagttacttaatggcatggatgaagaacttgatagcccagaagagttagggaaaaagcgtatctgcaggattatcacgaaagatttcccccagtattttgcagtggtttcc

SEQ ID NO: 107336 - DNA, 5792 bp, Homo sapiens
  Payload ID: 1067
  Gene Symbol: ANK3
  Gene Name: ankyrin 3, node of Ranvier (ankyrin G)
  Uniprot ID: Q12955
  ENST ID: ENST00000503366
  CDS Start-End: 137-5743
aagcagcggctgctttgcctggggagcacccgtaaatggactttggtctcaatgctttgactctttgccgtggttttggatgttggaataccggcggtgatctgtcttttataaactcacctgatttaaaggaaagatgagtgaagaaccaaaggagaaaaatgcaaaacctgctcataggaaaaggaaaggaaaaaagtctgatgccaatgcaagttacttaagagcagctcgagctggacaccttgaaaaggccctcgactacataaaaaatggagttgacatcaacatttgcaatcagaatgggttgaacgctctccaccttgcttccaaagaaggccatgtagaggttgtttctgagctgctgcagagagaagccaatgtggatgcagctacaaagaaaggaaacacagcattgcacatcgcatctttggctgggcaagcagaggtggtaaaagtcttggttacaaatggagccaatgtcaatgcacaatctcagaatggtttcacgccattgtatatggcagcccaggaaaatcacctggaagttgtcaagtttcttcttgacaatggtgcaagccagagcctagccacagaggatggcttcacaccattggcagtggctttgcaacaaggtcacgaccaagtcgtttcgctcctgctagagaatgacaccaaaggaaaagtgcgtctcccagctcttcatatcgcggcccgaaaagacgacacgaaagccgccgccctgctgctgcagaatgacaacaatgcagatgtggaatcaaagagtggcttcactccgctccacatagctgctcactatggaaatatcaatgtagccacgttgctgttaaaccgagcggctgctgtggatttcaccgcaaggaatgacatcactcctttacatgttgcatcaaaaagaggaaatgcaaatatggtaaaactattgctcgatcgaggagctaaaatcgatgccaaaaccagggatggtctgacaccactgcactgtggagcaaggagtggccacgagcaggtggtagaaatgttgcttgatcgagctgcccccattctttcaaaaaccaagaatggattatctccattgcacatggccacacaaggggatcatttaaactgcgtccagcttctcctccagcataatgtacccgtggatgatgtcaccaatgactacctgactgccctacacgtggctgcccactgtggccattacaaagttgccaaggttctcttggataagaaagctaaccccaatgccaaagccctgaatggctttacccctcttcatattgcctgcaagaagaatcgaattaaagtaatggaactccttctgaaacacggtgcatccatccaagctgtaaccgagtcgggccttaccccaatccatgttgctgccttcatggggcatgtaaatattgtatcacaactaatgcatcatggagcctcaccaaacaccaccaatgtgagaggagaaacagcactgcacatggcagctcgctccggccaagctgaagttgtgcggtatctggtacaagacggagctcaggtagaagctaaagctaaggatgaccaaacaccactccacatttcagcccgactggggaaagcagacatagtacaacagctgttgcagcaaggggcatctccaaatgcagccacaacttctgggtacaccccacttcacctttccgcccgagaggggcatgaggatgtggccgcgttccttttggatcatggagcgtctttatctataacaacaaagaaaggatttactcctcttcatgtggcagcaaaatatggaaagcttgaagtcgccaatctcctgctacagaaaagtgcatctccagatgctgctgggaagagcgggctaacaccactgcatgtagctgcacattacgataatcagaaagtggcccttctgcttttggaccaaggagcctcacctcacgcagccgcaaagaatggttatacgccactgcacatcgctgccaaaaagaaccagatggacatagcgacaactctgctggaatatggtgctgatgccaacgcagttacccggcaaggaattgcttccgtccatctcgcagctcaggaagggcacgtggacatggtgtcgctgctcctcggtagaaatgcgaatgtgaacctgagcaataagagcggcctgaccccactccatttggctgctcaagaagatcgagtgaatgtggcagaagtcctcgtaaaccaaggggctcatgtggacgcccagacaaagatgggatacacaccactgcatgtgggctgccactatggaaatatcaagattgttaatttcctgctccagcattctgcaaaagttaatgccaaaacaaagaatgggtatacgccattacatcaagcagcacagcaggggcatacgcatataataaatgtcttacttcagaacaacgcctcccccaatgaactcactgtgaatgggaatactgcccttggcattgcccggcgcctcggctacatctcagtagtggacaccctgaagatagtgaccgaagagaccatgaccacaactactgtcacagagaagcacaaaatgaatgttccagaaacgatgaatgaagttcttgatatgtctgatgatgaagttcgtaaagccaatgcccctgaaatgctcagtgatggcgaatatatctcagatgttgaagaaggtaatagatgcacatggtacaaaattcccaaggtacaagagtttacggtgaaaagtgaagatgcaatgaccggggacacagacaaatatcttgggccacaggaccttaaggaattgggtgatgattccctgcctgcagagggttacatgggctttagtctcggagcgcgttctgccagcctccgctccttcagttcggataggtcttacaccttgaacagaagctcctatgcacgggacagcatgatgattgaagaactccttgtgccatccaaagagcagcatctaacattcacaagggaatttgattcagattctcttagacattacagctgggctgcagacaccttagacaatgtcaatcttgtttcaagccccattcattctgggtttctggttagctttatggtggacgcgagagggggctccatgagaggaagccgtcatcacgggatgagaatcatcattcctccacgcaagtgtacggcccccactcgaatcacctgccgtttggtaaagagacataaactggccaacccaccccccatggtggaaggagagggattagccagtaggctggtagaaatgggtcctgcaggggcacaatttttaggccctgtcatagtggaaatccctcactttgggtccatgagaggaaaagagagagaactcattgttcttcgaagtgaaaatggtgaaacttggaaggagcatcagtttgacagcaaaaatgaagatttaaccgagttacttaatggcatggatgaagaacttgatagcccagaagagttagggaaaaagcgtatctgcaggattatcacgaaagatttcccccagtattttgcagtggtttcccggattaagcaggaaagcaaccagattggtcctgaaggtggaattctgagcagcaccacagtgccccttgttcaagcatctttcccagagggtgccctaactaaaagaattcgagtgggcctccaggcccagcctgttccagatgaaattgtgaaaaagatccttggaaacaaagcaacttttagcccaattgtcactgtggaaccaagaagacggaaattccataaaccaatcacaatgaccattccggtgcccccgccctcaggagaaggtgtatccaatggatacaaaggggacactacacccaatctgcgtcttctctgtagcattacagggggcacttcgcctgctcagtgggaagacatcacaggaacaactcctttgacgtttataaaagattgtgtctcctttacaaccaatgtttcagccagattttggcttgcagactgccatcaagttttagaaactgtggggttagccacgcaactgtacagagaattgatatgtgttccatatatggccaagtttgttgtttttgccaaaatgaatgatcccgtagaatcttccttgcgatgtttctgcatgacagatgacaaagtggacaaaactttagagcaacaagagaattttgaggaagtcgcaagaagcaaagatattgaggttctggaaggaaaacctatttatgttgattgttatggaaatttggccccacttaccaaaggaggacagcaacttgtttttaacttttattctttcaaagaaaatagactgccattttccatcaagattagagacaccagccaagagccctgtggtcgtctgtcttttctgaaagaaccaaagacaacaaaaggactgcctcaaacagcggtttgcaacttaaatatcactctgccagcacataaaaagattgagaaaacagatagacgacagagcttcgcatccttagctttacgtaagcgctacagctacttgactgagcctggaatgagtccacagagtccatgtgaacggacagatatcaggatggcaatagtagccgatcacctgggacttagttggacagaactggcaagggaactgaatttttcagtggatgaaatcaatcaaatacgtgtggaaaatccaaattctttaatttctcagagcttcatgttattaaaaaaatgggttaccagagacggaaaaaatgccacaactgatgccttaacttcggtcttgacaaaaattaatcgaatagatatagtgacactgctagaaggaccaatatttgattatggaaatatttcaggcaccagaagttttgcagatgagaacaatgttttccatgaccctgttgatggttatccttcccttcaagtggaactggaaacccccacagggttgcactacacaccacctacccctttccagcaagatgattattttagtgatatctctagcatagaatctccccttagaacccctagtagactgagtgatgggctagtgccttcccaggggaacatagagcattccgcagatggacctccagtcgtaactgcagaagacgcttccttagaagacagcaaactggaagactcagtgcctttaacagaaatgcctgaagcagtggatgtagatgagagccagttggagaatgtatgtctgagttggcagaatgagacatcaagtggaaacctagagtcctgcgctcaagctcgaagagtaactggtgggttactagatcgactggatgacagccctgaccagtgtagagattccattacctcatatctcaaaggagaagctggcaaatttgaagcaaatggaagccatacagaaatcactccagaagcaaagacaaaatcttactttccagaatcccaaaatgatgtaggaaaacagagtaccaaggaaactctgaaaccaaaaatacatggatctggtcatgttgaagaaccagcatcaccactagcagcatatcagaaatctctagaagaaaccagcaagcttataatagaagagactaaaccctgtgtgcctgtcagtatgaaaaagatgagtaggacttctccagcagatggcaagccaaggcttagcctccatgaagaagaggggtccagtgggtctgagcaaaagcagggagaaggttttaaggtgaaaacgaagaaagaaatccggcatgtggaaaagaagagccactcgtaacagcgaacggtcagtcaaggatcataagtttttactgccagtattgaga

SEQ ID NO: 107337 - DNA, 947 bp, Homo sapiens
  Payload ID: 1067
  Gene Symbol: ANK3
  Gene Name: ankyrin 3, node of Ranvier (ankyrin G)
  ENST ID: ENST00000503925
  CDS Start-End: 129-947
agctcctacctccttcctaggaagtgggggaaacctttacatttccgaaggcagatatttttagatgtgatgctctgtccaaagtgttaactaattgagttatcaggtttcttacttggccacagagaatggcagtggaagagggagagagcttcccagaacaatctgatgccaatgcaagttacttaagagcagctcgagctggacaccttgaaaaggccctcgactacataaaaaatggagttgacatcaacatttgcaatcagaatgggttgaacgctctccaccttgcttccaaagaaggccatgtagaggttgtttctgagctgctgcagagagaagccaatgtggatgcagctacaaagaaaggaaacacagcattgcacatcgcatctttggctgggcaagcagaggtggtaaaagtcttggttacaaatggagccaatgtcaatgcacaatctcagaatggtttcacgccattgtatatggcagcccaggaaaatcacctggaagttgtcaagtttcttcttgacaatggtgcaagccagagcctagccacagaggatggcttcacaccattggcagtggctttgcaacaaggtcacgaccaagtcgtttcgctcctgctagagaatgacaccaaaggaaaagtgcgtctcccagctcttcatatcgcggcccgaaaagacgacacgaaagccgccgccctgctgctgcagaatgacaacaatgcagatgtggaatcaaagagtggcttcactccgctccacatagctgctcactatggaaatatcaatgtagccacgttgctgttaaaccgagcggctgctgtggatttcaccgcaaggaatgacatcactcctttacatgttgcatcaaaaagaggaaatgcaaatatggtaaaactattgctcgatcgaggagctaaaatcgatgccaaaaccagg

SEQ ID NO: 107338 - DNA, 562 bp, Homo sapiens
  Payload ID: 1067
  Gene Symbol: ANK3
  Gene Name: ankyrin 3, node of Ranvier (ankyrin G)
  ENST ID: ENST00000511043
  CDS Start-End: 1-562
agattgagaaaacagatagacgacagagcttcgcatccttagctttacgtaagcgctacagctacttgactgagcctggaatgagtccacagagtccatgtgaacggacagatatcaggatggcaatagtagccgatcacctgggacttagttggacagaactggcaagggaactgaatttttcagtggatgaaatcaatcaaatacgtgtggaaaatccaaattctttaatttctcagagcttcatgttattaaaaaaatgggttaccagagacggaaaaaatgccacaactgatgccttaacttcggtcttgacaaaaattaatcgaatagatatagtgacactgctagaaggaccaatatttgattatggaaatatttcaggcaccagaagttttgcagatgagaacaatgttttccatgaccctgttgatgatggacctccagtcgtaactgcagaagacgcttccttagaagacagcaaactggaagactcagtgcctttaacagaaatgcctgaagcagtggatgtagatgagagccagttggagaatgtatgtct

SEQ ID NO: 107339 - DNA, 544 bp, Homo sapiens
  Payload ID: 1067
  Gene Symbol: ANK3
  Gene Name: ankyrin 3, node of Ranvier (ankyrin G)
  ENST ID: ENST00000513049
  CDS Start-End: 68-544
acaacatgtacacttttgcaatctcttggccagtgaagcttgcgtccagaaagagggtgaagatgcaatgaccggggacacagacaaatatcttgggccacaggaccttaaggaattgggtgatgattccctgcctgcagagggttacatgggctttagtctcggagcgcgttctgccagcctccgctccttcagttcggataggtcttacaccttgaacagaagctcctatgcacgggacagcatgatgattgaagaactccttgtgccatccaaagagcagcatctaacattcacaagggaatttgattcagattctcttagacattacagctgggctgcagacaccttagacaatgtcaatcttgtttcaagccccattcattctgggtttctggttagctttatggtggacgcgagagggggctccatgagaggaagccgtcatcacgggatgagaatcatcattcctccacgcaagtgtacggcccccactcgaatcacctgccgtttggtaaagagacataaactggccaacccaccc

SEQ ID NO: 107340 - DNA, 677 bp, Homo sapiens
  Payload ID: 1067
  Gene Symbol: ANK3
  Gene Name: ankyrin 3, node of Ranvier (ankyrin G)
  ENST ID: ENST00000460468
  CDS Start-End: 1-261
atgaatgttccagaaacgatgaatgaagttcttgatatgtctgatgatgaaggtaatagatgcacatggtacaaaattcccaaggtacaagagtttacggtgaaaagtgaagatgcaatgaccggggacacagacaaatatcttgggccacaggaccttaaggaattgggtgatgattccctgcctgcagagggttacatgggctttagtctcggagcgcgttctgccaggtacttcgttgttgctgtctttcatagttaatttaaaacaaccatgatttgtcataaatcaaaatcatgttcatttttcacattatcccaaaatgtgttctttggatgaagatgtgaatttagcgaaatgttctcgacgcaaatacacatgctctgctattttcttttgtggtttgcggttgttaatttcatgtgattgaacatgttaattgtgtgttctttttttttttcccactttgcagtcatgctgccagcacagtagcaaaagagctcactgacaaaactgggagaaccaatctgagtcacatatttcaaaattaagttttgttccatattgaaagaaagtattatttgctaataagtgagaaatatgtgtatagattgttcactattctctgttactgaaataataattcatgattaaaagagagcatttttgaaaaaaaa

SEQ ID NO: 107341 - DNA, 651 bp, Homo sapiens
  Payload ID: 1067
  Gene Symbol: ANK3
  Gene Name: ankyrin 3, node of Ranvier (ankyrin G)
  ENST ID: ENST00000514197
  CDS Start-End: 1-651
aactggcaagggaactgaatttttcagtggatgaaatcaatcaaatacgtgtggaaaatccaaattctttaatttctcagagcttcatgttattaaaaaaatgggttaccagagacggaaaaaatgccacaactgatgccttaacttcggtcttgacaaaaattaatcgaatagatatagtgacactgctagaaggaccaatatttgattatggaaatatttcaggcaccagaagttttgcagatgagaacaatgttttccatgaccctgttgatgtcagtccaaatgtactgtcttccataggttatccttcccttcaagtggaactggaaacccccacagggttgcactacacaccacctacccctttccagcaagatgattattttagtgatatctctagcatagaatctccccttagaacccctagtagactgagtgatgggctagtgccttcccaggggaacatagagcattccgcagatggacctccagtcgtaactgcagaagacgcttccttagaagacagcaaactggaagactcagtgcctttaacagaaatgcctgaagcagtggatgtagatgagagccagttggagaatgtatgtctgagttggcagaatgagacatcaagtggaaacctagagtcct

SEQ ID NO: 107342 - DNA, 724 bp, Homo sapiens
  Payload ID: 1067
  Gene Symbol: ANK3
  Gene Name: ankyrin 3, node of Ranvier (ankyrin G)
  ENST ID: ENST00000613207
  CDS Start-End: 1-724
aaacagtagctaccaaaggtctagattttgacccttggtctaataaccgaggggatgatgaagtttttgacagtaaatcacgggaagatgaaactaagccatttgggctggcggtagaagaccgctctccagcaacaacccctgatacaacgccagccagaacgccaactgatgaaagtaccccaactagtgagcctaaccccttcccatttcatgaaggaaaaatgtttgagatgactcgcagtggtgcaattgacatgagcaagagggattttgttgaagagaggctccaatttttccagattggtccacagagtccatgtgaacggacagatatcaggatggcaatagtagccgatcacctgggacttagttggacagaactggcaagggaactgaatttttcagtggatgaaatcaatcaaatacgtgtggaaaatccaaattctttaatttctcagagcttcatgttattaaaaaaatgggttaccagagacggaaaaaatgccacaactgatgccttaacttcggtcttgacaaaaattaatcgaatagatatagtgacactgctagaaggaccaatatttgattatggaaatatttcaggcaccagaagttttgcagatgagaacaatgttttccatgaccctgttgatggttatccttcccttcaagtggaactggaaacccccacagggttgcactacacaccacctaccccttt

SEQ ID NO: 107343 - DNA, 4930 bp, Homo sapiens
  Payload ID: 1067
  Gene Symbol: ANK3
  Gene Name: ankyrin 3, node of Ranvier (ankyrin G)
  ENST ID: ENST00000610321
  CDS Start-End: 1-4930
gtttctggttagctttatggtggacgcgagagggggctccatgagaggaagccgtcatcacgggatgagaatcatcattcctccacgcaagtgtacggcccccactcgaatcacctgccgtttggtaaagagacataaactggccaacccaccccccatggtggaaggagagggattagccagtaggctggtagaaatgggtcctgcaggggcacaatttttaggccctgtcatagtggaaatccctcactttgggtccatgagaggaaaagagagagaactcattgttcttcgaagtgaaaatggtgaaacttggaaggagcatcagtttgacagcaaaaatgaagatttaaccgagttacttaatggcatggatgaagaacttgatagcccagaagagttagggaaaaagcgtatctgcaggattatcacgaaagatttcccccagtattttgcagtggtttcccggattaagcaggaaagcaaccagattggtcctgaaggtggaattctgagcagcaccacagtgccccttgttcaagcatctttcccagagggtgccctaactaaaagaattcgagtgggcctccaggcccagcctgttccagatgaaattgtgaaaaagatccttggaaacaaagcaacttttagcccaattgtcactgtggaaccaagaagacggaaattccataaaccaatcacaatgaccattccggtgcccccgccctcaggagaaggtgtatccaatggatacaaaggggacactacacccaatctgcgtcttctctgtagcattacagggggcacttcgcctgctcagtgggaagacatcacaggaacaactcctttgacgtttataaaagattgtgtctcctttacaaccaatgtttcagccagattttggcttgcagactgccatcaagttttagaaactgtggggttagccacgcaactgtacagagaattgatatgtgttccatatatggccaagtttgttgtttttgccaaaatgaatgatcccgtagaatcttccttgcgatgtttctgcatgacagatgacaaagtggacaaaactttagagcaacaagagaattttgaggaagtcgcaagaagcaaagatattgaggttctggaaggaaaacctatttatgttgattgttatggaaatttggccccacttaccaaaggaggacagcaacttgtttttaacttttattctttcaaagaaaatagactgccattttccatcaagattagagacaccagccaagagccctgtggtcgtctgtcttttctgaaagaaccaaagacaacaaaaggactgcctcaaacagcggtttgcaacttaaatatcactctgccagcacataaaaagattgagaaaacagatagacgacagagcttcgcatccttagctttacgtaagcgctacagctacttgactgagcctggaatgaaaacagttgaacggagtacaggagcaacaagatccctccccaccacttactcatacaagccattcttttctacaagaccataccagtcctggacaacagctccgattacagtgcctgggccagccaagtcaggcttcacttccttatcaagttcttcctctaatacgccatcagcttctccgttaaaatcaatatggtctgtttcgacaccttctccaatcaaatccacattaggcgcgtcaactacatcttcagttaaatccattagtgacgtggcatctccaattagatcctttcggacaatgtcttcgccgataaaaactgtggtgtcacaatctccatacaatatccaagtttcctctggtaccctggctagagctccagcagtcacggaagctacgcccttaaaagggctggcatccaattctacgttttcctctcgaacctctccagtgactacagcagggtctcttttggagaggtcatcaattactatgacaccccctgcctcccccaaatcaaacattaatatgtattcctcaagtttgccatttaagtcaattattacatcagcagcaccgctaatatcttcacctttaaagtcagtggtgtctccagttaaatcagcagttgatgtcatttcatcagccaaaattacaatggcatcttctctctcatcacctgtgaagcagatgcctggacatgcagaggtagcattagtcaatggatctatttcccctctaaaatatccatcatcctcaactttaattaatggatgcaaagccactgccacgttacaggaaaaaatttcttctgctacaaactctgtgagctctgtggtcagtgcagccactgacacagttgagaaagtgttttctaccacgactgcaatgccattttccccactcaggtcatatgtttctgcagcaccatcagcttttcagtctctaagaactccttccgcaagtgcactctatacatcccttgggtcgtcaatatctgcaactacctcatctgtaacttcatcaattataacagtgccagtatactctgtagtcaatgttttgccagaaccagcattaaagaaacttccagactctaattcatttacaaaatcagcagcagccttgctgtcacccattaaaacattgactacggagacacatcctcagcctcacttcagtcgaacttcatctccagttaagtcatctttgttccttgcaccctctgcccttaagttgtctacaccatcttctttatcttccagtcaggagatactaaaagatgtagctgaaatgaaagaggacctaatgcggatgaccgcaatactacagacagatgtgcctgaggagaagccattccaacctgaactcccaaaggaagggagaatagatgatgaagaacctttcaaaattgtagagaaagtaaaggaagacttagtgaaagttagtgaaatccttaaaaaggatgtatgtgtagataataaaggatcacccaaatcaccaaagagtgacaaaggacactctcctgaagatgactggatagaatttagttcggaagaaatccgggaagccagacaacaagctgctgcgagccagtctccatctctgccagagagagtgcaagtaaaagcaaaagccgcctccgaaaaggattataacttgaccaaagttattgattacctaacaaatgatattgggagtagttcactgacaaacttaaaatacaagtttgaggatgcaaagaaggatggtgaggagagacagaaaagagttttaaaaccagcaattgctttgcaggaacacaaactcaaaatgcctccagcctccatgaggacttccacctctgagaaagaattgtgtaaaatggctgattccttttttggaacagatactattttagagtctcctgatgacttttctcaacacgaccaagataaaagtcccttgtctgacagtggctttgaaacaagaagtgaaaagacaccttcagccccacaaagcgctgaaagcactggtcctaaaccactttttcatgaagttcccatccctcctgtcattacagaaacaagaactgaagtggttcatgttatcaggagctatgatccctcagctggggatgttccccagacccaaccagaggagcctgtgtcacctaaaccttcacctacttttatggaattggaaccaaagcccaccacctctagtattaaagaaaaggttaaagcatttcaaatgaaagccagtagtgaagaagatgaccacaatcgggttttaagcaaaggcatgcgtgttaaagaagagactcacataaccacaaccaccagaatggtttatcattctccaccaggcggtgaaggtgcatctgaaagaattgaagaaaccatgtcagtccatgacatcatgaaggcctttcagtccgggcgggatccttccaaagaactggcaggtctgtttgaacataagtcggcagtgtctccagatgttcacaagtctgctgctgaaacctcagcccagcatgcagagaaggacaaccaaatgaaacccaaactggagcgtataatagaagtccacatcgaaaaaggtccacagagtccatgtgaacggacagatatcaggatggcaatagtagccgatcacctgggacttagttggacagaactggcaagggaactgaatttttcagtggatgaaatcaatcaaatacgtgtggaaaatccaaattctttaatttctcagagcttcatgttattaaaaaaatgggttaccagagacggaaaaaatgccacaactgatgccttaacttcggtcttgacaaaaattaatcgaatagatatagtgacactgctagaaggaccaatatttgattatggaaatatttcaggcaccagaagttttgcagatgagaacaatgttttccatgaccctgttgatggttggcagaatgagacatcaagtggaaacctagagtcctgcgctcaagctcgaagagtaactggtgggttactagatcgactggatgacagccctgaccagtgtagagattccattacctcatatctcaaaggagaagctggcaaatttgaagcaaatggaagccatacagaaatcactccagaagcaaagacaaaatcttactttccagaatcccaaaatgatgtaggaaaacagagtaccaaggaaactctgaaaccaaaaatacatggatctggtcatgttgaagaaccagcatcaccactagcagcatatcagaaatctctagaagaaaccagcaagcttataatagaagagactaaaccctgtgtgcctgtcagtatgaaaaagatgagtaggacttctccagcagatggcaagccaaggcttagcctccatgaagaagaggggtccagtgggtctgagcaaaagcagggagaaggttttaaggtgaaaacgaagaaagaaatccggcatgtggaaaagaagagccactcgtaa

SEQ ID NO: 107344 - DNA, 3166 bp, Homo sapiens
  Payload ID: 1067
  Gene Symbol: ANK3
  Gene Name: ankyrin 3, node of Ranvier (ankyrin G)
  ENST ID: ENST00000621739
  CDS Start-End: 1-2606
tagacctcccagatgaaagtgtatctgtgcaaaaagattttatggtattaaaaaccaaagatgagcatgcccaaagcaacgaaattgttgtaaatgattctggctctgataatgtgaaaaaacagagaactgaaatgtcaagtaaagcaatgcctgactctttttctgagcagcaggctaaagacttggcatgtcatataacctcagatttagcaactaggggaccatgggacaaaaaggtctttagaacatgggagagttcgggagccactaacaataagtctcagaaagaaaaactttcgcatgtacttgttcatgatgtaagagagaatcacattggtcaccctgagagtaaaagtgttgatcaaaagaatgaatttatgtctgtgactgagagagaacgcaaattgttaacaaacggctctctctcagaaattaaagaaatgactgtaaaatctccctccaaaaaagtcttatatagggaatatgttgtgaaagaaggggaccatccaggcggattgcttgatcagccttccaggaggagcgagagctcagcagtgtcacacattcccgtcagagttgctgatgagaggagaatgctgtcttctaatattcccgatggtttttgtgaacagtcggcatttccaaaacatgaactatcacaaaaattgtcccagtcaagcatgagtaaagagacagttgagacacagcactttaattctatagaagatgaaaaagttacctattcagaaatcagcaaagtttccaaacaccagagttatgtaggtttatgcccacctctcgaggaaaccgaaacctcccccaccaaatctcctgattctttagagtttagcccaggaaaggaatctccctctagtgatgtattcgaccacagtcccattgatggattggaaaaactcgcaccactagcccagacagagggagggaaagagataaaaactttacccgtttatgtcagttttgtacaagtggggaagcaatatgaaaaggagatacaacaaggaggtgtaaaaaaaatcataagtcaggaatgtaagacagtacaagaaaccagggggaccttttatacaactagacagcaaaagcaacctccttctccccaaggtagtccagaagatgatactctagagcaagtatcctttctagacagctctgggaaaagccctttaaccccagaaacacccagttcagaggaagtgagttatgaatttacatctaagacacctgactcgctcatagcttatataccaggcaaacccagcccaattcccgaggtttctgaggagtcagaggaggaggaacaggccaagtcaacctcccttaagcagactacagtggaggaaacagcagttgagcgtgaaatgcctaatgacgtgagcaaagactctaaccaaagacccaaaaataacagagttgcctatattgaatttccccctcctccaccactggatgcggaccagattgagtcagataagaagcatcattatctcccagaaaaagaggttgacatgattgaagtcaatctgcaagatgagcatgacaagtaccagctggctgaacctgtcattagagtgcagccaccttcaccagttcctcccggggcagacgtcagtgattcaagcgatgacgaatctatttatcagccagtcccagttaaaaaatataccttcaaattaaaggaagtggacgatgaacaaaaagaaaaacccaaagcttctgctgaaaaggcttccaaccagaaagaactggaaagtaatggatctggaaaagataatgaatttggccttggccttgattcacctcagaatgaaattgcccagaatgggaacaacgaccagtccatcacagagtgttccattgccaccacagcagagttttctcatgacacggatgccacagagatcgactctctggatggctatgacctgcaagatgaagatgatggcttgacagagagtgattctaaactcccaattcaagccatggaaattaagaaagatatctggaacacagagggcattctgaagccagctgaccgctcttttagccaaagtaaacttgaagttatcgaggaggagggaaaggtgggaccagatgaggacaagccaccttctaaaagttcttcatctgaaaagactcctgataagactgatcagaagtcaggggcccagttcttcacactggaaggcagacatcctgacagatcagtgtttcctgatacttacttcagttacaaagtagatgaagaatttgccactccttttaaaacagtagctaccaaaggtctagattttgacccttggtctaataaccgaggggatgatgaagtttttgacagtaaatcacgggaagatgaaactaagccatttgggctggcggtagaagaccgctctccagcaacaacccctgatacaacgccagccagaacgccaactgatgaaagtaccccaactagtgagcctaaccccttcccatttcatgaaggaaaaatgtttgagatgactcgcagtggtgcaattgacatgagcaagagggattttgttgaagagaggctccaatttttccagattgtggtgagaccttaaagcttgtggaccgcctctctgaagaagaaaaaaagatgcagtccgagttgtccgatgaggaagaaagtacctcaagaaacacgtcgttgtccgagacttcccggggtggccagccttcggttacaacgaagtctgctagagataagaaaacagaggcagcacctttaaaatcaaagagtgaaaaggccggcagtgagaaaaggagcagtccacagagtccatgtgaacggacagatatcaggatggcaatagtagccgatcacctgggacttagttggacagaactggcaagggaactgaatttttcagtggatgaaatcaatcaaatacgtgtggaaaatccaaattctttaatttctcagagcttcatgttattaaaaaaatgggttaccagagacggaaaaaatgccacaactgatgccttaacttcggtcttgacaaaaattaatcgaatagatatagtgacactgctagaaggaccaatatttgattatggaaatatttcaggcaccagaagttttgcagatgagaacaatgttttccatgaccctgttgatggt

SEQ ID NO: 107345 - DNA, 3459 bp, Homo sapiens
  Payload ID: 1067
  Gene Symbol: ANK3
  Gene Name: ankyrin 3, node of Ranvier (ankyrin G)
  ENST ID: ENST00000618374
  CDS Start-End: 309-2744
agctttaaaaggatgtctgcgaagtggtcaaaaggatcttaacctcaattaagtggggttttttaaaaagatttttttgggggcctgaaattttgaaaatcttcgaactctgagtggggaaagatgtataattcctcaattgcctacgaggatatcaagatgctgagaggaattcagcggtggtgaagagagtggatacaaaccagggattggtttccttgagctgttttggaggttgattctaaatcactgcttaaggaattcctggaaacatcaggaaaacatttgatcatccaagcctagtggaaatggctttaccgcagagtgaagatgcaatgaccggggacacagacaaatatcttgggccacaggaccttaaggaattgggtgatgattccctgcctgcagagggttacatgggctttagtctcggagcgcgttctgccagcctccgctccttcagttcggataggtcttacaccttgaacagaagctcctatgcacgggacagcatgatgattgaagaactccttgtgccatccaaagagcagcatctaacattcacaagggaatttgattcagattctcttagacattacagctgggctgcagacaccttagacaatgtcaatcttgtttcaagccccattcattctgggtttctggttagctttatggtggacgcgagagggggctccatgagaggaagccgtcatcacgggatgagaatcatcattcctccacgcaagtgtacggcccccactcgaatcacctgccgtttggtaaagagacataaactggccaacccaccccccatggtggaaggagagggattagccagtaggctggtagaaatgggtcctgcaggggcacaatttttaggccctgtcatagtggaaatccctcactttgggtccatgagaggaaaagagagagaactcattgttcttcgaagtgaaaatggtgaaacttggaaggagcatcagtttgacagcaaaaatgaagatttaaccgagttacttaatggcatggatgaagaacttgatagcccagaagagttagggaaaaagcgtatctgcaggattatcacgaaagatttcccccagtattttgcagtggtttcccggattaagcaggaaagcaaccagattggtcctgaaggtggaattctgagcagcaccacagtgccccttgttcaagcatctttcccagagggtgccctaactaaaagaattcgagtgggcctccaggcccagcctgttccagatgaaattgtgaaaaagatccttggaaacaaagcaacttttagcccaattgtcactgtggaaccaagaagacggaaattccataaaccaatcacaatgaccattccggtgcccccgccctcaggagaaggtgtatccaatggatacaaaggggacactacacccaatctgcgtcttctctgtagcattacagggggcacttcgcctgctcagtgggaagacatcacaggaacaactcctttgacgtttataaaagattgtgtctcctttacaaccaatgtttcagccagattttggcttgcagactgccatcaagttttagaaactgtggggttagccacgcaactgtacagagaattgatatgtgttccatatatggccaagtttgttgtttttgccaaaatgaatgatcccgtagaatcttccttgcgatgtttctgcatgacagatgacaaagtggacaaaactttagagcaacaagagaattttgaggaagtcgcaagaagcaaagatattgaggttctggaaggaaaacctatttatgttgattgttatggaaatttggccccacttaccaaaggaggacagcaacttgtttttaacttttattctttcaaagaaaatagactgccattttccatcaagattagagacaccagccaagagccctgtggtcgtctgtcttttctgaaagaaccaaagacaacaaaaggactgcctcaaacagcggtttgcaacttaaatatcactctgccagcacataaaaagattgagaaaacagatagacgacagagcttcgcatccttagctttacgtaagcgctacagctacttgactgagcctggaatgagtccacagagtccatgtgaacggacagatatcaggatggcaatagtagccgatcacctgggacttagttggacagaactggcaagggaactgaatttttcagtggatgaaatcaatcaaatacgtgtggaaaatccaaattctttaatttctcagagcttcatgttattaaaaaaatgggttaccagagacggaaaaaatgccacaactgatgccttaacttcggtcttgacaaaaattaatcgaatagatatagtgacactgctagaaggaccaatatttgattatggaaatatttcaggcaccagaagttttgcagatgagaacaatgttttccatgaccctgttgatggttatccttcccttcaagtggaactggaaacccccacagggttgcactacacaccacctacccctttccagcaagatgattattttagtgatatctctagcatagaatctccccttagaacccctagtagactgagtgatgggctagtgccttcccaggggaacatagagcattccgcagatggacctccagtcgtaactgcagaagacgcttccttagaagacagcaaactggaagactcagtgcctttaacagaaatgcctgaagcagtgatgtagatgagagccagttggagaatgtatgtctgagttggcagaatgagacatcaagtggaaacctagagtcctgcgctcaagctcgaagagtaactggtgggttactagatcgactggatgacagccctgaccagtgtagagattccattacctcatatctcaaaggagaagctggcaaatttgaagcaaatggaagccatacagaaatcactccagaagcaaagacaaaatcttactttccagaatcccaaaatgatgtaggaaaacagagtaccaaggaaactctgaaaccaaaaatacatggatctggtcatgttgaagaaccagcatcaccactagcagcatatcagaaatctctagaagaaaccagcaagcttataatagaagagactaaaccctgtgtgcctgtcagtatgaaaaagatgagtaggacttctccagcagatggcaagccaaggcttagcctccatgaagaagaggggtccagtgggtctgagcaaaagcagggagaaggttttaaggtgaaaacgaagaaagaaatccggcatgtggaaaagaagagccactcgtaacagcgaacggtcagtcaaggatcataagtttttactgccagtattgagaaattcgtggaagaaatgtcagcaggaagtaaaaattcaccgagaagtgtgtgtgtgttcgctgcttccacacattaatggcatgattttttttatgc

SEQ ID NO: 107346 - DNA, 965 bp, Homo sapiens
  Payload ID: 1067
  Gene Symbol: ANK3
  Gene Name: ankyrin 3, node of Ranvier (ankyrin G)
  ENST ID: ENST00000610901
  CDS Start-End: 1-965
tgggaccagatgaggacaagccaccttctaaaagttcttcatctgaaaagactcctgataagactgatcagaagtcaggggcccagttcttcacactggaaggcagacatcctgacagatcagtgtttcctgatacttacttcagttacaaagtagatgaagaatttgccactccttttaaaacagtagctaccaaaggtctagattttgacccttggtctaataaccgaggggatgatgaagtttttgacagtaaatcacgggaagatgaaactaagccatttgggctggcggtagaagaccgctctccagcaacaacccctgatacaacgccagccagaacgccaactgatgaaagtaccccaactagtgagcctaaccccttcccatttcatgaaggaaaaatgtttgagatgactcgcagtggtgcaattgacatgagcaagagggattttgttgaagagaggctccaatttttccagattggtccacagagtccatgtgaacggacagatatcaggatggcaatagtagccgatcacctgggacttagttggacagaactggcaagggaactgaatttttcagtggatgaaatcaatcaaatacgtgtggaaaatccaaattctttaatttctcagagcttcatgttattaaaaaaatgggttaccagagacggaaaaaatgccacaactgatgccttaacttcggtcttgacaaaaattaatcgaatagatatagtgacactgctagaaggaccaatatttgattatggaaatatttcaggcaccagaagttttgcagatgagaacaatgttttccatgaccctgttgatggttggcagaatgagacatcaagtggaaacctagagtcctgcgctcaagctcgaagagtaactggtgggttactagatcgactggatgacagccctgaccagtgtagagattccattacctcatatctc

SEQ ID NO: 107347 - DNA, 1466 bp, Homo sapiens
  Payload ID: 1067
  Gene Symbol: ANK3
  Gene Name: ankyrin 3, node of Ranvier (ankyrin G)
  ENST ID: ENST00000459732
  CDS Start-End: 1-290
aactggcaagggaactgaatttttcagtggatgaaatcaatcaaatacgtgtggaaaatccaaattctttaatttctcagagcttcatgttattaaaaaaatgggttaccagagacggaaaaaatgccacaactgatgccttaacttcggtcttgacaaaaattaatcgaatagatatagtgacactgctagaaggaccaatatttgattatggaaatatttcaggcaccagaagttttgcagatgagaacaatgttttccatgaccctgttgatggtaatcgaatttagtgttcatatttatttaatcatttgataaaatttgaaagtgcagtcagacaaggcagtcacttaaaagcaactaaactgtgatttgcttgacttagtttctcattttctctgccagagtctgcaaataaacactctgatatcagagcaaacttggtaaatacctctgtttatatacaatataaatatacaatataaatcatgacgtatgaacgcctaaggtatctgaaagagttggtatttctaatatttcataaaagttaaatatctagagaatgcattgcttttgtcacttttaatttttatattaaccctcctaaactagttacctcttttattcgtatataggtaaaacaaacgatgagccatttttatcaaataagcaaggtattgagtaaagtgtaagcatatagtatacaaattgtaaggtaaaatggcaatttactgtgtggcaccaggtatttaaatgtgcactgaaaaaatttaatgtatcattcaagtatgtgctttagttatttagcgttcgttgttattttaacttcatgaatatgctgccatttattctttggaaaaactgcttgatctattgtatatcaaaggcagcataatttctaattcagtcggcatacatgttactaacaacaattcctctttcacattagcttaatttatataatgatcttgtcattttttcctcattatgtaaattgtgctttcttcactgaaatattaagaaaaacataataaatatcttcctatgtttttcaaaatagtcctgtcttaggctcacaaatgaaaatttattcctacaatgaatttttgttctgtttttgagacgaagtctcgctctgtcgcctaagctggagtgcaatggcacgatctcggctcactgcaacctctgcctcctgggttcaagccattctcctgtctcagcctcctgagtagctgggattacaggcatgcaccaccgtgcccagcaaattttttgtatttttagtaaagatgggggtttcaccacgttggccaggctggtctcgaactcttgacctcaagtgatccacccacctctgcctcccaaagtgctggaattacaggcatgagccaccccacccagcctctataatgaattttgagtagaaaatttgatgatggtgtggaggcaggaataagaactaagga

SEQ ID NO: 107348 - DNA, 545 bp, Homo sapiens
  Payload ID: 1067
  Gene Symbol: ANK3
  Gene Name: ankyrin 3, node of Ranvier (ankyrin G)
  ENST ID: ENST00000617800
  CDS Start-End: 1-526
atcaccactagcagcatatcagaaatctctagaagaaaccagcaagcttataatagaagagactaaaccctgtgtgcctgtcagtatgaaaaagatgagtaggacttctccagcagatggcaagccaaggcttagcctccatgaagaagaggggtccagtgggtctgagcaaaaggtcaaaagtccgggtgcggctcctacacggatgactgcctgctgttataaggacttgaaagacagtgagagtgattcaagctcagaggaagagcggagagtcactacccgagttattcgccggcgtttgattataaagggagaggaagcaaaaaacattcctggtgaatctgtcacagaagaacaatttactgatgaagaaggcaacctcatcaccagaaaaatcactcggaaagtattaagacgaattgttatcccacaagagagaaaacgtgatgatgtgcagggagaaggttttaaggtgaaaacgaagaaagaaatccggcatgtggaaaagaagagccactcgtaacagcgaacggtcagtcaag

SEQ ID NO: 107349 - DNA, 681 bp, Homo sapiens
  Payload ID: 1067
  Gene Symbol: ANK3
  Gene Name: ankyrin 3, node of Ranvier (ankyrin G)
  ENST ID: ENST00000612776
  CDS Start-End: 1-536
gttggcagaatgagacatcaagtggaaacctagagtcctgcgctcaagctcgaagagtaactggtgggttactagatcgactggatgacagccctgaccagtgtagagattccattacctcatatctcaaaggagaagctggcaaatttgaagcaaatggaagccatacagaaatcactccagaagcaaagacaaaatcttactttccagaatcccaaaatgatgtaggaaaacagagtaccaaggaaactctgaaaccaaaaatacatggatctggtcatgttgaagaaccagcatcaccactagcagcatatcagaaatctctagaagaaaccagcaagcttataatagaagagactaaaccctgtgtgcctgtcagtatgaaaaagatgagtaggacttctccagcagatggcaagccaaggcttagcctccatgaagaagaggggtccagtgggtctgagcaaaagggagaaggttttaaggtgaaaacgaagaaagaaatccggcatgtggaaaagaagagccactcgtaacagcgaacggtcagtcaaggatcataagtttttactgccagtattgagaaattcgtggaagaaatgtcagcaggaagtaaaaattcaccgagaagtgtgtgtgtgttcgctgcttccacacattaatggcatgattttttttatg

SEQ ID NO: 107350 - DNA, 604 bp, Homo sapiens
  Payload ID: 1067
  Gene Symbol: ANK3
  Gene Name: ankyrin 3, node of Ranvier (ankyrin G)
  ENST ID: ENST00000618080
  CDS Start-End: 1-604
gtgaagatgcaatgaccggggacacagacaaatatcttgggccacaggaccttaaggaattgggtgatgattccctgcctgcagagggttacatgggctttagtctcggagcgcgttctgccagtcccaagataagcctccgctccttcagttcggataggtcttacaccttgaacagaagctcctatgcacgggacagcatgatgattgaagaactccttgtgccatccaaagagcagcatctaacattcacaagggaatttgattcagattctcttagacattacagctgggctgcagacaccttagacaatgtcaatcttgtttcaagccccattcattctggctattcttctccacttcctcagtatgattcaaggtttctggttagctttatggtggacgcgagagggggctccatgagaggaagccgtcatcacgggatgagaatcatcattcctccacgcaagtgtacggcccccactcgaatcacctgccgtttggtaaagagacataaactggccaacccaccccccatggtggaaggagagggattagccagtaggctggtagaaatgggtcctgcaggggcacaatttttagg

SEQ ID NO: 107351 - DNA, 2939 bp, Homo sapiens
  Payload ID: 1067
  Gene Symbol: ANK3
  Gene Name: ankyrin 3, node of Ranvier (ankyrin G)
  ENST ID: ENST00000616444
  CDS Start-End: 1-2920
ccctgtcatagtggaaatccctcactttgggtccatgagaggaaaagagagagaactcattgttcttcgaagtgaaaatggtgaaacttggaaggagcatcagtttgacagcaaaaatgaagatttaaccgagttacttaatggcatggatgaagaacttgatagcccagaagagttagggaaaaagcgtatctgcaggattatcacgaaagatttcccccagtattttgcagtggtttcccggattaagcaggaaagcaaccagattggtcctgaaggtggaattctgagcagcaccacagtgccccttgttcaagcatctttcccagagggtgccctaactaaaagaattcgagtgggcctccaggcccagcctgttccagatgaaattgtgaaaaagatccttggaaacaaagcaacttttagcccaattgtcactgtggaaccaagaagacggaaattccataaaccaatcacaatgaccattccggtgcccccgccctcaggagaaggtgtatccaatggatacaaaggggacactacacccaatctgcgtcttctctgtagcattacagggggcacttcgcctgctcagtgggaagacatcacaggaacaactcctttgacgtttataaaagattgtgtctcctttacaaccaatgtttcagccagattttggcttgcagactgccatcaagttttagaaactgtggggttagccacgcaactgtacagagaattgatatgtgttccatatatggccaagtttgttgtttttgccaaaatgaatgatcccgtagaatcttccttgcgatgtttctgcatgacagatgacaaagtggacaaaactttagagcaacaagagaattttgaggaagtcgcaagaagcaaagatattgaggttctggaaggaaaacctatttatgttgattgttatggaaatttggccccacttaccaaaggaggacagcaacttgtttttaacttttattctttcaaagaaaatagactgccattttccatcaagattagagacaccagccaagagccctgtggtcgtctgtcttttctgaaagaaccaaagacaacaaaaggactgcctcaaacagcggtttgcaacttaaatatcactctgccagcacataaaaaggagacagagtcagatcaagatgatgagattgagaaaacagatagacgacagagcttcgcatccttagctttacgtccacagagtccatgtgaacggacagatatcaggatggcaatagtagccgatcacctgggacttagttggacagaactggcaagggaactgaatttttcagtggatgaaatcaatcaaatacgtgtggaaaatccaaattctttaatttctcagagcttcatgttattaaaaaaatgggttaccagagacggaaaaaatgccacaactgatgccttaacttcggtcttgacaaaaattaatcgaatagatatagtgacactgctagaaggaccaatatttgattatggaaatatttcaggcaccagaagttttgcagatgagaacaatgttttccatgaccctgttgatggttatccttcccttcaagtggaactggaaacccccacagggttgcactacacaccacctacccctttccagcaagatgattattttagtgatatctctagcatagaatctccccttagaacccctagtagactgagtgatgggctagtgccttcccaggggaacatagagcattccgcagatggacctccagtcgtaactgcagaagacgcttccttagaagacagcaaactggaagactcagtgcctttaacagaaatgcctgaagcagtggatgtagatgagagccagttggagaatgtatgtctgagtgagtatcctcaataccttggaaatttggctgggtccccaaaagatgttaaaccagcagagcctagaaaactaggagtaagctctgagcagcaggagaaaggaaaatctggtcctgatgaggagatgatggaagagaaactcaaatctctatttgaggacattcaacttgaagaaggagtagagtctgaggagatgacagaagaaaaagtacaggctattcttaagcgtgttcagcaagcagaactggaaatgtcttcaattacaggttggcagaatgagacatcaagtggaaacctagagtcctgcgctcaagctcgaagagtaactggtgggttactagatcgactggatgacagccctgaccagtgtagagattccattacctcatatctcaaaggagaagctggcaaatttgaagcaaatggaagccatacagaaatcactccagaagcaaagacaaaatcttactttccagaatcccaaaatgatgtaggaaaacagagtaccaaggaaactctgaaaccaaaaatacatggatctggtcatgttgaagaaccagcatcaccactagcagcatatcagaaatctctagaagaaaccagcaagcttataatagaagagactaaaccctgtgtgcctgtcagtatgaaaaagatgagtaggacttctccagcagatggcaagccaaggcttagcctccatgaagaagaggggtccagtgggtctgagcaaaaggacttgaaagacagtgagagtgattcaagctcagaggaagagcggagagtcactacccgagttattcgccggcgtttgattataaagggagaggaagcaaaaaacattcctggtgaatctgtcacagaagaacaatttactgatgaagaaggcaacctcatcaccagaaaaatcactcggaaagtattaagacgaattgttatcccacaagagagaaaacgtgatgatgtgcagggagaaggttttaaggtgaaaacgaagaaagaaatccggcatgtggaaaagaagagccactcgtaacagcgaacggtcagtcaag

SEQ ID NO: 107352 - DNA, 5071 bp, Homo sapiens
  Payload ID: 1067
  Gene Symbol: ANK3
  Gene Name: ankyrin 3, node of Ranvier (ankyrin G)
  ENST ID: ENST00000622427
  CDS Start-End: 383-1735
tctctctctttctctctctctcaccatttccaggctcaaatcactgtggaggaacaagcaacaaagtcttgtcaggaccttatctcagggtaacgattagttaaaaatgaaaggctaaaatattgattttctttagaagaataattgactgtttgatatagagaacacccagtttcttcctgaggaaagctgaacagggctacattagcagcccgcgtctctctgacagcagcaggggctgggtttaagcagcggctgctttgcctggggagcacccgtaaatggactttggtctcaatgctttgactctttgccgtggttttggatgttggaataccggcggtgatctgtcttttataaactcacctgatttaaaggaaagatgagtgaagaaccaaaggagaaaaatgcaaaacctgctcataggaaaaggaaaggaaaaaagtctgatgccaatgcaagttacttaagagcagctcgagctggacaccttgaaaaggccctcgactacataaaaaatggagttgacatcaacatttgcaatcagaatgggttgaacgctctccaccttgcttccaaagaaggccatgtagaggttgtttctgagctgctgcagagagaagccaatgtggatgcagctacaaagaaaggaaacacagcattgcacatcgcatctttggctgggcaagcagaggtggtaaaagtcttggttacaaatggagccaatgtcaatgcacaatctcagaatggtttcacgccattgtatatggcagcccaggaaaatcacctggaagttgtcaagtttcttcttgacaatggtgcaagccagagcctagccacagaggatggcttcacaccattggcagtggctttgcaacaaggtcacgaccaagtcgtttcgctcctgctagagaatgacaccaaaggaaaagtgcgtctcccagctcttcatatcgcggcccgaaaagacgacacgaaagccgccgccctgctgctgcagaatgacaacaatgcagatgtggaatcaaagagtggcttcactccgctccacatagctgctcactatggaaatatcaatgtagccacgttgctgttaaaccgagcggctgctgtggatttcaccgcaaggaatgacatcactcctttacatgttgcatcaaaaagaggaaatgcaaatatggtaaaactattgctcgatcgaggagctaaaatcgatgccaaaaccagggatggtctgacaccactgcactgtggagcaaggagtggccacgagcaggtggtagaaatgttgcttgatcgagctgcccccattctttcaaaaaccaagaatggattatctccattgcacatggccacacaaggggatcatttaaactgcgtccagcttctcctccagcataatgtacccgtggatgatgtcaccaatgactacctgactgccctacacgtggctgcccactgtggccattacaaagttgccaaggttctcttggataagaaagctaaccccaatgccaaagccctgaatggctttacccctcttcatattgcctgcaagaagaatcgaattaaagtaatggaactccttctgaaacacggtgcatccatccaagctgtaaccgagtcgggccttaccccaatccatgttgctgccttcatggggcatgtaaatattgtatcacaactaatgcatcatggagcctcaccaaacaccaccaatgtgagctgcagctaatttactttggctcatgttccccagagaggagaaacagcactgcacatggcagctcgctccggccaagctgaagttgtgcggtatctggtacaagacggagctcaggtagaagctaaagctaaggatgaccaaacaccactccacatttcagcccgactggggaaagcagacatagtacaacagctgttgcagcaaggggcatctccaaatgcagccacaacttctgggtacaccccacttcacctttccgcccgagaggggcatgaggatgtggccgcgttccttttggatcatggagcgtctttatctataacaacaaagaaaggatttactcctcttcatgtggcagcaaaatatggaaagcttgaagtcgccaatctcctgctacagaaaagtgcatctccagatgctgctgggaagagcgggctaacaccactgcatgtagctgcacattacgataatcagaaagtggcccttctgcttttggaccaaggagcctcacctcacgcagccgcaaagaatggttatacgccactgcacatcgctgccaaaaagaaccagatggacatagcgacaactctgctggaatatggtgctgatgccaacgcagttacccggcaaggaattgcttccgtccatctcgcagctcaggaagggcacgtggacatggtgtcgctgctcctcggtagaaatgcgaatgtgaacctgagcaataagagcggcctgaccccactccatttggctgctcaagaagatcgagtgaatgtggcagaagtcctcgtaaaccaaggggctcatgtggacgcccagacaaagatgggatacacaccactgcatgtgggctgccactatggaaatatcaagattgttaatttcctgctccagcattctgcaaaagttaatgccaaaacaaagaatgggtatacgccattacatcaagcagcacagcaggggcatacgcatataataaatgtcttacttcagaacaacgcctcccccaatgaactcactgtgaatgggaatactgcccttggcattgcccggcgcctcggctacatctcagtagtggacaccctgaagatagtgaccgaagagaccatgaccacaactactgtcacagagaagcacaaaatgaatgttccagaaacgatgaatgaagttcttgatatgtctgatgatgaaggtgaagatgcaatgaccggggacacagacaaatatcttgggccacaggaccttaaggaattgggtgatgattccctgcctgcagagggttacatgggctttagtctcggagcgcgttctgccagtcccaagataagttcggataggtcttacaccttgaacagaagctcctatgcacgggacagcatgatgattgaagaactccttgtgccatccaaagagcagcatctaacattcacaagggaatttgattcagattctcttagacattacagctgggctgcagacaccttagacaatgtcaatcttgtttcaagccccattcattctggctattcttctccacttcctcagtatgattcaaggtttctggttagctttatggtggacgcgagagggggctccatgagaggaagccgtcatcacgggatgagaatcatcattcctccacgcaagtgtacggcccccactcgaatcacctgccgtttggtaaagagacataaactggccaacccaccccccatggtggaaggagagggattagccagtaggctggtagaaatgggtcctgcaggggcacaatttttaggccctgtcatagtggaaatccctcactttgggtccatgagaggaaaagagagagaactcattgttcttcgaagtgaaaatggtgaaacttggaaggagcatcagtttgacagcaaaaatgaagatttaaccgagttacttaatggcatggatgaagaacttgatagcccagaagagttagggaaaaagcgtatctgcaggattatcacgaaagatttcccccagtattttgcagtggtttcccggattaagcaggaaagcaaccagattggtcctgaaggtggaattctgagcagcaccacagtgccccttgttcaagcatctttcccagagggtgccctaactaaaagaattcgagtgggcctccaggcccagcctgttccagatgaaattgtgaaaaagatccttggaaacaaagcaacttttagcccaattgtcactgtggaaccaagaagacggaaattccataaaccaatcacaatgaccattccggtgcccccgccctcaggagaaggtgtatccaatggatacaaaggggacactacacccaatctgcgtcttctctgtagcattacagggggcacttcgcctgctcagtgggaagacatcacaggaacaactcctttgacgtttataaaagattgtgtctcctttacaaccaatgtttcagccagattttggcttgcagactgccatcaagttttagaaactgtggggttagccacgcaactgtacagagaattgatatgtgttccatatatggccaagtttgttgtttttgccaaaatgaatgatcccgtagaatcttccttgcgatgtttctgcatgacagatgacaaagtggacaaaactttagagcaacaagagaattttgaggaagtcgcaagaagcaaagatattgaggtaccttgttcacaaaaacaagttcatttcattacgtactccagatatgaggttttattttgtggtcttaatagcactcactataaaataccaagtgcattattgattttacttttactttaaaaaatttgatatagattaatactcaaatttttttatcttttttaatttaatttaatttaatttttttttttttgagacggagccttgctctgttgccgaggctggagtgcagtggcgcggtctcagcttactgcaacctccgcctcctgggttcaaacaattctcctgcctcagcctcccaagtagctcggattacaggcgcctgccaccatgcccagctaattttctgtattttcagtagagatggggtttcaccatgttagccaggctggtctcaaactcctgacctcgtgatccacccaccttggcctcccaaagcgctggcattacatgagtcaccacgcccggccaatactcaaattattttaagtgtctctggggctgtcttagctggttaaaacatagcactaatgaatttaagttatggtctccattttcctgtggccacttgagttacctacttttcagaatcactgtttatacacattactatgattttcctttttcaaacccagtgagcatgtaagtatctaacagtgc

SEQ ID NO: 107353 - DNA, 493 bp, Homo sapiens
  Payload ID: 1067
  Gene Symbol: ANK3
  Gene Name: ankyrin 3, node of Ranvier (ankyrin G)
  ENST ID: ENST00000486349
  CDS Start-End: 176-367
tgctgagaggaattcagcggtggtgaagagagtggatacaaaccagggattggtttccttgagctgttttggaggttgattctaaatcactgcttaaggaattcctggaaacatcaggaaaacatttgatcatccaagcctagtggaaatggctttaccgcagagtgaagatgcaatgaccggggacacagacaaatatcttgggccacaggaccttaaggaattgggtgatgattccctgcctgcagagggttacatgggctttagtctcggagcgcgttctgccagtcatgctgccagcacagtagcaaaagagctcactgacaaaactgggagaaccaatctgagtcacatatttcaaaattaagttttgttccatattgaaagaaagtattatttgctaataagtgagaaatatgtgtatagattgttcactattctctgttactgaaataataattcatgattaaaagagagcatttttgaaaaaaaa

SEQ ID NO: 107354 - DNA, 4391 bp, Homo sapiens
  Payload ID: 1068
  Gene Symbol: ANKAR
  Gene Name: ankyrin and armadillo repeat containing
  Uniprot ID: Q7Z5J8
  ENST ID: ENST00000313581
  CDS Start-End: 65-4369
gataatcttttccttcttattcattgcagaagcttcaaaaaggacacactagatttaattagaaatgttaagattgcccaaaaaaggattacctagatttgagcaagttcaggatgaagacacctacctggaaaatttagcaatacaaagaaatgcatctgctttttttgaaaaatatgatcggagtgaaatacaagagttactaactactgcactagttagctggttgtctgccaaagaggatgtgcgctctcaagtagacctcccatgtggaattatgagtcaaatgaataacgtaggcttctccactgcaatcctactgactcccgtggaccctactgccctcttagactatagagaggtccatcaaatgataagagagttggctattggaatttattgcctaaatcaaatcccttccatcagtttagaagctaattatgatcagagttcttcttgtcaattacctccagcttattatgataccagaattgggcaaattctgatcaatattgactacatgctgaaagcactatggcatggaatatatatgcccaaagaaaaacgagctagattctctgaattgtggcgtgccatcatggacattgatcctgatggaaaacctcaaacaaataaagacattttttcagagtttagttcagcaggtttgactgatattacaaaggatccagactttaatgaaatctatgatgaagacgtgaatgaagatccaacatatgatcccaacagccctgaagaaacagctgtatttatgaaatatgctgaaaatattatgctaaagttaacattcagtaccacacaaattcaacagtatgaaaatgtctttatatttgaaacaggctattggcttactaatgctataaaatataatcaggattatcttgatatctgtacctaccagagactacagcaaagattatatcttcaaaaaaagattattcaaaaacactttgagaagaaaaaagatatcagaagagggataggatacctaaagttaatatgttttctgattccatttctactgagtttaaagaagaaaatgaaagttccatatttaagtagtctgcttcagcctttttcagatgacaaggtcaagacagagcgagaattgcctccatttatttatggaagagattttaaatgccagaattttcactacaaagagaatcaatattttcatgttcatggaggaattgaatttgatatcagcaccccttcaattgagaatgccttggaagattttcagaaaaatttagaaaaaatacgagattgtgctgctaatacatttatagaagattcaggatataaagaatattactcaataccagtcatggaatttcatggaaaaagctactatgtgatctattttgaactagaaactttctatcagcaactatataagacacagtggtggggagccataaatgaaatagtgaacaatctgagactgaaaagacttccactgacagatgctcaattacatgaacaatttaagaaaaagcttggtttcaaaagagctatgaaatgcaagagtattccatttggtatgaagtccgctgttgaaagagggttgtctgcagttttccacacatttagccgtaaaacctcaagctcaacaatcaatgtttcagatgaagcaggttatactatttttcatcatgctgccctgcacaacagagtttctattatatgtcaactgtgcaatgctaacttcaaggtcaaccagaggcgctttgttacgttcagccaaggtccaacacctctacaccttgctgcacaggcttgctcattagaaacaacagtttgtctactgtgttccaaagctgattacacgctttctgaaaaaagaggctggatgccgattcactttgccgctttctatgacaacgtttgcatcattattgctctctgtaggaaggatcctagtttgctagaagctgaggcaacagctgagaatcagtgcactccactgttacttgctgccacttcaggagcactggacactattcaatacctgttttctatcggtgctaactggagaaaaacagatattaaaggaaataatataatccatttatcagtgttaacctttcatacagaggttctcaaatatataataaaattaaatattcctgaactcccagtgtggaaaactttggtagaaatgttacagtgtgaaagctataaacgaaggatgatggccgtcatgtccttggaagtaatttgcttagcaaatgatcaatactggagatgtattttggatgcaggcaccattcctgccttaatcaatctattaaaaagttccaaaataaaactgcagtgcaaaactgttgggttattgagtaatatctcaacccacaaaagtgcagtgcatgctttggtagaagcgggaggcattccatctctaatcaacctactggtttgtgatgagcctgaagtacactctcgctgtgctgtcattctatatgatattgctcaatgtgaaaacaaggatgttattgccaaatataatggaatcccaagcctgataaatctattgaacttaaacatagaaaatgtgctagtaaatgtaatgaactgtatacgggtattgtgtataggaaatgaaaacaatcaaagagctgtgagagaacataaaggcctcccatatcttatcagatttctgagttctgattcagatgtgttgaaggctgtatcttctgctgcaattgctgaggttgggcgtgacaataaggaaattcaggatgctatagctatggagggagcgattcctcctctggtggctctttttaaagggaaacaaattagtgtccaaatgaaaggtgcaatggctgtggaatcactggcaagtcacaacgctcttatacagaaagcatttctggaaaaatcgttaactaaatatcttttaaaactcctaaaggcatttcaaatagatgttaaggaacaaggagctgttgcactttgggccttggcaggacaaacactaaaacaacaaaaatatatggcagaacaaattggatacagctttataataaatatgcttttgtcaccatcagctaaaatgcagtatgttggaggtgaagctgtcatagctctaagtaaggacagcaggatgcatcaaaatcaaatatgtgaagggaatggaattgcaccattggttcgcttactaagaattagtacgattgctgaaggcacacttctcagtgtcatcagagcagtgggatccatttgtattggtgtagcccatacaagcaatcctgtcagtcaacaattggttgtagatgaaaatgcctttccagtacttatccaactactaagaaatcacccttctcctaacattaaggttgaagtggcattttccttggcatgcattgtcctagggaatgatgtgttacagaaagacttacatgaaaatgaaggatttgaatatgctgatgtcctttatcttcttcactcaacagaaaaggatatttgcttaagagcaggctatgcattaacactttttgccttcaataatcgctttcaacaatacttaatattggaaagtggaataatgaccatatctatttttgaacgttttcttgaatcaacagttgaaactgagaaggcaatggcagcatttcagattgttgtactggctaaagtcattagagatatggaccatattactttgtctgcaagaggtgttactattttagttgatagtctgtattcagttcagacttctactattgtcttgacagggaatttaatagcaagcctggctcattctagagctggtatcccagaagcatttaccacattaggaacaatccaacggctctgctatcatttgtactcgggaatagaagaggttcgtgcagcttgttcctctgctcttggctacttaacatacaatgcaaatgctttccgcatcctattaaaagaatgcaggaataaacctaatcagttcattcgtataaaaaataatatcagcagagatgcaagtattaacccagcatttttaaaggaatttcaaatgcaacaaacactggtgggacttccttccttaagtctggagaagaatggaggaccatccataattcctatctttaaaagagggaaggagcaccgaagaaaattaaaacctaaaattcaaccaaaagattctttgactttattacctcctgtaactaacttcatgggactcttcaaagcaacaaaaaagaccaaggattcccataatattttttctttttcatctacaattacatcagatatcacaaatgtatcaagaccaagaatagtgtgtttgaaccaacttgggaaacatgtccagaaagccaacccagagcctgcagaaggctaataaaacattttagaatgaaagg

SEQ ID NO: 107355 - DNA, 3980 bp, Homo sapiens
  Payload ID: 1068
  Gene Symbol: ANKAR
  Gene Name: ankyrin and armadillo repeat containing
  ENST ID: ENST00000433782
  CDS Start-End: 302-3331
ctcacaagaagctgagcagatgctggtgccatgcttgtacagcctgcagaattaagcttcaaaaaggacacactagatttaattagaaatgttaagattgcccaaaaaaggattacctagatttgagcaagttcaggatgaagacacctacctggaaaatttagcaatacaaagaaatgcatctgctttttttgaaaaatatgatcggagtgaaatacaagagttactaactactgcactagttagctggttgtctgccaaagaggatgtgcgctctcaagtagacctcccatgtggaattatgagtcaaatgaataacgtaggcttctccactgcaatcctactgactcccgtggaccctactgccctcttagactatagagaggtccatcaaatgataagagagttggctattggaatttattgcctaaatcaaatcccttccatcagtttagaagctaattatgatcagagttcttcttgtcaattacctccagcttattatgataccagaattgggcaaattctgatcaatattgactacatgctgaaagcactatggcatggaatatatatgcccaaagaaaaacgagctagattctctgaattgtggcgtgccatcatggacattgatcctgatggaaaacctcaaacaaataaagacattttttcagagtttagttcagcaggtttgactgatattacaaaggatccagactttaatgaaatctatgatgaagacgtgaatgaagatccaacatatgatcccaacagccctgaagaaacagctgtatttatgaaatatgctgaaaatattatgctaaagttaacattcagtaccacacaaattcaacagtatgaaaatgtctttatatttgaaacaggctattggcttactaatgctataaaatataatcaggattatcttgatatctgtacctaccagagactacagcaaagattatatcttcaaaaaaagattattcaaaaacactttgagaagaaaaaagatatcagaagagggataggatacctaaagttaatatgttttctgattccatttctactgagtttaaagaagaaaatgaaagttccatatttaagtagtctgcttcagcctttttcagatgacaaggtcaagacagagcgagaattgcctccatttatttatggaagagattttaaatgccagaattttcactacaaagagaatcaatattttcatgttcatggaggaattgaatttgatatcagcaccccttcaattgagaatgccttggaagattttcagaaaaatttagaaaaaatacgagattgtgctgctaatacatttatagaagattcaggatataaagaatattactcaataccagtcatggaatttcatggaaaaagctactatgtgatctattttgaactagaaactttctatcagcaactatataagacacagtggtggggagccataaatgaaatagtgaacaatctgagactgaaaagacttccactgacagatgctcaattacatgaacaatttaagaaaaagcttggtttcaaaagagctatgaaatgcaagagtattccatttggtatgaagtccgctgttgaaagagggttgtctgcagttttccacacatttagccgtaaaacctcaagctcaacaatcaatgtttcagatgaagcaggttatactatttttcatcatgctgccctgcacaacagagtttctattatatgtcaactgtgcaatgctaacttcaaggtcaaccagaggcgctttgttacgttcagccaaggtccaacacctctacaccttgctgcacaggcttgctcattagaaacaacagtttgtctactgtgttccaaagctgattacacgctttctgaaaaaagaggctggatgccgattcactttgccgctttctatgacaacgtttgcatcattattgctctctgtaggaaggatcctagtttgctagaagctgaggcaacagctgagaatcagtgcactccactgttacttgctgccacttcaggagcactggacactattcaatacctgttttctatcggtgctaactggagaaaaacagatattaaaggaaataatataatccatttatcagtgttaacctttcatacagaggttctcaaatatataataaaattaaatattcctgaactcccagtgtggaaaactttggtagaaatgttacagtgtgaaagctataaacgaaggatgatggccgtcatgtccttggaagtaatttgcttagcaaatgatcaatactggagatgtattttggatgcaggcaccattcctgccttaatcaatctattaaaaagttccaaaataaaactgcagtgcaaaactgttgggttattgagtaatatctcaacccacaaaagtgcagtgcatgctttggtagaagcgggaggcattccatctctaatcaacctactggtttgtgatgagcctgaagtacactctcgctgtgctgtcattctatatgatattgctcaatgtgaaaacaaggatgttattgccaaatataatggaatcccaagcctgataaatctattgaacttaaacatagaaaatgtgctagtaaatgtaatgaactgtatacgggtattgtgtataggaaatgaaaacaatcaaagagctgtgagagaacataaaggcctcccatatcttatcagatttctgagttctgattcagatgtgttgaaggctgtatcttctgctgcaattgctgaggttgggcgtgacaataaggaaattcaggatgctatagctatggagggagcgattcctcctctggtggctctttttaaagggaaacaaattagtgtccaaatgaaaggtgcaatggctgtggaatcactggcaagtcacaacgctcttatacagaaagcatttctggaaaaatcgttaactaaatatcttttaaaactcctaaaggcatttcaaatagatgttaaggaacaaggagctgttgcactttgggccttggcaggacaaacactaaaacaacaaaaatatatggcagaacaaattggatacagctttataataaatatgcttttgtcaccatcagctaaaatgcagtatgttggaggtgaagctgtcatagctctaagtaaggacagcaggatgcatcaaaatcaaatatgtgaagggaatggaattgcaccattggttcgcttactaagaattagtacgattgctgaaggcacacttctcagtgtcatcagagcagtgggatccatttgtattggatatttgcttaagagcaggctatgcattaacactttttgccttcaataatcgctttcaacaatacttaatattggaaagtggaataatgaccatatctatttttgaacgttttcttgaatcaacagttgaaactgagaaggcaatggcagcatttcagattgttgtactggctaaagtcattagagatatggaccatattactttgtctgcaagaggtgttactattttagttgatagtctgtattcagttcagacttctactattgtcttgacagggaatttaatagcaagcctggctcattctagagctggtatcccagaagcatttaccacattaggaacaatccaacggctctgctatcatttgtactcgggaatagaagagtctggagaagaatggaggaccatccataattcctatctttaaaagagggaaggagcaccgaagaaaattaaaacctaaaattcaaccaaaagattctttgactttattacctcctgtaactaacttcatgggactcttcaaagcaacaaaaaagaccaaggattcccataatattttttctttttcatctacaattacatcagatatcacaaatgtatcaagaccaagaatagtgtgtttgaaccaacttgggaaacatgtccagaaagccaacccagagcctgcagaaggctaataaaacattttagaatg

SEQ ID NO: 107356 - DNA, 3734 bp, Homo sapiens
  Payload ID: 1068
  Gene Symbol: ANKAR
  Gene Name: ankyrin and armadillo repeat containing
  Uniprot ID: Q7Z5J8
  ENST ID: ENST00000441800
  CDS Start-End: 649-3054
gtattccaactcgggactgcctcaacgcccggcgctgtctcctctgctactctgtttcggtgttttagcagaggcagatagtgagggcggcacagtgcccacggcatgccgctggactaagcgctaagcgggcttgggatgatgcgcacgcggggggtctgagccagccaaggggccgggcgccgcctgggggcgctgcggctgctgcgggacgcaccaggcctagtcgcccgcaggctccgcccgaggagcagcccagccaccccagggcccggaggaccaaccgcttcgacccgcgcccgggcggcggcagtgttggccggcgaggcgaggagggccgggccgccacggtggggcgaaaagccctgaaagttcctctcagttccttccggtgcgcctcccgctcgcccttgcggaggccctgagggcggattcaaggccccgcgagaagccatctgaggcggcgacgactgttctcagccccacgggaacgccgcggacgcagcgtccctctcccggacaagaaaacagccattctagagtttgactgatattacaaaggatccagactttaatgaaatctatgatgaagacgtgaatgaagatccaacatatgatcccaacagccctgaagaaacagctgtatttatgaaatatgctgaaaatattatgctaaagttaacattcagtaccacacaaattcaacagtatgaaaatgtctttatatttgaaacaggctattggcttactaatgctataaaatataatcaggattatcttgatatctgtacctaccagagactacagcaaagattatatcttcaaaaaaagattattcaaaaacactttgagaagaaaaaagatatcagaagagggataggatacctaaagttaatatgttttctgattccatttctactgagtttaaagaagaaaatgaaagttccatatttaagtagtctgcttcagcctttttcagatgacaaggtcaagacagagcgagaattgcctccatttatttatggaagagattttaaatgccagaattttcactacaaagagaatcaatattttcatgttcatggaggaattgaatttgatatcagcaccccttcaattgagaatgccttggaagattttcagaaaaatttagaaaaaatacgagattgtgctgctaatacatttatagaagattcaggatataaagaatattactcaataccagtcatggaatttcatggaaaaagctactatgtgatctattttgaactagaaactttctatcagcaactatataagacacagtggtggggagccataaatgaaatagtgaacaatctgagactgaaaagacttccactgacagatgctcaattacatgaacaatttaagaaaaagcttggtttcaaaagagctatgaaatgcaagagtattccatttggtatgaagtccgctgttgaaagagggttgtctgcagttttccacacatttagccgtaaaacctcaagctcaacaatcaatgtttcagatgaagcaggttatactatttttcatcatgctgccctgcacaacagagtttctattatatgtcaactgtgcaatgctaacttcaaggtcaaccagaggcgctttgttacgttcagccaaggtccaacacctctacaccttgctgcacaggcttgctcattagaaacaacagtttgtctactgtgttccaaagctgattacacgctttctgaaaaaagaggctggatgccgattcactttgccgctttctatgacaacgtttgcatcattattgctctctgtaggaaggatcctagtttgctagaagctgaggcaacagctgagaatcagtgcactccactgttacttgctgccacttcaggagcactggacactattcaatacctgttttctatcggtgctaactggagaaaaacagatattaaaggaaataatataatccatttatcagtgttaacctttcatacagaggttctcaaatatataataaaattaaatattcctgaactcccagtgtggaaaactttggtagaaatgttacagtgtgaaagctataaacgaaggatgatggccgtcatgtccttggaagtaatttgcttagcaaatgatcaatactggagatgtattttggatgcaggcaccattcctgccttaatcaatctattaaaaagttccaaaataaaactgcagtgcaaaactgttgggttattgagtaatatctcaacccacaaaagtgcagtgcatgctttggtagaagcgggaggcattccatctctaatcaacctactggtttgtgatgagcctgaagtacactctcgctgtgctgtcattctatatgatattgctcaatgtgaaaacaaggatgttattgccaaatataatggaatcccaagcctgataaatctattgaacttaaacatagaaaatgtgctagtaaatgtaatgaactgtatacgggtattgtgtataggaaatgaaaacaatcaaagagctgtgagagaacataaaggcctcccatatcttatcagatttctgagttctgattcaggtttatttaacttgttcttaaattcatttgaagatgtgttgaaggctgtatcttctgctgcaattgctgaggttgggcgtgacaataaggaaattcaggatgctatagctatggagggagcgattcctcctctggtggctctttttaaagggaaacaaattagtgtccaaatgaaaggtgcaatggctgtggaatcactggcaagtcacaacgctcttatacagaaagcatttctggaaaaatcgttaactaaatatcttttaaaactcctaaaggcatttcaaatagatgttaaggaacaaggagctgttgcactttgggccttggcaggacaaacactaaaacaacaaaaatatatggcagaacaaattggatacagctttataataaatatgcttttgtcaccatcagctaaaatgcagtatgttggatatttgcttaagagcaggctatgcattaacactttttgccttcaataatcgctttcaacaatacttaatattggaaagtggaataatgaccatatctatttttgaacgttttcttgaatcaacagttgaaactgagaaggcaatggcagcatttcagattgttgtactggctaaagtcattagagatatggaccatattactttgtctgcaagaggtgttactattttagttgatagtctgtattcagttcagacttctactattgtcttgacagggaatttaatagcaagcctggctcattctagagctggtatcccagaagcatttaccacattaggaacaatccaacggctctgctatcatttgtactcgggaatagaagaggttcgtgcagcttgttcctctgctcttggctacttaacatacaatgcaaatgctttccgcatcctattaaaagaatgcaggaataaacctaatcagttcattcgtataaaaaataatatcagcagagatgcaagtattaacccagcatttttaaaggaatttcaaatgcaacaaacactggtgggacttccttccttaagtctggagaagaatggaggaccatccataattcctatctttaaaagagttttcctaggacttcagctgagaccatgaaacatagaagtggagaaaagaaggaatgcattactgaaggaaaatcaataaatacggaagctgggaa

SEQ ID NO: 107357 - DNA, 4410 bp, Homo sapiens
  Payload ID: 1068
  Gene Symbol: ANKAR
  Gene Name: ankyrin and armadillo repeat containing
  Uniprot ID: Q7Z5J8
  ENST ID: ENST00000520309
  CDS Start-End: 89-4393
ctcacaagaagctgagcagatgctggtgccatgcttgtacagcctgcagaattaagcttcaaaaaggacacactagatttaattagaaatgttaagattgcccaaaaaaggattacctagatttgagcaagttcaggatgaagacacctacctggaaaatttagcaatacaaagaaatgcatctgctttttttgaaaaatatgatcggagtgaaatacaagagttactaactactgcactagttagctggttgtctgccaaagaggatgtgcgctctcaagtagacctcccatgtggaattatgagtcaaatgaataacgtaggcttctccactgcaatcctactgactcccgtggaccctactgccctcttagactatagagaggtccatcaaatgataagagagttggctattggaatttattgcctaaatcaaatcccttccatcagtttagaagctaattatgatcagagttcttcttgtcaattacctccagcttattatgataccagaattgggcaaattctgatcaatattgactacatgctgaaagcactatggcatggaatatatatgcccaaagaaaaacgagctagattctctgaattgtggcgtgccatcatggacattgatcctgatggaaaacctcaaacaaataaagacattttttcagagtttagttcagcaggtttgactgatattacaaaggatccagactttaatgaaatctatgatgaagacgtgaatgaagatccaacatatgatcccaacagccctgaagaaacagctgtatttatgaaatatgctgaaaatattatgctaaagttaacattcagtaccacacaaattcaacagtatgaaaatgtctttatatttgaaacaggctattggcttactaatgctataaaatataatcaggattatcttgatatctgtacctaccagagactacagcaaagattatatcttcaaaaaaagattattcaaaaacactttgagaagaaaaaagatatcagaagagggataggatacctaaagttaatatgttttctgattccatttctactgagtttaaagaagaaaatgaaagttccatatttaagtagtctgcttcagcctttttcagatgacaaggtcaagacagagcgagaattgcctccatttatttatggaagagattttaaatgccagaattttcactacaaagagaatcaatattttcatgttcatggaggaattgaatttgatatcagcaccccttcaattgagaatgccttggaagattttcagaaaaatttagaaaaaatacgagattgtgctgctaatacatttatagaagattcaggatataaagaatattactcaataccagtcatggaatttcatggaaaaagctactatgtgatctattttgaactagaaactttctatcagcaactatataagacacagtggtggggagccataaatgaaatagtgaacaatctgagactgaaaagacttccactgacagatgctcaattacatgaacaatttaagaaaaagcttggtttcaaaagagctatgaaatgcaagagtattccatttggtatgaagtccgctgttgaaagagggttgtctgcagttttccacacatttagccgtaaaacctcaagctcaacaatcaatgtttcagatgaagcaggttatactatttttcatcatgctgccctgcacaacagagtttctattatatgtcaactgtgcaatgctaacttcaaggtcaaccagaggcgctttgttacgttcagccaaggtccaacacctctacaccttgctgcacaggcttgctcattagaaacaacagtttgtctactgtgttccaaagctgattacacgctttctgaaaaaagaggctggatgccgattcactttgccgctttctatgacaacgtttgcatcattattgctctctgtaggaaggatcctagtttgctagaagctgaggcaacagctgagaatcagtgcactccactgttacttgctgccacttcaggagcactggacactattcaatacctgttttctatcggtgctaactggagaaaaacagatattaaaggaaataatataatccatttatcagtgttaacctttcatacagaggttctcaaatatataataaaattaaatattcctgaactcccagtgtggaaaactttggtagaaatgttacagtgtgaaagctataaacgaaggatgatggccgtcatgtccttggaagtaatttgcttagcaaatgatcaatactggagatgtattttggatgcaggcaccattcctgccttaatcaatctattaaaaagttccaaaataaaactgcagtgcaaaactgttgggttattgagtaatatctcaacccacaaaagtgcagtgcatgctttggtagaagcgggaggcattccatctctaatcaacctactggtttgtgatgagcctgaagtacactctcgctgtgctgtcattctatatgatattgctcaatgtgaaaacaaggatgttattgccaaatataatggaatcccaagcctgataaatctattgaacttaaacatagaaaatgtgctagtaaatgtaatgaactgtatacgggtattgtgtataggaaatgaaaacaatcaaagagctgtgagagaacataaaggcctcccatatcttatcagatttctgagttctgattcagatgtgttgaaggctgtatcttctgctgcaattgctgaggttgggcgtgacaataaggaaattcaggatgctatagctatggagggagcgattcctcctctggtggctctttttaaagggaaacaaattagtgtccaaatgaaaggtgcaatggctgtggaatcactggcaagtcacaacgctcttatacagaaagcatttctggaaaaatcgttaactaaatatcttttaaaactcctaaaggcatttcaaatagatgttaaggaacaaggagctgttgcactttgggccttggcaggacaaacactaaaacaacaaaaatatatggcagaacaaattggatacagctttataataaatatgcttttgtcaccatcagctaaaatgcagtatgttggaggtgaagctgtcatagctctaagtaaggacagcaggatgcatcaaaatcaaatatgtgaagggaatggaattgcaccattggttcgcttactaagaattagtacgattgctgaaggcacacttctcagtgtcatcagagcagtgggatccatttgtattggtgtagcccatacaagcaatcctgtcagtcaacaattggttgtagatgaaaatgcctttccagtacttatccaactactaagaaatcacccttctcctaacattaaggttgaagtggcattttccttggcatgcattgtcctagggaatgatgtgttacagaaagacttacatgaaaatgaaggatttgaatatgctgatgtcctttatcttcttcactcaacagaaaaggatatttgcttaagagcaggctatgcattaacactttttgccttcaataatcgctttcaacaatacttaatattggaaagtggaataatgaccatatctatttttgaacgttttcttgaatcaacagttgaaactgagaaggcaatggcagcatttcagattgttgtactggctaaagtcattagagatatggaccatattactttgtctgcaagaggtgttactattttagttgatagtctgtattcagttcagacttctactattgtcttgacagggaatttaatagcaagcctggctcattctagagctggtatcccagaagcatttaccacattaggaacaatccaacggctctgctatcatttgtactcgggaatagaagaggttcgtgcagcttgttcctctgctcttggctacttaacatacaatgcaaatgctttccgcatcctattaaaagaatgcaggaataaacctaatcagttcattcgtataaaaaataatatcagcagagatgcaagtattaacccagcatttttaaaggaatttcaaatgcaacaaacactggtgggacttccttccttaagtctggagaagaatggaggaccatccataattcctatctttaaaagagggaaggagcaccgaagaaaattaaaacctaaaattcaaccaaaagattctttgactttattacctcctgtaactaacttcatgggactcttcaaagcaacaaaaaagaccaaggattcccataatattttttctttttcatctacaattacatcagatatcacaaatgtatcaagaccaagaatagtgtgtttgaaccaacttgggaaacatgtccagaaagccaacccagagcctgcagaaggctaataaaacattttagaatg

SEQ ID NO: 107358 - DNA, 1965 bp, Homo sapiens
  Payload ID: 1069
  Gene Symbol: ABTB1
  Gene Name: ankyrin repeat and BTB (POZ) domain containing 1
  Uniprot ID: Q969K4
  ENST ID: ENST00000232744
  CDS Start-End: 87-1523
cggggcggggctgagcgtgtttacatccgccgggtgcgcggcttcgccgcccgaggtcgttcggctcgggtaccatcctccgcgccatggacaccagcgacctgttcgccagctgcaggaagggggatgtgggccgagtgcggtacctgctggagcagcgagacgtggaggtgaatgtgcgggacaagtgggacagcacccccttgtactatgcctgcttgtgtgggcacgaggagctggtactctaccttctggccaatggagcccgctgcgaggccaacaccttcgatggtgagcgctgcctctatggggcactgagtgaccccatccgccgggctctacgcgattacaagcaggtcacggcttcctgcaggaggcgggattactatgacgacttcttgcagcggcttctagagcagggcatccacagtgacgtggtctttgtagtacacgggaagccattccgggtgcatcgctgcgtcctgggtgcacgtagtgcctactttgccaacatgctggacaccaaatggaagggcaagagtgtcgtggttctcaggcacccactgatcaaccccgtggcctttggggccctgctgcagtacctgtacacaggccgcctggacattggcgtagagcatgtgagtgactgtgagcgcctggccaagcaatgccagctgtgggacctgctcagcgacctggaggccaagtgcgagaaggtgtctgagtttgtggcgtctaagccaggcacgtgtgtgaaggtgctgaccatcgagcccccacctgcagacccccgcctccgggaggacatggcgctgctggccgattgtgccctgccccccgagctccgaggtgatctttgggagctgcccttcccttgtcctgacggcttcaacagctgccctgacatctgcttccgagtggctggctgcagcttcctctgccacaaggcctttttctgtggccgcagtgactacttccgagccctgctggatgaccacttccgagagagcgaggagccagcgacctcagggggccccccagccgtcaccctgcatggcatctcacccgacgtcttcactcacgtgctctactacatgtacagcgaccacactgagctgtcccccgaggcagcctatgatgtgctgagcgtcgccgacatgtacctgctgccaggcctgaagaggctgtgcggccgcagcctggctcagatgctagacgaggacactgtggtgggtgtgtggcgcgtggccaagctcttccgcctggcgcggcttgaggaccagtgcactgagtacatggccaaggtcattgagaagctggtggagcgggaggacttcgtggaggcggtgaaggaggaggcagcggctgtggcagcccggcaggagacggactctatcccgctggtggacgacatccgcttccacgtggccagcacggtgcagacctacagcgccatagaggaggcgcagcagcgtctgcgggcactcgaggacctgctcgtgtccatcggtctggactgttgagcccctggctgggcagccccaggggccaggagctctcttggagacaagcatgtgtatgcgtttgtgtgcagctcttcttcctgctccctgcacattgagggcttcatggggggtgcgaggggctcagtggggcttctcttccctccatgagcctggagaccccaggggaggatccatttgggatgagccccctccccccaatgcacaagccagcccccaagaccctgggggtggacaccactcagggaaacctggggtgggggtgggctttggtcttagcactttccttctccagatcccccctacccaccccagtcccaaatccagtcctctggcccttgcctagccctgaattgcttctctaagctggtgttcccatgcacagggccattcaggaagggctgggggagtgtgtgtggcaataaagcttgaaggcaccgtg

SEQ ID NO: 107359 - DNA, 1961 bp, Homo sapiens
  Payload ID: 1069
  Gene Symbol: ABTB1
  Gene Name: ankyrin repeat and BTB (POZ) domain containing 1
  Uniprot ID: Q969K4
  ENST ID: ENST00000453791
  CDS Start-End: 506-1516
gtttacatccgccgggtgcgcggcttcgccgcccgaggtcgttcggctcgggtaccatcctccgcgccatggacaccagcgacctgttcgccagctgcaggaagggggatgtgggccgagtgcgaccatgaacccgtcctgacccaggctctgacctccttcctgcccaggtacctgctggagcagcgagacgtggaggtactatgcctgcttgtgtgggcacgaggagctggtactctaccttctggccaatggagcccgctgcgaggccaacaccttcgatggtgagcgctgcctctatggggcactgagtgaccccatccgccgggctctacgcgattacaagcaggtcacggcttcctgcaggaggcgggattactatgacgacttcttgcagcggcttctagagcagggcatccacagtgacgtggtctttgtagtacacgggaagccattccgggtgcatcgctgcgtcctgggtgcacgtagtgcctactttgccaacatgctggacaccaaatggaagggcaagagtgtcgtggttctcaggcacccactgatcaaccccgtggcctttggggccctgctgcagtacctgtacacaggccgcctggacattggcgtagagcatgtgagtgactgtgagcgcctggccaagcaatgccagctgtgggacctgctcagcgacctggaggccaagtgcgagaaggtgtctgagtttgtggcgtctaagccaggcacgtgtgtgaaggtgctgaccatcgagcccccacctgcagacccccgcctccgggaggacatggcgctgctggccgattgtgccctgccccccgagctccgaggtgatctttgggagctgcccttcccttgtcctgacggcttcaacagctgccctgacatctgcttccgagtggctggctgcagcttcctctgccacaaggcctttttctgtggccgcagtgactacttccgagccctgctggatgaccacttccgagagagcgaggagccagcgacctcagggggccccccagccgtcaccctgcatggcatctcacccgacgtcttcactcacgtgctctactacatgtacagcgaccacactgagctgtcccccgaggcagcctatgatgtgctgagcgtcgccgacatgtacctgctgccaggcctgaagaggctgtgcggccgcagcctggctcagatgctagacgaggacactgtggtgggtgtgtggcgcgtggccaagctcttccgcctggcgcggcttgaggaccagtgcactgagtacatggccaaggtcattgagaagctggtggagcgggaggacttcgtggaggcggtgaaggaggaggcagcggctgtggcagcccggcaggagacggactctatcccgctggtggacgacatccgcttccacgtggccagcacggtgcagacctacagcgccatagaggaggcgcagcagcgtctgcgggcactcgaggacctgctcgtgtccatcggtctggactgttgagcccctggctgggcagccccaggggccaggagctctcttggagacaagcatgtgtatgcgtttgtgtgcagctcttcttcctgctccctgcacattgagggcttcatggggggtgcgaggggctcagtggggcttctcttccctccatgagcctggagaccccaggggaggatccatttgggatgagccccctccccccaatgcacaagccagcccccaagaccctgggggtggacaccactcagggaaacctggggtgggggtgggctttggtcttagcactttccttctccagatcccccctacccaccccagtcccaaatccagtcctctggcccttgcctagccctgaattgcttctctaagctggtgttcccatgcacagggccattcaggaagggctgggggagtgtgtgtggcaataaagcttgaaggcaccgtggga

SEQ ID NO: 107360 - DNA, 2065 bp, Homo sapiens
  Payload ID: 1069
  Gene Symbol: ABTB1
  Gene Name: ankyrin repeat and BTB (POZ) domain containing 1
  Uniprot ID: Q969K4
  ENST ID: ENST00000468137
  CDS Start-End: 617-1627
aaaggtccagcctcggcactggctctggcttctgtccctgtagcccatcgtcccccagcactgatagcacacagtgtctgcctgttcgaccccacctccacatccttgcctgcactttgccttgagtgcctctcctgctctggtctgcctgtcacctgccctcacctgggggaggcttccccataccaaaagggatgttttctctccgttcctttccacgggccttctttctcagaccatgaacccgtcctgacccaggctctgacctccttcctgcccaggtacctgctggagcagcgagacgtggaggtactatgcctgcttgtgtgggcacgaggagctggtactctaccttctggccaatggagcccgctgcgaggccaacaccttcgatggtgagcgctgcctctatggggcactgagtgaccccatccgccgggctctacgcgattacaagcaggtcacggcttcctgcaggaggcgggattactatgacgacttcttgcagcggcttctagagcagggcatccacagtgacgtggtctttgtagtacacgggaagccattccgggtgcatcgctgcgtcctgggtgcacgtagtgcctactttgccaacatgctggacaccaaatggaagggcaagagtgtcgtggttctcaggcacccactgatcaaccccgtggcctttggggccctgctgcagtacctgtacacaggccgcctggacattggcgtagagcatgtgagtgactgtgagcgcctggccaagcaatgccagctgtgggacctgctcagcgacctggaggccaagtgcgagaaggtgtctgagtttgtggcgtctaagccaggcacgtgtgtgaaggtgctgaccatcgagcccccacctgcagacccccgcctccgggaggacatggcgctgctggccgattgtgccctgccccccgagctccgaggtgatctttgggagctgcccttcccttgtcctgacggcttcaacagctgccctgacatctgcttccgagtggctggctgcagcttcctctgccacaaggcctttttctgtggccgcagtgactacttccgagccctgctggatgaccacttccgagagagcgaggagccagcgacctcagggggccccccagccgtcaccctgcatggcatctcacccgacgtcttcactcacgtgctctactacatgtacagcgaccacactgagctgtcccccgaggcagcctatgatgtgctgagcgtcgccgacatgtacctgctgccaggcctgaagaggctgtgcggccgcagcctggctcagatgctagacgaggacactgtggtgggtgtgtggcgcgtggccaagctcttccgcctggcgcggcttgaggaccagtgcactgagtacatggccaaggtcattgagaagctggtggagcgggaggacttcgtggaggcggtgaaggaggaggcagcggctgtggcagcccggcaggagacggactctatcccgctggtggacgacatccgcttccacgtggccagcacggtgcagacctacagcgccatagaggaggcgcagcagcgtctgcgggcactcgaggacctgctcgtgtccatcggtctggactgttgagcccctggctgggcagccccaggggccaggagctctcttggagacaagcatgtgtatgcgtttgtgtgcagctcttcttcctgctccctgcacattgagggcttcatggggggtgcgaggggctcagtggggcttctcttccctccatgagcctggagaccccaggggaggatccatttgggatgagccccctccccccaatgcacaagccagcccccaagaccctgggggtggacaccactcagggaaacctggggtgggggtgggctttggtcttagcactttccttctccagatcccccctacccaccccagtcccaaatccagtcctctggcccttgcctagccctgaattgcttctctaagctggtgttcccatgcacagggccattcaggaagggctgggggagtgtgtgtggcaataaagcttgaaggcac

SEQ ID NO: 107361 - DNA, 563 bp, Homo sapiens
  Payload ID: 1069
  Gene Symbol: ABTB1
  Gene Name: ankyrin repeat and BTB (POZ) domain containing 1
  ENST ID: ENST00000497162
  CDS Start-End: 1-425
agccaggcacgtgtgtgaaggtgctgaccatcgagcccccacctgcagacccccgcctccgggaggacatggcgctgctggccgattgtgccctgccccccgagctccgaggtgatctttgggagctgcccttcccttgtcctgacggcttcaacagctgccctgacatctgcttccgagtggctggctgcagcttcctctgccacaaggcctttttctgtggccgcagtgactacttccgagccctgctggatgaccacttccgagagagcgaggagccagcgacctcagggggccccccagccgtcaccctgcatggcatctcacccgacgtcttcactcacgtgctctactacatgtacagcgaccacactgagcccccgcaggtaggcatggttatctatacctcatggactgggaactagaggcacagggaggtgcagtgacttgcccagggccccacagctagaagtgtcagacccagctgtcccccgaggcagcctatgatgtgctgagcgtcgccgacatgtacctgctgccaggcctgaagaggctgtgcggcc

SEQ ID NO: 107362 - DNA, 1915 bp, Homo sapiens
  Payload ID: 1069
  Gene Symbol: ABTB1
  Gene Name: ankyrin repeat and BTB (POZ) domain containing 1
  ENST ID: ENST00000475042
  CDS Start-End: 69-242
gtttacatccgccgggtgcgcggcttcgccgcccgaggtcgttcggctcgggtaccatcctccgcgccatggacaccagcgacctgttcgccagctgcaggaagggggatgtgggccgagtgcggtacctgctggagcagcgagacgtggaggtactatgcctgcttgtgtgggcacgaggagctggtactctaccttctggccaatggagcccgctgcgaggccaacaccttcgatggtgagcgctgcctctatggggcactgagtgaccccatccgccgggctctacgcgattacaagcaggtcacggcttcctgcaggaggcgggattactatgacgacttcttgcagcggcttctagagcagggcatccacagtgacgtggtctttgtagtacacgggaagccattccgggtgcatcgctgcgtcctgggtgcacgtagtgcctactttgccaacatgctggacaccaaatggaagggcaagagtgtcgtggttctcaggcacccactgatcaaccccgtggcctttggggccctgctgcagtacctgtacacaggccgcctggacattggcgtagagcatgtgagtgactgtgagcgcctggccaagcaatgccagctgtgggacctgctcagcgacctggaggccaagtgcgagaaggtgtctgagtttgtggcgtctaagccaggcacgtgtgtgaaggtgctgaccatcgagcccccacctgcagacccccgcctccgggaggacatggcgctgctggccgattgtgccctgccccccgagctccgaggtgatctttgggagctgcccttcccttgtcctgacggcttcaacagctgccctgacatctgcttccgagtggctggctgcagcttcctctgccacaaggcctttttctgtggccgcagtgactacttccgagccctgctggatgaccacttccgagagagcgaggagccagcgacctcagggggccccccagccgtcaccctgcatggcatctcacccgacgtcttcactcacgtgctctactacatgtacagcgaccacactgagctgtcccccgaggcagcctatgatgtgctgagcgtcgccgacatgtacctgctgccaggcctgaagaggctgtgcggccgcagcctggctcagatgctagacgaggacactgtggtgggtgtgtggcgcgtggccaagctcttccgcctggcgcggcttgaggaccagtgcactgagtacatggccaaggtcattgagaagctggtggagcgggaggacttcgtggaggcggtgaaggaggaggcagcggctgtggcagcccggcaggagacggactctatcccgctggtggacgacatccgcttccacgtggccagcacggtgcagacctacagcgccatagaggaggcgcagcagcgtctgcgggcactcgaggacctgctcgtgtccatcggtctggactgttgagcccctggctgggcagccccaggggccaggagctctcttggagacaagcatgtgtatgcgtttgtgtgcagctcttcttcctgctccctgcacattgagggcttcatggggggtgcgaggggctcagtggggcttctcttccctccatgagcctggagaccccaggggaggatccatttgggatgagccccctccccccaatgcacaagccagcccccaagaccctgggggtggacaccactcagggaaacctggggtgggggtgggctttggtcttagcactttccttctccagatcccccctacccaccccagtcccaaatccagtcctctggcccttgcctagccctgaattgcttctctaagctggtgttcccatgcacagggccattcaggaagggctgggggagtgtgtgtggcaataaagcttgaaggcaccgtggga

SEQ ID NO: 107363 - DNA, 1027 bp, Homo sapiens
  Payload ID: 1069
  Gene Symbol: ABTB1
  Gene Name: ankyrin repeat and BTB (POZ) domain containing 1
  ENST ID: ENST00000483857
  CDS Start-End: 92-265
cggggcggggcggggctgagcgtgtttacatccgccgggtgcgcggcttcgccgcccgaggtcgttcggctcgggtaccatcctccgcgccatggacaccagcgacctgttcgccagctgcaggaagggggatgtgggccgagtgcggtacctgctggagcagcgagacgtggaggtactatgcctgcttgtgtgggcacgaggagctggtactctaccttctggccaatggagcccgctgcgaggccaacaccttcgatggtgagcgctgcctctatggggcactgagtgaccccatccgccgggctctacgcgattacaagcaggtcacggcttcctgcaggaggcgggattactatgacgacttcttgcagcggcttctagagcagggcatccacagtgacgtggtctttgtagtacacgggaagccattccgggtgcatcgctgcgtcctgggtgcacgtagtgcctactttgccaacatgctggacaccaaatggaagggcaagagtgtcgtggttctcaggcacccactgatcaaccccgtggcctttggggccctgctgcagtacctgtacacaggtgaccccctgggtccagggtaggaggagagggagtgggccgtccttctggacagcagtacacctaggtgtggctgggctgacctttcacctctagacacttcatggtccccccggggtggttccagctgcctctcgggttgggttgcaagagagaggactagtgtgcctgctcaggaagagcttgtcccacccacatgctgaggccctcccatctgttccctggggcctgtagaacagcttttgatggggaaaccatggtggcaagtgggcccaggagtcctagtcctgcagccaggtggccaggtgggaggggatcaccctttttctgtgggcctgatgacagctgaggtcccgcaggccctcatcctccccactgcccccaggccgcctggacattggcgtagagcatgtgagtgactgtgagcgcctggccaagcaatgcc

SEQ ID NO: 107364 - DNA, 4902 bp, Homo sapiens
  Payload ID: 1070
  Gene Symbol: ABTB2
  Gene Name: ankyrin repeat and BTB (POZ) domain containing 2
  Uniprot ID: Q8N961
  ENST ID: ENST00000435224
  CDS Start-End: 426-3503
agaagtttgcagagcgctttctcgccggctggtcccggactcgcgctgcgccctgcgccctgcgccgccgcctcctccttctgccgccgccgccctgttctcccgggattccttctctgtggaggactgactctctgcttgtgggaattagaggtggacaagggggagtgccggggggtagcgacggggttctttccagtggcagctgcgagtcgggacgccgggagcgtggggctcctgctggccacggatctcggccaccttcccgcggcctccgggcaggcaatgcggccgccgagccccgcgacgcagagaggaaggagggtggcccggagggcctagagcttgtttctgcccacttgggaaagagggcatggagttgtgagtgcccctcgctcggcgacgccgccctcggcaggctccccatggccgggacgtacagctcgactctgaagacgctggaggacttgaccttggactccgggtatggggccggggactcgtgccgctcgctcagcctctcgtcctccaagtccaactcgcaggcgctcaactcttcggcgcagcagcaccgcggggcggcctggtggtgctactccggctccatgaacagccgccacaacagctgggacacggtgaacacggtgctgcccgaggaccccgaagtggccgacctcttctcgcgctgtccgcggctccccgagctggaggagttcccctggaccgaaggagacgtggcccgggtgctccgcaaaggcgctggcggccggcggctgccccagttctccgccgaggcggtgaggcgcctggccgggctgctccgcagggcactgatccgcgtggcccgcgaggcgcagcgcctgagcgtgctgcacgccaagtgcacccgctttgaggtgcagagcgccgtgcgcctggtgcacagctgggcgctggccgagagctgcgcgctggcagccgtcaaggcgctgtccctgtacagcatgagcgccggcgacgggctgcgccggggcaagtccgcgcgctgcggcctcaccttctcagtgggtcgctttttccgctggatggtggacacccgaatctccgtgcgcatccacgagtacgcagccatctccctcaccgcctgcatggagaacctggtggaggagatccgggccagggtgatggccagccacagccctgatggcggaggggccggaggcggggaggtgtctgctgaggccctggagatggtcatcaacaacgacgccgagctctggggcgtcttgcagccctatgagcatctcatctgcggcaagaacgccaatggtgtcctctccctccccgcatacttcagcccctacaacggcgggtccctgggccatgacgagcgagccgatgcctatgcccagctggagctccgaaccctggagcagtccctcctggccacctgcgtgggcagcatctcggagctgagtgacttggtctcccgtgccatgcaccacatgcaggggcgtcaccccctgtgcccgggtgccagccctgcccgccaggcccgccagccgccacagcccatcacttggtcccccgacgccctccacacgctctactactttctgcggtgtccacagatggagtccatggagaaccccaacctggaccccccgagaatgaccttgaacaatgaacggcccttcatgctgctgccgcccctcatggagtggatgcgcgtggccatcacctacgcagagcaccgccgcagcctcaccgtggacagcggcgacatccggcaggcagcccggctgctgctgcctggtctggactgtgaacctcggcagctcaaacccgaacactgtttcagttccttccggaggctggatgcccgagcagctactgaaaaattcaaccaggacctgggtttccgcatgctcaactgtgggaggacggacctcatcaaccaagccatcgaggccttgggtccggatggggttaacaccatggatgaccagggtatgacgccactgatgtacgcctgcgctgctggggacgaagcgatggtccagatgttgattgatgctggggcaaacttggacatccaggttccaagcaactcccccaggcacccttccatccaccccgacagccggcactggacctcactgacattcgctgtgctgcatggacacatctctgtggtccagttgctgctggatgctggtgcccatgtcgagggctcggcagtgaacggcggcgaggacagctatgcggagacgcccctgcagctggcctctgcggcagggaactatgagctggtcagtttgttgctgagccgaggcgccgaccccctcctcagcatgctggaggcccacggcatgggctcctccctccacgaggacatgaactgcttcagccactcagctgcccacggccacaggaacgtcctgaggaagctcctgacgcagccacagcaggctaaagcggacgtgctgtccctggaggagatcctggccgagggtgtggaggaaagtgatgcgtcgagccagggcagtggcagcgaggggcccgtgcggctgagccggacccgcaccaaggccctacaggaggccatgtactacagcgctgagcacggctacgtggacatcaccatggagctgagggcactgggagtcccctggaagctgcacatctggatcgagtctctgaggacctcgttctcgcagtcgcggtactcggtggtgcagagcctcctgcgggacttcagctccatcagagaggaggagtacaacgaggagctggtgaccgagggcttgcagctcatgttcgacatcctcaagaccagcaaaaacgactccgtcatccagcaactggctaccatcttcacccactgctatggcagcagtcccatccccagcatcccagagatccggaagaccctgccggccaggctagatccacactttttgaacaataaggagatgtcagatgtgaccttcctggtggaaggaaagctgttttatgcacataaagtcctgctggtgacagcttctaacaggttcaagacactaatgaccaataaatcagaacaggatggggacagcagcaagaccatcgagatcagcgacatgaagtaccacatttttcagatgatgatgcagtatctgtactacggaggaacagaatccatggagatccccaccactgacatcctggagctgctgtcagctgccagcctgttccagctggatgccctgcagaggcactgcgagatcctgtgctcccagaccctcagcatggagagtgccgtgaacacctacaaatatgccaagatccacaatgccccagaactggccctgttctgtgagggcttcttcctcaagcacatgaaggccctactggagcaggatgccttccggcagctcatctacggccgcagcagcaaagtgcagggcctggatccactgcaggacctgcagaacaccctggcagagcgcgtgcactctgtctacatcacctcccgggtgtgaggcagggggcggaggctgccgaggccagggcctgtggaggtgccagggcccaccatgtcggggtatggttgtaggccctcttggagccaggttcacggggctgtttcctcctcctcccccagatgtcccccctgtcaccgggcagctcaccctcatctcctctgccctagagctgtttgttcaatcactgatgggcaaaggggagatgtagctaactggtggccctcctccccatctcagtttgcaactcaagggcagccatgcactcccccggggtgtcgctctcccctcctgcaggtcagcagctgatcctgatccacctccgcccaggccctccaagctctactcacccctagggcctcagtaaactcagaccatcccaactggggctcctgggggtacaggaatccttatgaatgtatagaatgcatactgcctaggcccccagtcgtctgcagtaattcaaaagctggtatttttcttcctaaatgtcacatagcaaaggctgcccaaatccccaaacttgttcttcaaaggtttgacaggcttaatgtgggcatccagtggcctgtggacccccccctgccaccacgactgctgccacccggagttcccccattgtctttggtgcctgggcttccagagtccctcccatcaggactaccagcttgctcagttagcagcagagggcagttccccagcttgatggtttctgagctaagtctggcatggaggggcaaggggtaggggatggggtgctgtgtaggaatggcctcagctcttgttttgctgctggttttaggggccaaagtaaatgggtggattctggaacctcaggcctagactaggttgcctttgtgggggcgatgaagcagagtcccctggtcaagtctctcggctcctttaatgtaggattgagagctgggcaaacaggtcccactggggactgtgactcttggagattaaaggacagggcattgatggaaggtaagggccaggagaagaggcctttctgctgtgtcccctcacggccttgccctcgaattctgcaggccctgggctcccctgacacctgtcatatttatggaccagacactggggcagcatcaggcacagtctgtctgggtgcaacttcttcagctgtctggccgcaccttaaaaactatttattcaccaaaagccccaggcatttcagaaggtggcactcaggtcaccctgaaaagcccccaggggcttgcaattctggaaaatattttgactagctgcttggctggatgtacaaagaaataggcattattttattgctgtaatattgtatgatactttaactgtacaataatgttgtcacttactgtaaatgtactatggttttattaacaataaacactcattaacaatg

SEQ ID NO: 107365 - DNA, 3110 bp, Homo sapiens
  Payload ID: 1071
  Gene Symbol: ANKDD1A
  Gene Name: ankyrin repeat and death domain containing 1A
  Uniprot ID: Q495B1
  ENST ID: ENST00000319580
  CDS Start-End: 30-1598
agcgcgcgcaggggctgcggagcggcaggatgcaggaggagctggcgtgggagaccgacggcctgcttcctctggagaggcagctccacgaggccgcccgccagaacaatgtcggcaggatgcaggagctgattgggaggagggttaacaccagggccagaaaccacgtgggcagggtggccctgcactgggctgcaggtgcagggcacgagcaggctgtgcgtctgcttctggagcacgaggctgctgtggacgaggaggatgcggtaggggccctcacagaggcacgtctgtgttttgggatgaatgcgcttctcctgtctgcctggttcggccacttacgaatcctccagatcttggtaaactcaggggccaagatccactgtgagagcaaggatggcctgaccttactgcactgcgcagcccaaaaaggccatgtgcctgtgctggcgttcataatggaggacctggaggatgtggccctggaccacgtagacaagctggggaggacggcgtttcacagggcagctgagcacgggcagctggatgctctggacttcctcgtgggctctggctgtgaccacaatgtcaaagacaaggaggggaacactgcccttcatctggctgctggtcggggccatatggctgtgctgcagcgacttgtggacatcgggctggacctggaggagcagaatgcggaaggtctgactgccctgcattcggctgctggaggatcccaccctgactgtgtgcagctcctcctcagggctgggagcaccgtgaatgccctcacccagaaaaacctaagctgccttcactatgcagccctcagtggctcggaggatgtgtctcgggtcctcatccacgcaggaggctgcgccaacgtggttgatcatcagggtgcctctcctctgcacctcgctgtgaggcacaacttccctgccttggtccggctcctcatcaactccgacagtgacgtgaatgccgtggacaataggcagcagacgccccttcacctggctgcagagcacgcctggcaggacatagcagatatgctcctcattgctggggttgacttaaacctgagagataagcagggaaaaaccgccctggcagtggccgtccgcagcaaccatgtcagcctggtggacatgatcataaaagctgatcgtttctacagatgggagaaggaccaccccagtgatccctctgggaagagcttgtcctttaagcaggaccatcggcaggaaacacagcagctccgttctgtgctgtggcggctggcctccaggtatctgcagccccgtgagtggaagaagctggcatattcctgggagttcacggaggcacatgtcgacgccatcgagcaacagtggacaggcaccaggagctatcaggagcacggccaccgaatgctgctcatttggctgcatggcgtggccacggctggtgagaaccccagcaaagcgctgttcgagggcctcgtggccattggcaggagggacctggctggctggagtacaatggcgagatctcagctcacggcaacctccgcctcccgggttcaaatgattcttgtgcctcagcctcccgagtagctgggattacaggtgcatgccatcacagctggctaatttttgtatttttagtagagatggggtttggccatgatggccaggctggaaaattgaaacataatttcacaattattcctttttccaccttaaataataagagtagaatactttctgtgtttttatcttatacacatgaataaatgctatggcttatcacagttacaatgtgttttctgaaagtaaagattattttaccttgaaattacaaaaattattttcagttttccaaaattctatctttaaacctaaataattcaatttcatggatgcacaaatgtttattgagagtctcatattcatgcttttcttcacagcactataaagttggacttggaaaatttggacagccatttgccattgtaatttttattcttttttctcctgattatttgacaaaacttgtatccacattgtagctgttcatgtgtctgcttctattgcatattgtaaaattattaactacttcccaaaatagtatttctctcagcagatatttctttggtactaccatgtattgtgtaacttttgggaaagtaaggtggcttccctgctctcagtgaagcattttattaaaagaataattataattaaaaaaacacgatacagatcagtgcatatagtatattactaatagtatgctgttaattgtgtaagaaagaaaggaaattagaaaacatatttgcataaataaaagctagacaaaggctaagaaactaatcaggtggtttccctggggtagtaggataatggggaacagtggggctgggaccgggtgggagaaagagttctcagtggttcctttctatacagttttaacttttgaaatgtgtgagagtgttacttactgaaaactgaaaggatatgacatgctggaacaggcaaaactacaaagacagtaaaaagatcagtgatttccaggagctgcaagggcagtgagaggaagggagggatgaggaggtggagcgcaggggatgttagggcagtgaaaggttctgtatgacactgtgatggtgggtacatgacattgggcattggtcaaaacccatagcatgtacagcacaaagcgtttgctctaatgtgagctatggactttagttaatagtaacgtgtcaatattggttcatcagttgtatcaaatgtaccacactgatgccagatgttaataatcggggaaactgtgtgtgctgaagagtacgtgggagctctctgtgctatctgctcaatttttctctaaacctaaaactgttctaaaatagaaagtctgtgaaaaaaaacaaaagtaaagttataaaaggaaaagaaaacagaggctttaaattaaatcatctattccttgggaaaggtattttgtaccatatgggactgaaatcatttatctggatgaattttataaaatgaattttgtaatttttttctgagaaaaaaaagttcttaaatacaataaaattgaaatgttgaaatatatctctcaaa

SEQ ID NO: 107366 - DNA, 1518 bp, Homo sapiens
  Payload ID: 1071
  Gene Symbol: ANKDD1A
  Gene Name: ankyrin repeat and death domain containing 1A
  ENST ID: ENST00000395720
  CDS Start-End: 1-1272
atgaatgcgcttctcctgtctgcctggttcggccacttacgaatcctccagatcttggtaaactcaggggccaagatccactgtgagagcaaggatggcctgaccttactgcactgcgcagcccaaaaaggccatgtgcctgtgctggcgttcataatggaggacctggaggatgtggccctggaccacgtagacaagctggggaggacggcgtttcacagggcagctgagcacgggcagctggatgctctggacttcctcgtgggctctggctgtgaccacaatgtcaaagacaaggaggggaacactgcccttcatctggctgctggtcggggccatatggctgtgctgcagcgacttgtggacatcgggctggacctggaggagcagaatgcggaaggtctgactgccctgcattcggctgctggaggatcccaccctgactgtgtgcagctcctcctcagggctgggagcaccgtgaatgccctcacccagaaaaacctaagctgccttcactatgcagccctcagtggctcggaggatgtgtctcgggtcctcatccacgcaggaggctgcgccaacgtggttgatcatcagggtgcctctcctctgcacctcgctgtgaggcacaacttccctgccttggtccggctcctcatcaactccgacagtgacgtgaatgccgtggacaataggcagcagacgccccttcacctggctgcagagcacgcctggcaggacatagcagatatgctcctcattgctggggttgacttaaacctgagagataagcagggaaaaaccgccctggcagtggccgtccgcagcaaccatgtcagcctggtggacatgatcataaaagctgatcgtttctacagatgggagaaggaccaccccagtgatccctctgggaagagcttgtcctttaagcaggaccatcggcaggaaacacagcagctccgttctgtgctgtggcggctggcctccaggtatctgcagccccgtgagtggaagaagctggcatattcctgggagttcacggaggcacatgtcgacgccatcgagcaacagtggacaggcaccaggagctatcaggagcacggccaccgaatgctgctcatttggctgcatggcgtggccacggctggtgagaaccccagcaaagcgctgttcgagggcctcgtggccattggcaggagggacctggctgaaaatatcaggaagaaagcaaacgcagccccgagtgcccccaggaggtgcacagccatgtaaccggaggggccagaccttcaggcacgtgggacctcagcgtgtggagccacctgaacagaagatgaccatcatttaagggctttttaaaaaatcactgttaacagacctccaggtgattctactgaaatgcacagtcatgcagagcccaggaggcaaatgtttgtacactgatctttttcatgaggatgggtccaagggcctgtaatcccgtccaacaggtatggtccttttgagctcttggcacac

SEQ ID NO: 107367 - DNA, 1250 bp, Homo sapiens
  Payload ID: 1071
  Gene Symbol: ANKDD1A
  Gene Name: ankyrin repeat and death domain containing 1A
  ENST ID: ENST00000395723
  CDS Start-End: 1-1200
atgaatgcgcttctcctgtctgcctggttcggccacttacgaatcctccagatcttggtaaactcaggggccaagatccactgtgagagcaaggatggcctgaccttactgcactgcgcagcccaaaaaggccatgtgcctgtgctggcgttcataatggaggacctggaggatgtggccctggaccacgtagacaagctggggaggacggcgtttcacagggcagctgagcacgggcagctggatgctctggacttcctcgtgggctctggctgtgaccacaatgtcaaagacaaggaggggaacactgcccttcatctggctgctggtcggggccatatggctgtgctgcagcgacttgtggacatcgggctggacctggaggagcagaatgcggaaggtctgactgccctgcattcggctgctggaggatcccaccctgactgtgtgcagctcctcctcagggctgggagcaccgtgaatgccctcacccagaaaaacctaagctgccttcactatgcagccctcagtggctcggaggatgtgtctcgggtcctcatccacgcaggaggctgcgccaacgtggttgatcatcagggtgcctctcctctgcacctcgctgtgaggcacaacttccctgccttggtccggctcctcatcaactccgacagtgacgtgaatgccgtggacaataggcagcagacgccccttcacctggctgcagagcacgcctggcaggacatagcagatatgctcctcattgctggggttgacttaaacctgagagataaggaccaccccagtgatccctctgggaagagcttgtcctttaagcaggaccatcggcaggaaacacagcagctccgttctgtgctgtggcggctggcctccaggtatctgcagccccgtgagtggaagaagctggcatattcctgggagttcacggaggcacatgtcgacgccatcgagcaacagtggacaggcaccaggagctatcaggagcacggccaccgaatgctgctcatttggctgcatggcgtggccacggctggtgagaaccccagcaaagcgctgttcgagggcctcgtggccattggcaggagggacctggctggctggagtacaatggcgagatctcagctcacggcaacctccgcctcccgggttcaaatgattcttgtgcctcagcctcccgagtagctgggattacaggtgcatgccatcacagctggctaatttttgtattttta

SEQ ID NO: 107368 - DNA, 1477 bp, Homo sapiens
  Payload ID: 1071
  Gene Symbol: ANKDD1A
  Gene Name: ankyrin repeat and death domain containing 1A
  ENST ID: ENST00000496660
  CDS Start-End: 54-599
gcggagcggcaggatgcaggaggagctggcgtgggagaccgacggcctttgggatgaatgcgcttctcctgtctgcctggttcggccacttacgaatcctccagatcttggtaaactcaggggccaagatccactgtgagagcaaggatggcctgaccttactgcactgcgcagcccaaaaaggccatgtgcctgtgctggcgttcataatggaggacctggaggatgtggccctggaccacgtagacaagctggggaggacggcgtttcacagggcagctgagcacgggcagctggatgctctggacttcctcgtgggctctggctgtgaccacaatgtcaaagacaaggaggggaacactgcccttcatctggctgctggtcggggccatatggctgtgctgcagcgacttgtggacatcgggctggacctggaggagcagaatgcggaaggtctgactgccctgcattcggctgctggaggatcccaccctgactgtgtgcagctcctcctcagggctgggagcaccgtgaatgccctcacccaggtagccaggccctcccaagactgcggtcggctcttggctgctgagccatagccatgtcggcagtaacggccacagggattcctgaaccctgagtgaatagaggcttcgaggcagcagacaaggttctgatcttggcttctccactgctgagccctgtgacctggagcaagttacttaacctctctgagccttgtttcccaactataaagtgcagtgacatttacttttttacattgttgtgaggattaaatacctaacacagtgcccaggacataatagggcccaacacctcaatacctgttagtgtttttttgttttaatttttttgagatgggtcttactctgtcgcccaggctgaagtgcaatggtgcgatcttggctcactgtaacctccgcctcctgggttcaagcagttttcctgactcagcctcccaagaggctgggactacaggtgtgtgccactacccccggctcatttttgtattttttgggtagagacagggtttcaccatgttggccaggctggtcttgaactcctgacctcaagtgatccacctgcctcagccttccaaagtgttgggattataggcgggatagccattgcacctggccctgttagtgtcttctatttgttgagctcttgatcgttcacaaagccccttcataactgttaccccagaaaaattccacccattttgcagatgagaaaactggagctttgagggcactttctcagggtcacaagctagtacgaggcaaagctgagtctcaaaagccttttcccctgactccagagctcccacccactgatgaagcttttcccctgacagagctggggcttgaggtgtgaccctggatgaacctcttctctctctccccgttgtactcatcagttctgccagtaaaaattctcctctatgacctggaaa

SEQ ID NO: 107369 - DNA, 1280 bp, Homo sapiens
  Payload ID: 1071
  Gene Symbol: ANKDD1A
  Gene Name: ankyrin repeat and death domain containing 1A
  ENST ID: ENST00000483400
  CDS Start-End: 1-402
attgggaggagggttaacaccagggccagaaaccacgtgggcagggtggccctgcactgggctgcaggtgcagggcacgagcaggctgtgcgtctgcttctggagcacgaggctgctgtggacgaggaggatgcggtaggggccctcacagaggaggggaacactgcccttcatctggctgctggtcggggccatatggctgtgctgcagcgacttgtggacatcgggctggacctggaggagcagaatgcggaaggtctgactgccctgcattcggctgctggaggatcccaccctgactgtgtgcagctcctcctcagggctgggagcaccgtgaatgccctcacccaggtagccaggccctcccaagactgcggtcggctcttggctgctgagccatagccatgtcggcagtaacggccacagggattcctgaaccctgagtgaatagaggcttcgaggcagcagacaaggttctgatcttggcttctccactgctgagccctgtgacctggagcaagttacttaacctctctgagccttgtttcccaactataaagtgcagtgacatttacttttttacattgttgtgaggattaaatacctaacacagtgcccaggacataatagggcccaacacctcaatacctgttagtgtttttttgttttaatttttttgagatgggtcttactctgtcgcccaggctgaagtgcaatggtgcgatcttggctcactgtaacctccgcctcctgggttcaagcagttttcctgactcagcctcccaagaggctgggactacaggtgtgtgccactacccccggctcatttttgtattttttgggtagagacagggtttcaccatgttggccaggctggtcttgaactcctgacctcaagtgatccacctgcctcagccttccaaagtgttgggattataggcgggatagccattgcacctggccctgttagtgtcttctatttgttgagctcttgatcgttcacaaagccccttcataactgttaccccagaaaaattccacccattttgcagatgagaaaactggagctttgagggcactttctcagggtcacaagctagtacgaggcaaagctgagtctcaaaagccttttcccctgactccagagctcccacccactgatgaagcttttcccctgacagagctggggcttgaggtgtgaccctggatgaacctcttctctctctccccgttgtactcatcagttctgccagtaaaaattctcctctatgacctggaaa

SEQ ID NO: 107370 - DNA, 1448 bp, Homo sapiens
  Payload ID: 1071
  Gene Symbol: ANKDD1A
  Gene Name: ankyrin repeat and death domain containing 1A
  ENST ID: ENST00000513267
  CDS Start-End: 4-375
aggatgcaggaggagctggcgtgggagaccgacggcctgcttcctctggagaggcagctccacgaggccgcccgccagaacaatgtcggcaggatgcaggagctgattgggaggagggttaacaccagggccagaaaccacgtgggcagggtggccctgcactgggctgcaggtgcagggcacgagcaggctgtgcgtctgcttctggagcacgaggctgctgtggacgaggaggatgcgtttgggatgaatgcgcttctcctgtctgcctggttcggccacttacgaatcctccagatcttggtaaactcaggggccaagatccactgtgagagcaagcccaaaaaggccatgtgcctgtgctggcgttcataatggaggacctggaggatgtggccctggaccacgtagacaagctggggaggacggcgtttcacagggcagctgagcacgggcagctggatgctctggacttcctcgtgggctctggctgtgaccacaatgtcaaagacaaggaggggaacactgcccttcatctggctgctggtcggggccatatggctgtgctgcagcgacttgtggacatcgggctggacctggaggagcagaatgcggaaggtctgactgccctgcattcggctgctggaggatcccaccctgactgtgtgcagctcctcctcagggctgggagcaccgtgaatgccctcacccaggtagccaggccctcccaagactgcggtcggctcttggctgctgagccatagccatgtcggcagtaacggccacagggattcctgaaccctgagtgaatagaggcttcgaggcagcagacaaggttctgatcttggcttctccactgctgagccctgtgacctggagcaagttacttaacctctctgagccttgtttcccaactataaagtgcagtgacatttacttttttacattgttgtgaggattaaatacctaacacagtgcccaggacataatagggcccaacacctcaatacctgttagtgtttttttgttttaatttttttgagatgggtcttactctgtcgcccaggctgaagtgcaatggtgcgatcttggctcactgtaacctccgcctcctgggttcaagcagttttcctgactcagcctcccaagaggctgggactacaggtgtgtgccactacccccggctcatttttgtattttttgggtagagacagggtttcaccatgttggccaggctggtcttgaactcctgacctcaagtgatccacctgcctcagccttccaaagtgttgggattataggcgggatagccattgcacctggccctgttagtgtcttctatttgttgagctcttgatcgttcacaaagccccttcataactgttaccccagaaaaattccacccattttgcagatgagaaaactggagctttgagggcactttctca

SEQ ID NO: 107371 - DNA, 3079 bp, Homo sapiens
  Payload ID: 1071
  Gene Symbol: ANKDD1A
  Gene Name: ankyrin repeat and death domain containing 1A
  ENST ID: ENST00000620154
  CDS Start-End: 1-1272
atgaatgcgcttctcctgtctgcctggttcggccacttacgaatcctccagatcttggtaaactcaggggccaagatccactgtgagagcaaggatggcctgaccttactgcactgcgcagcccaaaaaggccatgtgcctgtgctggcgttcataatggaggacctggaggatgtggccctggaccacgtagacaagctggggaggacggcgtttcacagggcagctgagcacgggcagctggatgctctggacttcctcgtgggctctggctgtgaccacaatgtcaaagacaaggaggggaacactgcccttcatctggctgctggtcggggccatatggctgtgctgcagcgacttgtggacatcgggctggacctggaggagcagaatgcggaaggtctgactgccctgcattcggctgctggaggatcccaccctgactgtgtgcagctcctcctcagggctgggagcaccgtgaatgccctcacccagaaaaacctaagctgccttcactatgcagccctcagtggctcggaggatgtgtctcgggtcctcatccacgcaggaggctgcgccaacgtggttgatcatcagggtgcctctcctctgcacctcgctgtgaggcacaacttccctgccttggtccggctcctcatcaactccgacagtgacgtgaatgccgtggacaataggcagcagacgccccttcacctggctgcagagcacgcctggcaggacatagcagatatgctcctcattgctggggttgacttaaacctgagagataagcagggaaaaaccgccctggcagtggccgtccgcagcaaccatgtcagcctggtggacatgatcataaaagctgatcgtttctacagatgggagaaggaccaccccagtgatccctctgggaagagcttgtcctttaagcaggaccatcggcaggaaacacagcagctccgttctgtgctgtggcggctggcctccaggtatctgcagccccgtgagtggaagaagctggcatattcctgggagttcacggaggcacatgtcgacgccatcgagcaacagtggacaggcaccaggagctatcaggagcacggccaccgaatgctgctcatttggctgcatggcgtggccacggctggtgagaaccccagcaaagcgctgttcgagggcctcgtggccattggcaggagggacctggctgaaaatatcaggaagaaagcaaacgcagccccgagtgcccccaggaggtgcacagccatgtaaccggaggggccagaccttcaggcacgtgggacctcagcgtgtggagccacctgaacagaagatgaccatcatttaagggctttttaaaaaatcactgttaacagacctccaggtgattctactgaaatgcacagtcatgcagagcccaggaggcaaatgtttgtacactgatctttttcatgaggatgggtccaagggcctgtaatcccgtccaacaggctggagtacaatggcgagatctcagctcacggcaacctccgcctcccgggttcaaatgattcttgtgcctcagcctcccgagtagctgggattacaggtgcatgccatcacagctggctaatttttgtatttttagtagagatggggtttggccatgatggccaggctggaaaattgaaacataatttcacaattattcctttttccaccttaaataataagagtagaatactttctgtgtttttatcttatacacatgaataaatgctatggcttatcacagttacaatgtgttttctgaaagtaaagattattttaccttgaaattacaaaaattattttcagttttccaaaattctatctttaaacctaaataattcaatttcatggatgcacaaatgtttattgagagtctcatattcatgcttttcttcacagcactataaagttggacttggaaaatttggacagccatttgccattgtaatttttattcttttttctcctgattatttgacaaaacttgtatccacattgtagctgttcatgtgtctgcttctattgcatattgtaaaattattaactacttcccaaaatagtatttctctcagcagatatttctttggtactaccatgtattgtgtaacttttgggaaagtaaggtggcttccctgctctcagtgaagcattttattaaaagaataattataattaaaaaaacacgatacagatcagtgcatatagtatattactaatagtatgctgttaattgtgtaagaaagaaaggaaattagaaaacatatttgcataaataaaagctagacaaaggctaagaaactaatcaggtggtttccctggggtagtaggataatggggaacagtggggctgggaccgggtgggagaaagagttctcagtggttcctttctatacagttttaacttttgaaatgtgtgagagtgttacttactgaaaactgaaaggatatgacatgctggaacaggcaaaactacaaagacagtaaaaagatcagtgatttccaggagctgcaagggcagtgagaggaagggagggatgaggaggtggagcgcaggggatgttagggcagtgaaaggttctgtatgacactgtgatggtgggtacatgacattgggcattggtcaaaacccatagcatgtacagcacaaagcgtttgctctaatgtgagctatggactttagttaatagtaacgtgtcaatattggttcatcagttgtatcaaatgtaccacactgatgccagatgttaataatcggggaaactgtgtgtgctgaagagtacgtgggagctctctgtgctatctgctcaatttttctctaaacctaaaactgttctaaaatagaaagtctgtgaaaaaaaacaaaagtaaagttataaaaggaaaagaaaacagaggctttaaattaaatcatctattccttgggaaaggtattttgtaccatatgggactgaaatcatttatctggatgaattttataaaatgaattttgtaatttttttctgagaaaaaaaagttcttaaatacaataaaattgaaatgttgaaatata

SEQ ID NO: 107372 - DNA, 2569 bp, Homo sapiens
  Payload ID: 1072
  Gene Symbol: ANKDD1B
  Gene Name: ankyrin repeat and death domain containing 1B
  Uniprot ID: A6NHY2
  ENST ID: ENST00000601380
  CDS Start-End: 177-1763
cagcgaaccgccacaacagagagcggactcgatcctgcgctccggccgggctgacctgcctgcgtccagcccccgcgccctgggcctgcctgggtctggatctgtgtccgagtctgggtctggatctgggtccgagtctgggtctggccctgcgctcagggcccgcggaggagactatggaccccgccgggcgcgcccggggccaaggggccacggcaggggggctgctgctccgggctgctgcggccgccaagggtctcagggaagacctgtggggcgcggccgccctgccttggaggagcctgtcccggatcccgaagcgggagggtcttggagaggaggacacagcagttgccggacacgagctcctactcccaaatgagagaagctttcagaatgctgctaaaagcaataatttggatcttatggagaagctgtttgaaaagaaggttaacattaatgttgtgaacaatatgaaccgcacagccctgcattttgcagtggggagaaatcatttatctgcagtggatttcttgcttaaacacaaggccagggtggatgttgctgataagcacggcttgacagtaattcaccttgcagcctggtctgggagccttgaggtcatgctcatgctggttaaagctggagcagaccagagagccaagaatcaggatggaatgagcgccctccactttgccactcagagcaatcatgtgcgcatcgtggagtatcttattcaagatctgcacctcaaggacctgaaccagcctgatgagaaaggaagaaaaccatttcttttggcagctgagaggggccatgttgaaatgatagaaaaacttaccttcctaaacctgcatacttcagaaaaggacaaggggggaaacactgccttgcacctcgctgcgaagcatggtcacagtcctgcagtgcaggtgctgctagcccagtggcaagacataaatgagatgaatgagctcaatatcagtagtttgcagatagcaaccaggaacggccatgcatcccttgtcaactttcttctcagtgagaacgttgatctgcaccagaaagtggaacctaaggagtcccctcttcatttagttgttatcaacaaccacatcacggttgtaaacagtttattaagtgcacagcatgatattgacatcttaaatcagaagcagcaaacccctctgcatgtagctgctgatcgtggaaatgtggaactggtggaaaccctgctgaaggcaggctgtgacttgaaggctgttgacaagcaaggaaagactgccctggctgtggcctccaggagcaaccatagccttgtcgtgggcatgctcattaaagcagagagatactacgcctggagagaggagcatcatgagagcatcagggacccgtcaacaggctttactctgacattcaagcaagatcacagtctggagaccagacacattcgcacgcttctctgggacctggcttaccatcagctgaaggccaatgagtggcagaggctggcccgttcgtggaactttacagatgaccagattagagccattgaggagcagtggtcgggaaatgaaagcttccgtgaacatggccacagggctctgcttatctggctacacgggaccctgatgactcagggtgacccggccaagcaactgtatgaagagctggtacacgcaggtttcccaaaactagctgaaaagactcgtcatttcaaaagcaaaactgactcaaactccaagaaatgtgtagtttcataaatgcctaaagaaattgtatttacatgattttccactcagcattcagttcttttaatgccataaatttcttctagcagtagcactgattttcaactatgatgatggtggtgacagggaactctaacagatgaaagaagagtaataccatgatacttttcaaccactaaaaagtcaaatatagttttttttgctgagggcaagttgtatgtgattttcccatttctatcaatcatttgatgtaatccatgtaataagataatctaggacggttttgtatgtcatgtttttttaaaaaactcatgggagcagcatcatggtacagtaaaaaaacaagggtttttataatagacaaatatggttttgaacttggttttgccacttattagatgtgaacctttgggcatgttaatgttgtttacgttcttagatcttcagtttccttctctataaactgggagagatgtctatttaatccatagggttggaatgaagatgaagggaaaatgcctgtgtagcctcacgcccatagtacggaaatcaactgctatttctctttcagtaagagaaactgggtttggaatttatagtcattgttgactttaaatcacacattttgtgtaatatattacttaggaaagaccagaagtatgtacaccatttttttttttttttaaatctcttggtgatgtaattacagatgattattttctttgtacttttgggtacattccattctttttttcacaaagaacatgcattatttttgtaatctaagagttatgaaataaatgtaaaattgagtgtca

SEQ ID NO: 107373 - DNA, 5303 bp, Homo sapiens
  Payload ID: 1073
  Gene Symbol: ANKEF1
  Gene Name: ankyrin repeat and EF-hand domain containing 1
  Uniprot ID: Q9NU02
  ENST ID: ENST00000378380
  CDS Start-End: 330-2660
ccccgccccctgcgctcacctgcccgcgcgctcgccttccggggacccggggcccatggacacatacacccagccctgctgtcccgcgcgccagctcaccagccctacccaagggacatcattcacgcctgggcgcctccgccgggctccgggagcccaaggtcgcggctgggccagcgctgagcgtcagaggacgagagcaggggcctccccggtcgccccagcaggcccaggcacataggtgcccagagatccctggcttctgatcgcccggaagactaagagctttagttttggtccagaaagcattttcaaggagctggtcaagcatggctttagcagataagagacttgagaacttacagatctacaaagttcttcaatgtgtgcggaacaaagacaagaagcagatagagaagctgaccaagcttggataccctgaactaatcaattatacagaacccattaatggacttagtgctttgcacttagcctcagtttccaatgatattgatatggtcagctttctccttgaccttggtgctcaccctgatgtgcaagaccgaatgggctgtactcccacaatgagggctgcagaactgggccatgaattgtcaatggaaatattagcaaaggcaaaggctgatatgactatagttgataatgaaggaaaaggtgttttgttttactgcattttaccgactaagcggcattatcgctgtgctctgatcgcccttgaacatggtgcagatgtcaacaattctacctatgaaggaaagccaatattccttagagcttgtgaagatgcacatgatgttaaagatgtgtgcctgacatttttggaaaaaggagccaatcctaatgcaatcaactcatccacaggccgcacagctttaatggaagcgtcaagagaaggggtagtggaaatagttcgaggcatattggaaagaggaggtgaagtgaatgcatttgacaacgacaggcatcacgctgctcattttgctgctaaaggaggctttttcgatatattgaagcttctttttgcctacaatggagacgtggggctgatttcgataaatgggaacacaccacttcattatgctgccatgggtggttttgcagactgctgtaaatatatagctcagcgaggatgtgacctgaaatggaagaatttagatcataaaacgcccagggctgtggctaaggaaggcggcttcaaagcagcaagcaaagaaatacgccgagcagagagaatcgctaataaactagccaggccaggagccaaaaatccaaatccactgtgggcccttagactgcacgattggtccgtagaacgtgaggctttcctccgggaagcctttgcggttttagacaggggtgatggaagcatcagcaagaacgacttcgtgatggtgttggaggaaaggcaggattatgcaagctcagaacagctggctgccatcgctcaccttcatgagaaaacccggggaggaggggtcaatattaatgaattctttaaaggaaccagatatttaaacaagtcttttgtcttaggatcgtatggacctaagaaaaaggaaaaagggatgggcaaaaaaggaaagaaagggaaatttgtcttaccccttccaatctgtgtcattcctgagtacgcgtttccacgccggcaggatggtgggccaccgtattacatgattgagacctacaagaatgtcactgatagcagccggtttaatagagatcatcccccagaacatcccattcaggatgactctgtttggtacattgatgattcagagaaggtattttcaaacattaatattatcaccaaagcaggggatctggcttctctgaaaaaggcctttgaatcaggaatacctgtggatatgaaggataattattacaaaactccgctaatgacggcgtgtgcaagtggaaacatagatgtggtcaagtttcttcttgaaaaaggagctaacgttaatgcaacagataactttctgtggactccacttcattttgcatgccatgcaggccaacaagacattgttgagcttcttgttgaatctggagctttaatagatgcagcttcaatcaacaactcaactcctttaaatagagccattgaaagctgcagactggatacagtaaaatacctacttgatattggtgctaaattccagctggaaaatagaaaagggcatagtgccatggacgttgcaaaggcatatgctgattatagaataattgatctgattaaagaaaagctagataacttgccgaaaccagcagaaaatcaaaaactaaaaggcaagacacctcctatactgaagactgaaggccctgaaattaagaaagaagaggaactgctgtcatcaatttatggtgtaccaaccacatcagagggaaagaaagtacagaagggtaatgtggttcatctgaattcattgattaccagtggttatactaagaaagtggatatcacatttattccacggaggatttggagtcctgaagccacaacagcagagctgatcaggaagagggaactacggcgagagaggtttacacatgaggtggacttcgacgattttatgatgccttttcagaagaacatcacagagaaagctcgagcactggaagctgccttgaagacctaagtcatagcagttatttcttggggtaaatgctttgaggcccagggaccaatctttggagaaagtagatatttccatcaaagccaaagcaatccatacaccaagaacttgttaccaagaatttctttttgctttaacaactataaatattcttagctgtctagagaaaagatgtatgttattttgaaatgaatggtatgtcattctggataaatccccaagcccctttatgaatgtagtgaaatacatggcatgtgggttataaacgttgctgtcaaaagatttaccaggtctacaccattatgcttattatttttttaattatcctttttatttattaaatagagacagagtctcactatattgccccagctggtctcgaactcttgagctcaggcagtcctcccaacttggccgtcgaaagtgctgggattataggcatgagctactgtgcccagcctgcttattgaagatacatttctagtggaaattgatgaaacaatttaggttttggaaaaagaagtaatatttaatcttttaaggaaggagtttatttctcacatgccattataaactatgtgtattagataccttgggttgaatacacttttaacagccctagatcgatagccctagccctagatagatagccctagccctagatagatagctattaggttggtgcaaaagtaattgtggtttttgccataacctttaattgcagcaaaaaccgcaattacttttgctccaacctgacagctaggtatctagctagctagaaaggcagatagacagatatatagatgatagatagatagatgatagatagatagatagatgatagatagatagatagatagatagatagatagatagatagagatttattgcaaataattggtttacataattttgggccccagatggttaagtgctaaatttgtagggtaggctatcaggaagtgcaggctggaaacatgcaggagctgtccctgaagtccacaagtggaatttcttcttcatcatggaaacctcagttttgttcatacacctaaatacttcagtatgtctttcctaaaataaaaggcatccatttacctaaccagattacgattgtgaaaatttcaactgttgttaaagcgactgatgggatcagtttcacctagattatctaaagcagtctcctttacataaagtcaatgaattgtaaatattggttgcatgtacacaattccttcaccacaacacctaagattagtatttgattgagttactgggtgctacaacctagccaagttgagtcataaaactgaccatctctggaggtgtactctgcagtaaaaagctagctgaggcattattcacaccaagaaatgcagtgggtaccgaacaggagctccaaaaatatccaacgtctcattgacagaaagaagccactttagaatctgccttaccagaaggcaccaattgcagattacagctctgtcagtcacgtatggattaaacccctttcctctaacctcctccctctctttccaaccttggagggaccttccacaggagccagttagggaggagaagggaagagagagaatgaagcaggtaaccaggcccacccctctggaggagacagacctgaacaggggttgcttacaagcattgcatttggatcccaagatttgctattacaactaaattttgtctgttttgtaaggttttggttggtttttttgttctctcttttctttttgttttgacataatttcatatttatggaaaagttgcaataatttgacaaagaattcttatatgccctttacccagattacctaaatgttaaccacttaccacatttgctctatctctttctccctctacatatatgcatatgtatgtttaatttttgtccccgaactatctgtgtgtccgttgaagacatgatgaagacatgatgttcttcacatgatgttttcatatttgtgtgtcagttgaagacatgatgttttaaatatttcattgtgtatttcctaaaatcacgatgttcttttgcataacaatattaccattggcaaactaaggaaattaacacttaagtgaactatttaatctatagaccttattcagattttgctatttatcccaataatttcctttgtactcccaggtcatgaaatacattcgcttgccccatctctttagtctcttttagtttagaacaacctgtatttcttgtttgtttgtttgtttgtttgtttatgacagtatataagaagaacacaagccacttttatcttgtaaaatgtctctcaactttggtttgtcttaaatgtcttcaagaatagattcaggtgatgcttttggggcagcagtgctacagatgtcattgcacccttctcagtacatcatatcaggaggcacatgatgttgatacctgatataaactttaactgcatttgcagttgagagaaatgtaaataaaagtaaagctgcagtaataaatcataactgcataaaattaactgtagtacatactgtacaactgtaataatttcatagccacctcctgttgctattgtgttgagttcaattgttgtcttttctcaagcttactttattgcacaaatacagtatttataacatacaaaa

SEQ ID NO: 107374 - DNA, 2894 bp, Homo sapiens
  Payload ID: 1073
  Gene Symbol: ANKEF1
  Gene Name: ankyrin repeat and EF-hand domain containing 1
  Uniprot ID: Q9NU02
  ENST ID: ENST00000378392
  CDS Start-End: 402-2732
ggcttccaccccgccccctgcgctcacctgcccgcgcgctcgccttccggggacccggggcccatggacacatacacccagccctgctgtcccgcgcgccagctcaccagccctacccaagggacatcattcacgcctgggcgcctccgccgggctccgggagcccaaggtcgcggctgggccagcgctgagcgtcagaggacgagagcaggggcctccccggtcgccccagcaggcccaggcacataggtgcccagagatccctggcttctgatcgcccggaagactaagagtcccatgaagtgggcaccattgctattgccagttcacagatgcagaaactgaggtaaaaactagctttagttttggtccagaaagcattttcaaggagctggtcaagcatggctttagcagataagagacttgagaacttacagatctacaaagttcttcaatgtgtgcggaacaaagacaagaagcagatagagaagctgaccaagcttggataccctgaactaatcaattatacagaacccattaatggacttagtgctttgcacttagcctcagtttccaatgatattgatatggtcagctttctccttgaccttggtgctcaccctgatgtgcaagaccgaatgggctgtactcccacaatgagggctgcagaactgggccatgaattgtcaatggaaatattagcaaaggcaaaggctgatatgactatagttgataatgaaggaaaaggtgttttgttttactgcattttaccgactaagcggcattatcgctgtgctctgatcgcccttgaacatggtgcagatgtcaacaattctacctatgaaggaaagccaatattccttagagcttgtgaagatgcacatgatgttaaagatgtgtgcctgacatttttggaaaaaggagccaatcctaatgcaatcaactcatccacaggccgcacagctttaatggaagcgtcaagagaaggggtagtggaaatagttcgaggcatattggaaagaggaggtgaagtgaatgcatttgacaacgacaggcatcacgctgctcattttgctgctaaaggaggctttttcgatatattgaagcttctttttgcctacaatggagacgtggggctgatttcgataaatgggaacacaccacttcattatgctgccatgggtggttttgcagactgctgtaaatatatagctcagcgaggatgtgacctgaaatggaagaatttagatcataaaacgcccagggctgtggctaaggaaggcggcttcaaagcagcaagcaaagaaatacgccgagcagagagaatcgctaataaactagccaggccaggagccaaaaatccaaatccactgtgggcccttagactgcacgattggtccgtagaacgtgaggctttcctccgggaagcctttgcggttttagacaggggtgatggaagcatcagcaagaacgacttcgtgatggtgttggaggaaaggcaggattatgcaagctcagaacagctggctgccatcgctcaccttcatgagaaaacccggggaggaggggtcaatattaatgaattctttaaaggaaccagatatttaaacaagtcttttgtcttaggatcgtatggacctaagaaaaaggaaaaagggatgggcaaaaaaggaaagaaagggaaatttgtcttaccccttccaatctgtgtcattcctgagtacgcgtttccacgccggcaggatggtgggccaccgtattacatgattgagacctacaagaatgtcactgatagcagccggtttaatagagatcatcccccagaacatcccattcaggatgactctgtttggtacattgatgattcagagaaggtattttcaaacattaatattatcaccaaagcaggggatctggcttctctgaaaaaggcctttgaatcaggaatacctgtggatatgaaggataattattacaaaactccgctaatgacggcgtgtgcaagtggaaacatagatgtggtcaagtttcttcttgaaaaaggagctaacgttaatgcaacagataactttctgtggactccacttcattttgcatgccatgcaggccaacaagacattgttgagcttcttgttgaatctggagctttaatagatgcagcttcaatcaacaactcaactcctttaaatagagccattgaaagctgcagactggatacagtaaaatacctacttgatattggtgctaaattccagctggaaaatagaaaagggcatagtgccatggacgttgcaaaggcatatgctgattatagaataattgatctgattaaagaaaagctagataacttgccgaaaccagcagaaaatcaaaaactaaaaggcaagacacctcctatactgaagactgaaggccctgaaattaagaaagaagaggaactgctgtcatcaatttatggtgtaccaaccacatcagagggaaagaaagtacagaagggtaatgtggttcatctgaattcattgattaccagtggttatactaagaaagtggatatcacatttattccacggaggatttggagtcctgaagccacaacagcagagctgatcaggaagagggaactacggcgagagaggtttacacatgaggtggacttcgacgattttatgatgccttttcagaagaacatcacagagaaagctcgagcactggaagctgccttgaagacctaagtcatagcagttatttcttggggtaaatgctttgaggcccagggaccaatctttggagaaagtagatatttccatcaaagccaaagcaatccatacaccaagaacttgttaccaagaatttctttttgctttaacaactataaatattcttagctgtctaga

SEQ ID NO: 107375 - DNA, 7418 bp, Homo sapiens
  Payload ID: 1074
  Gene Symbol: ANKFY1
  Gene Name: ankyrin repeat and FYVE domain containing 1
  Uniprot ID: Q9P2R3
  ENST ID: ENST00000341657
  CDS Start-End: 37-3546
acttctcgcgaggttgcaggcagtgccgggccagacatggcggaagaggaggtggccaagttggagaagcacttgatgcttctgcggcaggagtatgtcaagctgcagaagaagctggcggagacagagaagcgctgcgctctcttggctgcgcaggcaaacaaggagagcagcagcgagtccttcatcagccgtctgctggccatcgtggcagacctctacgagcaggagcagtacagcgatctgaagataaaggttggggacaggcacatcagtgctcacaagtttgtcctggcagcccgcagtgacagctggagtctggctaacttgtcttccactaaagagttggacctgtcagatgctaatcctgaggtgacgatgacaatgcttcgctggatctatacagatgagctggagttcagagaggatgatgtgttcctgactgaactgatgaaactagcaaatcggtttcagctacagctcctcagggagagatgtgagaagggtgttatgtctctagtgaatgtcaggaactgtattcgcttctaccagacggcagaggagctgaatgccagcacactgatgaactactgtgcagaaattattgcaagtcattgggacgacctgaggaaggaggatttcagcagcatgagcgctcagttgttatacaaaatgatcaaatccaagacagagtacccgctacataaagccatcaaagtggagagagaagacgtggtcttcctgtatctgattgaaatggattcccagctccctgggaagctgaatgaagcggatcataacggagatctggcattagatctagccctctcacgacgactggagagtattgccaccacgctggttagtcacaaagctgatgtggacatggtggacaagagtggctggagcttgttacacaaaggaatccaaagaggagatctctttgctgccactttcctcattaagaatggggcctttgtcaacgctgctacactgggtgcccaggagacaccactgcaccttgtggccttgtacagttcaaagaaacactcagcagatgtgatgtctgagatggcgcagattgcagaggcccttctgcaggctggtgccaaccccaacatgcaggacagcaaggggaggactcctttacatgtgtccatcatggccgggaatgaatatgtgttcagtcagctgctgcagtgcaaacaactagatttagaactcaaagaccacgagggcagcacggctctgtggctggcagtgcagcatatcacagtgtcttctgaccagtctgtgaaccccttcgaagatgtccccgtggtaaatgggacttcatttgatgagaacagctttgcagccagactcatccagcgcggcagccacacagacgcacctgacacggcgacaggaaactgtttactacagcgggcagctggagcaggaaacgaggcagcagctcttttcctggcaaccaacggtgcccatgtcaaccacagaaacaagtggggagaaaccccgttgcacacagcgtgtcggcatggcctggccaacctcacggcagagctcctgcagcaaggcgccaacccaaacctgcagacggaggaagctctgcctctgccaaaggaggccgcatccctgaccagcttggcggacagcgtccatctgcagacgccactgcacatggcgatcgcctataaccatccggatgtggtgtctgtcatcctggagcagaaagccaatgctcttcatgccaccaacaacttgcagatcattccggacttcagcctcaaagattcccgagaccagactgtgctgggcctggcattatggactggcatgcacacgatcgcagcccagctgctgggctctggagccgccatcaatgacaccatgtcggatgggcagacgctactgcacatggccatacagcggcaggacagcaagagcgcactcttcctgctggagcaccaggcagatataaatgtcaggactcaggacggggagacagccctccagctggccatcagaaaccagcttccactcgtagttgatgccatatgcacccgaggagctgacatgtctgtgccagatgagaaggggaaccccccgctgtggcttgcattggcaaacaatctggaggacatcgcatccactctggtcagacatggctgtgatgccacatgctggggtccgggacctggtgggtgccttcagacgctcctgcacagagccattgatgaaaacaacgagcccaccgcctgctttcttattcgcagtggctgtgacgtgaacagtcccagacaaccaggcgccaatggagaaggagaggaagaggctagagatgggcagacccctttgcatttggcagcctcttgggggctggaagagacagtacagtgtcttctggagtttggtgccaacgtgaacgcacaggatgcagaaggaagaacccccatccacgtggccatcagcagccaacacggtgtcatcattcagctgttggtttctcaccccgatatccatttgaatgtacgagacagacaagggctgaccccgtttgcctgtgccatgactttcaagaacaacaagtcagccgaggccattctcaaacgagagtccggggctgctgagcaggtggataacaagggccggaatttccttcatgtggcagttcagaactctgatattgaaagtgtgctgttcctgatcagtgtccacgctaatgtgaattcaagagtccaggatgcctccaagttgacccccctgcacctcgctgtccaagcaggctcagaaattattgtccgcaatttgcttcttgcgggagccaaagtgaacgaattaaccaagcatcgccagactgccctccatcttgctgcccagcaggacctgcccaccatctgctcagtcctcctagagaatggcgtggactttgctgccgtggatgagaatggaaacaatgctcttcatcttgctgtcatgcacggccggctcaacaacatccgggttctcctgacagagtgcacagtggacgccgaagcctttaatctcagaggccagtcaccactgcacattttgggacaatatggcaaggagaatgcagcggccatctttgatctcttcctagaatgcatgccggggtatcctctggacaagccggatgcagacggcagcacggtgctgctcctggcatacatgaaagggaacgccaacttgtgccgcgccatcgtccggtcgggggctcgcctcggggtgaataacaaccagggagtcaacatcttcaactaccaggtcgccaccaagcagctcctgttccgactgctggatatgctgtccaaggagcctccgtggtgtgacggctcctactgctatgagtgcactgccaggttcggagtcaccactcgcaaacaccactgtcgtcactgcggacgtcttctttgccataaatgctcgaccaaggagattcctattataaagtttgatctgaacaagcctgtgcgggtttgcaacatttgttttgatgtactgactctgggtggggtttcttagtgagccccccggagggtccaggccacgtccttggtcacctccccagcagctgctctgctcaccagcctgaccccacccagagcaggagctggcgggtgtcttcctgcggcaatagactggaacgattaaggaccatggtgtgatagatcccatttcaaatgattccatatgattgtcagtgtgtgtgtcagactgtgatcgatttcactagatgtctcactcatcagaccaggccattgggcctaagtggtaaatgtgattaggaattagacctctccccattctgctagcaacatacagggacacttggaaaaccatttccccttccagtagcttggtgtccatcccagagcattcatgaagtcttcccgcctgggctgactgatgaggcagagcctctcagcgtaggaagctggctgcttaatgagctggctttactctagggtaagtggctgtggacttttctgcacagtgttttcataaagataataggatcctcttgccctgaagtctttttttctttttacgctaagctgtatttttagtgagctaccccttttaaaaaggtgaaatctttcttaacagggttcaaagatgagagctgaaaaatcgtggccttaacaactgaaagctttacagtgttcatgctactgaggtgtcaggagtgcagctgggccgcttgacacctcgtagcagccgtctcattctctcgtcttgctgcgtcctgtctgtggagtcctcagtcactctgctgttggagagtgctggaggaaatgcacttttactgtgctgcactttttatagagctgcattgtcggtgattccaatttaaaaatccatattcaaaaataccctcacacatccctgcatcagtgattctaatgatcagctttgactggacctcagctcacacgaatctccaaggaaaaactctacagagcatcttttagagcaagagattcatacaggccaagtgatgagagggggagtcaccaaggcttcagccccaagggcatctccagcctcaggccggcaggtcctatgtccttgacacaaatgcttcttgctgaaatcctccctagtgatgctgcgagtgctgttggtcccagttctgtgtagcttgccctgccccatgaagggccaccagccaagggccctggccacgtgtgcgccaccttactttggaagtctctggcttgtgtgctggatgaggctgccagaacttgttgggcgttcatcgctgttagtacatatattaaccgtgaggtgttaaacttttcttttgaaggtttggccagtttctaaaaaatgcacatttaaagagaagcatctaccacggctttaaaacaaaacaactctgagatgaacaatatgtgttatactcagagattaacaatctcaatcatacatactgattctttcagacatttaataaccactacatttttttgcattaatgaagtttgactatatgtgtaaagggactaaatatttttgcaacagcctgttctttgttcattcttttctggatagtgtgtcctctgtattgcggtagatttatacattctgttgcctaaatatgtgtgtaaaatgagctgataaactggagtactacttaaaaaaaagtctgtgatttataagatgtatatgctttctatgtgaatataagcttgtgcacaatgtttaaaagaaaaacaatgaattagaagagatcccccgtcccccagtctgacatatttcatacagaatgtttaaaagaaaaactctgctagtcttggcaaacatttggccatgtgaggcatgtggtcagtttccattttctattacctggaaagggccataaggaagcaggcagggcttaggtagcttggttacctaagttagaaagtaagagaatcatgattcggatatgaattgaagtggttggtacatggatacctgttctttaaaaggaatgtgggagatgagtcaagggtgaggccgattgttctgcccatgccctaccataccaatttcaataacaatcttgcctgtcattgcactcagaatcttaagatcatgtttcaaatatgttgattcaaacttgcttctaagcctgagtccagggatagcaatggtactgaccagctatggactgggagaacattgagtcctgttttccattggcttcagggcgcatccatgtggatataggaaaagcctctttccacagacttaggaagccccccgaccacgcggacgctcgctgggctgcactcagcaggctgcttgagtgggagctgactccaacatgccctgccctggctgggactaggcatgcttccagcccttcccgtgctctccctgctgtcaacacttgcgtacaaacctgcctagctgttgtaagttttcatcagtagcttaagtactagtagcaaaaacttaaattcattcagaaagttgccacttctgaatgagtagagcaggaaaagtaaactttactgaaacataatttgctgcaacagtcaacattgttatgctgaatgtgctctcaactgccctttgctcatcgccagatttattatccagtgtattcctaacagtcttttgttgtcgttgtttttaaaacaaaggtacggaccatgtgctatatataaatcgaatggcttaaactaatttgctatgatcctctaacaccgaaatttcccataaacttaagtgcctacacttaggacttttgaactttcagtcatctttttcgtggtgtctcactgaacgatgtgttagaacatgtgttccatttggagttttgggcctgtgcacggtcaaccccaattaccaatttagttgaggctggattcgattgctcagttcacctgccacgttctctccaaggagtggggtctacgtgacctttagtcctctacctcagagccccgagtcatttctgaccaccccgttctgtgtcctcactcttgtccctgaatgggtccctgtgtggatctcagtgtgtgtgtggtttctccactcctccccgctcatgtcccacacctgccatattgaaccgtttctgcactaatcttctccacgggcacggagtggagggaacgtcttgggaaaggggagagcttgacctccatctaggtttcttttatctggagaaaaagaacacttttgaactatgtaatgcttcaccctgaaaggcaagctaacgctaacttcccaggtgacagtagcaggaacaaggaagggtaatgtttccatgacagacacttgcttcccttgggacaagtcccagaagaactacctgaagcaccaaagctccccaccccagcctggtggcagaggaagcaggtggcaccaactcaccaaagggacttgggagccaccttctcactctgtggaagtactttagtgagagctgactggcaagataaaaaccctgaaattcccagaagttacagatgccttaaagactttctttggaagatcattgcctgtactattccttttttgtgtggcataaataatatattaacctgttacaactgacaacattggttttctgcagctagggagtcttgagtcgagactgctcgccttgatgacttgctcttttttggcagatgtgtggagttggctgttacgacatccctgtgtgatcccagaggaggggcagtagctgggcagaaactgcaggcacacatttgggtggatcacctggcttccagccccttcggggtggtgctcagtgtggggtgatggtatcatagaggaccacggcgcttatcagcattgtttctttggagtctgtgtaatggaatgtatttttcaaatactgatatttgcattttctgtaacaattccttataataaaatgaagtaaaattgtg

SEQ ID NO: 107376 - DNA, 570 bp, Homo sapiens
  Payload ID: 1074
  Gene Symbol: ANKFY1
  Gene Name: ankyrin repeat and FYVE domain containing 1
  ENST ID: ENST00000574736
  CDS Start-End: 391-570
actgctcaggtgacgggtgcactaacattaagaaatcaccaccgaagaacttatccgtggaaccagaaaccacctgtaccccaaagacactgaaatacgaatttaaaaaaaacagttgcggcgaacccatggaaaaacagaggaaactggccaggaggaggagcctgtgtgtgggaataaattccattgtgatttttgaatttctacacatttaagggagaaaccccgttgcacacagcgtgtcggcatggcctggccaacctcacggcagagctcctgcagcaaggcgccaacccaaacctgcagacggaggaagctctgcctctgccaaaggaggccgcatccctgaccagcttggcggacagcgtccatctgcagacgccactgcacatggcgatcgcctataaccatccggatgtggtgtctgtcatcctggagcagaaagccaatgctcttcatgccaccaacaacttgcagatcattccggacttcagcctcaaagattcccgagaccagactgtgctgggcctggcattatggactggcatgcacacgatcgcagcccagctg

SEQ ID NO: 107377 - DNA, 5033 bp, Homo sapiens
  Payload ID: 1074
  Gene Symbol: ANKFY1
  Gene Name: ankyrin repeat and FYVE domain containing 1
  Uniprot ID: Q9P2R3
  ENST ID: ENST00000574367
  CDS Start-End: 16-3528
agtgccgggccagacatggcggaagaggaggtggccaagttggagaagcacttgatgcttctgcggcaggagtatgtcaagctgcagaagaagctggcggagacagagaagcgctgcgctctcttggctgcgcaggcaaacaaggagagcagcagcgagtccttcatcagccgtctgctggccatcgtggcagacctctacgagcaggagcagtacagcgatctgaagataaaggttggggacaggcacatcagtgctcacaagtttgtcctggcagcccgcagtgacagctggagtctggctaacttgtcttccactaaagagttggacctgtcagatgctaatcctgaggtgacgatgacaatgcttcgctggatctatacagatgagctggagttcagagaggatgatgtgttcctgactgaactgatgaaactagcaaatcggtttcagctacagctcctcagggagagatgtgagaagggtgttatgtctctagtgaatgtcaggaactgtattcgcttctaccagacggcagaggagctgaatgccagcacactgatgaactactgtgcagaaattattgcaagtcattgggacgacctgaggaaggaggatttcagcagcatgagcgctcagttgttatacaaaatgatcaaatccaagacagagtacccgctacataaagccatcaaagtggagagagaagacgtggtcttcctgtatctgattgaaatggattcccagctccctgggaagctgaatgaagcggatcataacggagatctggcattagatctagccctctcacgacgactggagagtattgccaccacgctggttagtcacaaagctgatgtggacatggtggacaagagtggctggagcttgttacacaaaggaatccaaagaggagatctctttgctgccactttcctcattaagaatggggcctttgtcaacgctgctacactgggtgcccaggagacaccactgcaccttgtggccttgtacagttcaaagaaacactcagcagatgtgatgtctgagatggcgcagattgcagaggcccttctgcaggctggtgccaaccccaacatgcaggacagcaaggggaggactcctttacatgtgtccatcatggccgggaatgaatatgtgttcagtcagctgctgcagtgcaaacaactagatttagaactcaaagaccacgagggcagcacggctctgtggctggcagtgcagcatatcacagtgtcttctgaccagtctgtgaaccccttcgaagatgtccccgtggtaaatgggacttcatttgatgagaacagctttgcagccagactcatccagcgcggcagccacacagacgcacctgacacggcgacaggaaactgtttactacagcgggcagctggagcaggaaacgaggcagcagctcttttcctggcaaccaacggtgcccatgtcaaccacagaaacaagtggggagaaaccccgttgcacacagcgtgtcggcatggcctggccaacctcacggcagagctcctgcagcaaggcgccaacccaaacctgcagacggaggaagctctgcctctgccaaaggaggccgcatccctgaccagcttggcggacagcgtccatctgcagacgccactgcacatggcgatcgcctataaccatccggatgtggtgtctgtcatcctggagcagaaagccaatgctcttcatgccaccaacaacttgcagatcattccggacttcagcctcaaagattcccgagaccagactgtgctgggcctggcattatggactggcatgcacacgatcgcagcccagctgctgggctctggagccgccatcaatgacaccatgtcggatgggcagacgctactgcacatggccatacagcggcaggacagcaagagcgcactcttcctgctggagcaccaggcagatataaatgtcagcaggactcaggacggggagacagccctccagctggccatcagaaaccagcttccactcgtagttgatgccatatgcacccgaggagctgacatgtctgtgccagatgagaaggggaaccccccgctgtggcttgcattggcaaacaatctggaggacatcgcatccactctggtcagacatggctgtgatgccacatgctggggtccgggacctggtgggtgccttcagacgctcctgcacagagccattgatgaaaacaacgagcccaccgcctgctttcttattcgcagtggctgtgacgtgaacagtcccagacaaccaggcgccaatggagaaggagaggaagaggctagagatgggcagacccctttgcatttggcagcctcttgggggctggaagagacagtacagtgtcttctggagtttggtgccaacgtgaacgcacaggatgcagaaggaagaacccccatccacgtggccatcagcagccaacacggtgtcatcattcagctgttggtttctcaccccgatatccatttgaatgtacgagacagacaagggctgaccccgtttgcctgtgccatgactttcaagaacaacaagtcagccgaggccattctcaaacgagagtccggggctgctgagcaggtggataacaagggccggaatttccttcatgtggcagttcagaactctgatattgaaagtgtgctgttcctgatcagtgtccacgctaatgtgaattcaagagtccaggatgcctccaagttgacccccctgcacctcgctgtccaagcaggctcagaaattattgtccgcaatttgcttcttgcgggagccaaagtgaacgaattaaccaagcatcgccagactgccctccatcttgctgcccagcaggacctgcccaccatctgctcagtcctcctagagaatggcgtggactttgctgccgtggatgagaatggaaacaatgctcttcatcttgctgtcatgcacggccggctcaacaacatccgggttctcctgacagagtgcacagtggacgccgaagcctttaatctcagaggccagtcaccactgcacattttgggacaatatggcaaggagaatgcagcggccatctttgatctcttcctagaatgcatgccggggtatcctctggacaagccggatgcagacggcagcacggtgctgctcctggcatacatgaaagggaacgccaacttgtgccgcgccatcgtccggtcgggggctcgcctcggggtgaataacaaccagggagtcaacatcttcaactaccaggtcgccaccaagcagctcctgttccgactgctggatatgctgtccaaggagcctccgtggtgtgacggctcctactgctatgagtgcactgccaggttcggagtcaccactcgcaaacaccactgtcgtcactgcggacgtcttctttgccataaatgctcgaccaaggagattcctattataaagtttgatctgaacaagcctgtgcgggtttgcaacatttgttttgatgtactgactctgggtggggtttcttagtgagccccccggagggtccaggccacgtccttggtcacctccccagcagctgctctgctcaccagcctgaccccacccagagcaggagctggcgggtgtcttcctgcggcaatagactggaacgattaaggaccatggtgtgatagatcccatttcaaatgattccatatgattgtcagtgtgtgtgtcagactgtgatcgatttcactagatgtctcactcatcagaccaggccattgggcctaagtggtaaatgtgattaggaattagacctctccccattctgctagcaacatacagggacacttggaaaaccatttccccttccagtagcttggtgtccatcccagagcattcatgaagtcttcccgcctgggctgactgatgaggcagagcctctcagcgtaggaagctggctgcttaatgagctggctttactctagggtaagtggctgtggacttttctgcacagtgttttcataaagataataggatcctcttgccctgaagtctttttttctttttacgctaagctgtatttttagtgagctaccccttttaaaaaggtgaaatctttcttaacagggttcaaagatgagagctgaaaaatcgtggccttaacaactgaaagctttacagtgttcatgctactgaggtgtcaggagtgcagctgggccgcttgacacctcgtagcagccgtctcattctctcgtcttgctgcgtcctgtctgtggagtcctcagtcactctgctgttggagagtgctggaggaaatgcacttttactgtgctgcactttttatagagctgcattgtcggtgattccaatttaaaaatccatattcaaaaataccctcacacatccctgcatcagtgattctaatgatcagctttgactggacctcagctcacacgaatctccaaggaaaaactctacagagcatcttttagagcaagagattcatacaggccaagtgatgagagggggagtcaccaaggcttcagccccaagggcatctccagcctcaggccggcaggtcctatgtccttgacacaaatgcttcttgctgaaatcctccctagtgatgctgcgagtgctgttggtcccagttctgtgtagcttgccctgccccatgaagggccaccagccaagggccctggccacgtgtgcgccaccttactttggaagtctctggcttgtgtgctggatgaggctgccagaacttgttgggcgttcatcgctgttagtacatatattaaccgtgaggtgttaaacttttcttttgaaggtttggccagtttctaaaaaatgcacatttaaagagaagcatctaccacggctttaaaacaaaacaactctgagatgaacaatatgtgttatactcagagattaacaatctcaatcatacatactgattctttcagacatttaataaccactacatttttttgcattaatgaagtttgactatatgtgtaaagggactaaatatttttgcaacagcc

SEQ ID NO: 107378 - DNA, 6458 bp, Homo sapiens
  Payload ID: 1074
  Gene Symbol: ANKFY1
  Gene Name: ankyrin repeat and FYVE domain containing 1
  Uniprot ID: Q9P2R3
  ENST ID: ENST00000570535
  CDS Start-End: 118-3753
ggccgggcgtggttgcatgggggctccgcgggtctcgcgagccttcctgtctagcctctccggagcttctcgggccggggtccggagcgcggttcctatgacaacgtccctcccgcgatgccgaccccgcgggactgcggccggctgcggagccgggctggcaggtcccgcgccggtgctgcgtgcagccgcggggccccgagggcagcacgggaggctcttgattgccggcggtgccgggacgccgggggaaaggaggtggccaagttggagaagcacttgatgcttctgcggcaggagtatgtcaagctgcagaagaagctggcggagacagagaagcgctgcgctctcttggctgcgcaggcaaacaaggagagcagcagcgagtccttcatcagccgtctgctggccatcgtggcagacctctacgagcaggagcagtacagcgatctgaagataaaggttggggacaggcacatcagtgctcacaagtttgtcctggcagcccgcagtgacagctggagtctggctaacttgtcttccactaaagagttggacctgtcagatgctaatcctgaggtgacgatgacaatgcttcgctggatctatacagatgagctggagttcagagaggatgatgtgttcctgactgaactgatgaaactagcaaatcggtttcagctacagctcctcagggagagatgtgagaagggtgttatgtctctagtgaatgtcaggaactgtattcgcttctaccagacggcagaggagctgaatgccagcacactgatgaactactgtgcagaaattattgcaagtcattgggacgacctgaggaaggaggatttcagcagcatgagcgctcagttgttatacaaaatgatcaaatccaagacagagtacccgctacataaagccatcaaagtggagagagaagacgtggtcttcctgtatctgattgaaatggattcccagctccctgggaagctgaatgaagcggatcataacggagatctggcattagatctagccctctcacgacgactggagagtattgccaccacgctggttagtcacaaagctgatgtggacatggtggacaagagtggctggagcttgttacacaaaggaatccaaagaggagatctctttgctgccactttcctcattaagaatggggcctttgtcaacgctgctacactgggtgcccaggagacaccactgcaccttgtggccttgtacagttcaaagaaacactcagcagatgtgatgtctgagatggcgcagattgcagaggcccttctgcaggctggtgccaaccccaacatgcaggacagcaaggggaggactcctttacatgtgtccatcatggccgggaatgaatatgtgttcagtcagctgctgcagtgcaaacaactagatttagaactcaaagaccacgagggcagcacggctctgtggctggcagtgcagcatatcacagtgtcttctgaccagtctgtgaaccccttcgaagatgtccccgtggtaaatgggacttcatttgatgagaacagctttgcagccagactcatccagcgcggcagccacacagacgcacctgacacggcgacaggaaactgtttactacagcgggcagctggagcaggaaacgaggcagcagctcttttcctggcaaccaacggtgcccatgtcaaccacagaaacaagtggggagaaaccccgttgcacacagcgtgtcggcatggcctggccaacctcacggcagagctcctgcagcaaggcgccaacccaaacctgcagacggaggaagctctgcctctgccaaaggaggccgcatccctgaccagcttggcggacagcgtccatctgcagacgccactgcacatggcgatcgcctataaccatccggatgtggtgtctgtcatcctggagcagaaagccaatgctcttcatgccaccaacaacttgcagatcattccggacttcagcctcaaagattcccgagaccagactgtgctgggcctggcattatggactggcatgcacacgatcgcagcccagctgctgggctctggagccgccatcaatgacaccatgtcggatgggcagacgctactgcacatggccatacagcggcaggacagcaagagcgcactcttcctgctggagcaccaggcagatataaatgtcaggactcaggacggggagacagccctccagctggccatcagaaaccagcttccactcgtagttgatgccatatgcacccgaggagctgacatgtctgtgccagatgagaaggggaaccccccgctgtggcttgcattggcaaacaatctggaggacatcgcatccactctggtcagacatggctgtgatgccacatgctggggtccgggacctggtgggtgccttcagacgctcctgcacagagccattgatgaaaacaacgagcccaccgcctgctttcttattcgcagtggctgtgacgtgaacagtcccagacaaccaggcgccaatggagaaggagaggaagaggctagagatgggcagacccctttgcatttggcagcctcttgggggctggaagagacagtacagtgtcttctggagtttggtgccaacgtgaacgcacaggatgcagaaggaagaacccccatccacgtggccatcagcagccaacacggtgtcatcattcagctgttggtttctcaccccgatatccatttgaatgtacgagacagacaagggctgaccccgtttgcctgtgccatgactttcaagaacaacaagtcagccgaggccattctcaaacgagagtccggggctgctgagcaggtggataacaagggccggaatttccttcatgtggcagttcagaactctgatattgaaagtgtgctgttcctgatcagtgtccacgctaatgtgaattcaagagtccaggatgcctccaagttgacccccctgcacctcgctgtccaagcaggctcagaaattattgtccgcaatttgcttcttgcgggagccaaagtgaacgaattaaccaagcatcgccagactgccctccatcttgctgcccagcaggacctgcccaccatctgctcagtcctcctagagaatggcgtggactttgctgccgtggatgagaatggaaacaatgctcttcatcttgctgtcatgcacggccggctcaacaacatccgggttctcctgacagagtgcacagtggacgccgaagcctttaatctcagaggccagtcaccactgcacattttgggacaatatggcaaggagaatgcagcggccatctttgatctcttcctagaatgcatgccggggtatcctctggacaagccggatgcagacggcagcacggtgctgctcctggcatacatgaaagggaacgccaacttgtgccgcgccatcgtccggtcgggggctcgcctcggggtgaataacaaccagggagtcaacatcttcaactaccaggtcgccaccaagcagctcctgttccgactgctggatatgctgtccaaggagcctccgtggtgtgacggctcctactgctatgagtgcactgccaggttcggagtcaccactcgcaaacaccactgtcgtcactgcggacgtcttctttgccataaatgctcgaccaaggagattcctattataaagtttgatctgaacaagcctgtgcgggtttgcaacatttgttttgatgtactgactctgggtggggtttcttagtgagccccccggagggtccaggccacgtccttggtcacctccccagcagctgctctgctcaccagcctgaccccacccagagcaggagctggcgggtgtcttcctgcggcaatagactggaacgattaaggaccatggtgtgatagatcccatttcaaatgattccatatgattgtcagtgtgtgtgtcagactgtgatcgatttcactagatgtctcactcatcagaccaggccattgggcctaagtggtaaatgtgattaggaattagacctctccccattctgctagcaacatacagggacacttggaaaaccatttccccttccagtagcttggtgtccatcccagagcattcatgaagtcttcccgcctgggctgactgatgaggcagagcctctcagcgtaggaagctggctgcttaatgagctggctttactctagggtaagtggctgtggacttttctgcacagtgttttcataaagataataggatcctcttgccctgaagtctttttttctttttacgctaagctgtatttttagtgagctaccccttttaaaaaggtgaaatctttcttaacagggttcaaagatgagagctgaaaaatcgtggccttaacaactgaaagctttacagtgttcatgctactgaggtgtcaggagtgcagctgggccgcttgacacctcgtagcagccgtctcattctctcgtcttgctgcgtcctgtctgtggagtcctcagtcactctgctgttggagagtgctggaggaaatgcacttttactgtgctgcactttttatagagctgcattgtcggtgattccaatttaaaaatccatattcaaaaataccctcacacatccctgcatcagtgattctaatgatcagctttgactggacctcagctcacacgaatctccaaggaaaaactctacagagcatcttttagagcaagagattcatacaggccaagtgatgagagggggagtcaccaaggcttcagccccaagggcatctccagcctcaggccggcaggtcctatgtccttgacacaaatgcttcttgctgaaatcctccctagtgatgctgcgagtgctgttggtcccagttctgtgtagcttgccctgccccatgaagggccaccagccaagggccctggccacgtgtgcgccaccttactttggaagtctctggcttgtgtgctggatgaggctgccagaacttgttgggcgttcatcgctgttagtacatatattaaccgtgaggtgttaaacttttcttttgaaggtttggccagtttctaaaaaatgcacatttaaagagaagcatctaccacggctttaaaacaaaacaactctgagatgaacaatatgtgttatactcagagattaacaatctcaatcatacatactgattctttcagacatttaataaccactacatttttttgcattaatgaagtttgactatatgtgtaaagggactaaatatttttgcaacagcctgttctttgttcattcttttctggatagtgtgtcctctgtattgcggtagatttatacattctgttgcctaaatatgtgtgtaaaatgagctgataaactggagtactacttaaaaaaaagtctgtgatttataagatgtatatgctttctatgtgaatataagcttgtgcacaatgtttaaaagaaaaacaatgaattagaagagatcccccgtcccccagtctgacatatttcatacagaatgtttaaaagaaaaactctgctagtcttggcaaacatttggccatgtgaggcatgtggtcagtttccattttctattacctggaaagggccataaggaagcaggcagggcttaggtagcttggttacctaagttagaaagtaagagaatcatgattcggatatgaattgaagtggttggtacatggatacctgttctttaaaaggaatgtgggagatgagtcaagggtgaggccgattgttctgcccatgccctaccataccaatttcaataacaatcttgcctgtcattgcactcagaatcttaagatcatgtttcaaatatgttgattcaaacttgcttctaagcctgagtccagggatagcaatggtactgaccagctatggactgggagaacattgagtcctgttttccattggcttcagggcgcatccatgtggatataggaaaagcctctttccacagacttaggaagccccccgaccacgcggacgctcgctgggctgcactcagcaggctgcttgagtgggagctgactccaacatgccctgccctggctgggactaggcatgcttccagcccttcccgtgctctccctgctgtcaacacttgcgtacaaacctgcctagctgttgtaagttttcatcagtagcttaagtactagtagcaaaaacttaaattcattcagaaagttgccacttctgaatgagtagagcaggaaaagtaaactttactgaaacataatttgctgcaacagtcaacattgttatgctgaatgtgctctcaactgccctttgctcatcgccagatttattatccagtgtattcctaacagtcttttgttgtcgttgtttttaaaacaaaggtacggaccatgtgctatatataaatcgaatggcttaaactaatttgctatgatcctctaacaccgaaatttcccataaacttaagtgcctac

SEQ ID NO: 107379 - DNA, 3352 bp, Homo sapiens
  Payload ID: 1074
  Gene Symbol: ANKFY1
  Gene Name: ankyrin repeat and FYVE domain containing 1
  ENST ID: ENST00000572412
  CDS Start-End: 16-225
agtgccgggccagacatggcggaagaggaggtggccaagttggagaagcacttgatgcttctgcggcaggagtatgtcaagctgcagaagaagctggcggagacagagaagcgctgcgctctcttggctgcgcaggcaaacaaggagagcagcagcgagtccttcatcagccgtctgctggccatcgtggcagacctctacgagcaggagcagtacagatgctaatcctgaggtgacgatgacaatgcttcgctggatctatacagatgagctggagttcagagaggatgatgtgttcctgactgaactgatgaaactagcaaatcggtttcagctacagctcctcagggagagatgtgagaagggtgttatgtctctagtgaatgtcaggaactgtattcgcttctaccagacggcagaggagctgaatgccagcacactgatgaactactgtgcagaaattattgcaagtcattgggacgacctgaggaaggaggatttcagcagcatgagcgctcagttgttatacaaaatgatcaaatccaagacagagtacccgctacataaagccatcaaagtggagagagaagacgtggtcttcctgtatctgattgaaatggattcccagctccctgggaagctgaatgaagcggatcataacggagatctggcattagatctagccctctcacgacgactggagagtattgccaccacgctggttagtcacaaagctgatgtggacatggtggacaagagtggctggagcttgttacacaaaggaatccaaagaggagatctctttgctgccactttcctcattaagaatggggcctttgtcaacgctgctacactgggtgcccaggagacaccactgcaccttgtggccttgtacagttcaaagaaacactcagcagatgtgatgtctgagatggcgcagattgcagaggcccttctgcaggctggtgccaaccccaacatgcaggacagcaaggggaggactcctttacatgtgtccatcatggccgggaatgaatatgtgttcagtcagctgctgcagtgcaaacaactagatttagaactcaaagaccacgagggcagcacggctctgtggctggcagtgcagcatatcacagtgtcttctgaccagtctgtgaaccccttcgaagatgtccccgtggtaaatgggacttcatttgatgagaacagctttgcagccagactcatccagcgcggcagccacacagacgcacctgacacggcgacaggaaactgtttactacagcgggcagctggagcaggaaacgaggcagcagctcttttcctggcaaccaacggtgcccatgtcaaccacagaaacaagtggggagaaaccccgttgcacacagcgtgtcggcatggcctggccaacctcacggcagagctcctgcagcaaggcgccaacccaaacctgcagacggaggaagctctgcctctgccaaaggaggccgcatccctgaccagcttggcggacagcgtccatctgcagacgccactgcacatggcgatcgcctataaccatccggatgtggtgtctgtcatcctggagcagaaagccaatgctcttcatgccaccaacaacttgcagatcattccggacttcagcctcaaagattcccgagaccagactgtgctgggcctggcattatggactggcatgcacacgatcgcagcccagctgctgggctctggagccgccatcaatgacaccatgtcggatgggcagacgctactgcacatggccatacagcggcaggacagcaagagcgcactcttcctgctggagcaccaggcagatataaatgtcagcaggactcaggacggggagacagccctccagctggccatcagaaaccagcttccactcgtagttgatgccatatgcacccgaggagctgacatgtctgtgccagatgagaaggggaaccccccgctgtggcttgcattggcaaacaatctggaggacatcgcatccactctggtcagacatggctgtgatgccacatgctggggtccgggacctggtgggtgccttcagacgctcctgcacagagccattgatgaaaacaacgagcccaccgcctgctttcttattcgcagtggctgtgacgtgaacagtcccagacaaccaggcgccaatggagaaggagaggaagaggctagagatgggcagacccctttgcatttggcagcctcttgggggctggaagagacagtacagtgtcttctggagtttggtgccaacgtgaacgcacaggatgcagaaggaagaacccccatccacgtggccatcagcagccaacacggtgtcatcattcagctgttggtttctcaccccgatatccatttgaatgtacgagacagacaagggctgaccccgtttgcctgtgccatgactttcaagaacaacaagtcagccgaggccattctcaaacgagagtccggggctgctgagcaggtggataacaagggccggaatttccttcatgtggcagttcagaactctgatattgaaagtgtgctgttcctgatcagtgtccacgctaatgtgaattcaagagtccaggatgcctccaagttgacccccctgcacctcgctgtccaagcaggctcagaaattattgtccgcaatttgcttcttgcgggagccaaagtgaacgaattaaccaagcatcgccagactgccctccatcttgctgcccagcaggacctgcccaccatctgctcagtcctcctagagaatggcgtggactttgctgccgtggatgagaatggaaacaatgctcttcatcttgctgtcatgcacggccggctcaacaacatccgggttctcctgacagagtgcacagtggacgccgaagcctttaatctcagaggccagtcaccactgcacattttgggacaatatggcaaggagaatgcagcggccatctttgatctcttcctagaatgcatgccggggtatcctctggacaagccggatgcagacggcagcacggtgctgctcctggcatacatgaaagggaacgccaacttgtgccgcgccatcgtccggtcgggggctcgcctcggggtgaataacaaccagggagtcaacatcttcaactaccaggtcgccaccaagcagctcctgttccgactgctggatatgctgtccaaggagcctccgtggtgtgacggctcctactgctatgagtgcactgccaggttcggagtcaccactcgcaaacaccactgtcgtcactgcggacgtcttctttgccataaatgctcgaccaaggagattcctattataaagtttgatctgaacaag

SEQ ID NO: 107380 - DNA, 665 bp, Homo sapiens
  Payload ID: 1074
  Gene Symbol: ANKFY1
  Gene Name: ankyrin repeat and FYVE domain containing 1
  ENST ID: ENST00000575298
  CDS Start-End: 1-242
tgctgctcctggcatacatgaaagggaacgccaacttgtgccgcgccatcgtccggtcgggggctcgcctcggggtgaataacaaccagggagtcaacatcttcaactaccaggtcgccaccaagcagctcctgttccgactgctggatatgctgtccaaggagcctccgtggtgtgacggctcctactgctatgagtgcactgccaggttcggagtcaccactcgcaaacaccactggtaagaccccagcgtcactggcaaggagcgaggggactgccgctgatgtcattgcttccccccttctccaggacaggccgtgaacttgcctgggtcctgcacattgatgggcaaaccttgaccaaatggagggatgagatgagcacacccaaggatcctactgaggaacagagatgtagggaaggcagggagcctgcagacgggtggctttcctgctggaggctgaaggtgcacagtttccaggcagcctgccaggcctgtgccatccttcctgacttcctgcctgcaccaaagctgagatgagctactgccctcatggtgtgcctcagtatgggccgctttgccgagaactaaggggctgttcccattaaaatgagatagataggcgtgagccaccatgcctggcctgagctgctcttgatcttcc

SEQ ID NO: 107381 - DNA, 6081 bp, Homo sapiens
  Payload ID: 1075
  Gene Symbol: ANKIB1
  Gene Name: ankyrin repeat and IBR domain containing 1
  Uniprot ID: Q9P2G1
  ENST ID: ENST00000265742
  CDS Start-End: 377-3646
cgcagcggccggagagggatggggggcgcccacccagtctgagcctcgccgcgggcgccttcggctcacgcagcgcttcccgcgggccgccagtgcgcaccctcggccacatcagcctccgcctggcgggtgcacccgggccggcgaggaaggggcaaccgtccgggtgggtggggcgggctgggtacctgaggtcaccagctcggctgtagaggcaggggcggcggaggcggaactgcggagttgctgggtccaccgacccttaccctcagcgagagaagtaaccaatgtgaaagatgttgcagaagtgttccagaagtggctgaagatagaaggaaaaaagtgccactgcctatcagaaaaaacaaaacaaaacatgggaaatacaaccaccaaattccgtaaagcactcatcaatggtgatgaaaacctggcctgccaaatatatgaaaacaatcctcagctaaaagaatctcttgatccaaatacatcttatggggagccctaccagcacaatactccattacattatgctgctagacatggaatgaataaaatattagggacttttcttggtagagatggaaatccaaataaacggaatgtgcacaatgaaacatctatgcatttgttgtgtatgggacctcaaattatgatatctgaaggagcccttcatcctcgcttggcacgccccacagaagatgatttcagaagagcagattgtctgcagatgatcttaaaatggaaaggagcaaaacttgaccagggtgaatatgagagagcagctattgatgctgttgataacaaaaaaaacacacccttgcactatgctgctgcctcagggatgaaagcctgtgtagagcttttagtaaaacatggaggagacttgtttgctgagaatgaaaataaagatactccttgtgattgtgctgaaaagcaacaccacaaagatttggccctcaatctggaatctcaaatggtattctcacgggatcccgaggctgaagaaatagaagctgaatatgctgcattagacaaacgagagccatatgaaggattaaggcctcaggatcttcgtagactaaaagatatgcttattgtggaaactgcagacatgcttcaggctcctctctttactgctgaagctttacttcgagctcatgactgggacagggagaaattacttgaagcttggatgtccaacccggagaactgctgccaacgatcaggtgttcaaatgccaactccaccaccaagtgggtataatgcctgggacacgctcccatctccaagaactccaaggactacacgctcttctgtcacctccccagatgaaatcagcttatctcctggggatttagacaccagtttgtgtgacatttgtatgtgcagtatctctgtatttgaagaccctgtggatatgccctgtggacatgacttttgtagaggatgttgggagtcgtttttgaatctgaaaattcaagaaggtgaagctcacaacattttttgccctgcatatgattgcttccaacttgtacctgtggatatcatagaaagtgtagtttcaaaggagatggacaaacgatacctacagtttgatattaaggcctttgttgaaaataatcctgccattaaatggtgtcctactccaggctgtgacagagcagtaagactaacgaaacaagggtcaaatacatctggatctgatacactcagcttcccattgctgagagctcctgctgttgattgtggaaaaggacacctcttctgctgggagtgccttggtgaagcacatgagccttgtgactgccaaacatggaagaattggctgcaaaaaataaccgaaatgaaaccagaagaacttgtgggagttagtgaagcctacgaggatgccgccaattgtctctggttattaactaactccaagccttgtgccaactgtaagtctccaatacagaagaatgaaggctgcaatcacatgcagtgtgctaagtgcaagtatgacttttgctggatttgccttgaagagtggaaaaaacatagttcgtccactggaggttattacagatgtactcgctatgaagtcattcaacacgtggaggagcaatccaaggaaatgactgtggaggctgagaaaaaacacaaacgatttcaggaacttgacagatttatgcactattatacaagatttaaaaaccatgagcatagttatcagctagaacaacgccttcttaaaacagccaaagaaaagatggagcaattgagcagagctctcaaagaaactgaaggaggctgtccagataccactttcattgaagatgcagttcatgtgctcttaaaaactcggcgcattctcaagtgttcttatccatatggatttttcttggaacctaaaagcacaaagaaagaaatttttgaactaatgcaaacagacctagaaatggtcactgaagaccttgcccagaaagtcaataggccttaccttcgcacaccccgccacaagatcatcaaagcagcatgccttgtacagcagaagaggcaagaattcctggcatctgtggctcggggagtagctcctgcagactcaccagaagctccaaggcgcagctttgctggtggaacatgggattgggaatatttaggatttgcatcaccagaggaatatgctgaatttcagtatcggaggaggcacagacaacgtcgtcgaggagatgttcacagtctactcagtaatcctccagaccctgatgagccaagtgaaagcactttagatattccagaaggcggcagcagcagccgcaggcctggcacatccgtggtaagttctgcatctatgagtgtgctgcacagctcttccctgcgtgactacacccctgccagtcgctctgaaaaccaggactctcttcaggctctgagttccttggatgaagacgatcccaatatacttcttgcaatacagttatcactgcaagagtctgggctggccctcgatgaagaaactagagacttcctcagtaatgaagcatccttaggtgcgataggcacttctttaccttccaggctggactctgtccccagaaatacagatagccctcgggctgcattgagcagctctgagcttttggaacttggtgacagcctcatgagactaggagcagagaatgacccattttcaactgacaccctgagctcacaccctctcagtgaggcaagaagtgatttctgtccctcatctagtgatcctgactcagctggccaggaccccaacatcaatgacaatcttctcggcaacatcatggcttggtttcatgacatgaaccctcagagtattgccctgattcctccagcaactacagaaatcagtgcagattcccagctcccctgtatcaaagatgggtcagaaggtgtgaaggatgtggaactggtgctgccagaagattcaatgtttgaagatgccagtgtcagtgaaggtagaggaacccagatagaagaaaatcctttggaagaaaatattctggcgggggaagcagcatctcaagctggtgacagtggtaacgaggcagccaacagaggagatggttcagatgtttcaagtcaaacacctcaaacctcaagtgactggcttgaacaagtacatttagtgtgaactgcacacatctgggctctaaatgaattacaggtacagatggtatgctaggtggagtatgcttgatagagactttgattcacttaattccaactcagtgataaaccactgacattagggttgaatacagagaagttcccttgaatggtagcttcattttttattttaaccttacagggaatttcctttgtacttaattgaatagcttttcccctttttgctgacaaaaagaagagcaagagaaagagaaacaaaaatgaaataaataagttgtattccacactctaagaaaatgcagtcctctatttagcctaggcttgacaatacttaaattgaacatttaaactaaaggcttactccctaatctttgggtggctttcctttaaaaaaaaaaaaaaagttttcttcattctagaaatttattttggataaatccgataacatatatgtcctcaatctctttgtgctcttccataacttacttcctttttgtctgagcaatgtgaattgaagtctctttagtaccacatctaccatagtgtaattagttttaattttcacatgaatcaaaggtttcctttcatgtctatttacagtccaattgtgccaaactcttacttgtgtgctgactaacaaggcatttaggtgtgcagcatcctagagtgctccagggcagtgtcagcgttctcgggagtaaaaggtgccacttggtagcaatgatattccagaattaaatgggtttttgttgccatggagactgcatttatataaatgtagcctgtagcttaagttaactaaacctaatgctgctgttaaaaacagtttattttaatattaaaatacagttgattagcaacagcggtgctgtattttaagagacactttattggaagtgcaatcatagttatttgttttcacaattttacagtgcattctaattactgatgggtgcaattacttttaatcgtgttttataaaatagaaaaaaagtggagttttcatgagttatagtaaatcccacgattattaagaaattcagtaaaacatcctgcgcaacatgttaccgtgcctttgcctaacctaaatggatagttgccagttaaataagtgagtaattcaaatttcaatgtctcttctgaagtaactatgctatgaattgcaaagacctccataaaaccacccatggccttgcttttacactaactataacaactaaatgttcaatcagtttgtttgcctaactagcaaatgctgacatgtgtttgttctactgcgcaatactcatttgctgtgtgattactgtttagtgttgaaaaaaatcaacttcctagttatcagtgtcttactgtgaagaaaatactggtcttagttgtaattaggatacaatggtacagtgtgtaattaaaactagagtaaactgttggaatggctgttttacttaaatattatcaaaactagcataacataagcaaaatagataagtacaacactccatttagtgttttgccagattgttaccagaagtctacagataccaaactttcagttctgagtttgtacaggcaagtcctgggctgggtaaaaagttatattaatattgttatccacaagagatgtgattatgggttttgattactttttttttttccaaaccctgcttttgaaatatccttgtacttaaaattcatattgctaagacactgtattagaatatttaatattccccagatcctcttaggataaactgtgggaatcctcctatgccatggatatcaaaggtccacattagtttttatttctccagtgatcagaaacattgatatcaatccctattaaattagtggggggaatattaactttatctacagtgtattactgtatattaaactgaaatagtccattaaaggatttttttataaatttattttggattaaaaatatcaacaccaataagtttttagaccaagttgtaatttttccaatatagagtctttgcatcacactgaggcatcttgcacagctgcagttaaggtgagaaagaatgctctgtgtgaagacagtgtacacaatgggttccggtttccttgcaccttgtgcagtatcctttatttctgtgctgttctctcctgagcatgaaaaatgatcattatccaatttgtatttccttggtacatattttaaaaacaacacagtcattgactttacaattcagtaatgaagtttggcaaagcctattttgtaaacaagttaattttataatgtaaaaaaaaaaagttaatctaaccttgacttgttatttgcactttcatagtctatacttgatacattcccactttatatacagtaggattctacaaacgtgtagatgtttggccaaatgaatgctgttaataatatgtaaaattctttgattaaacatttattacttaaactac

SEQ ID NO: 107382 - DNA, 2036 bp, Homo sapiens
  Payload ID: 1075
  Gene Symbol: ANKIB1
  Gene Name: ankyrin repeat and IBR domain containing 1
  ENST ID: ENST00000422095
  CDS Start-End: 1-163
aagaatgaaggctgcaatcacatgcagtgtgctaagtgcaagtatgacttttgctggatttgccttgaagagtggaaaaaacatagttcgtccactggaggttattacagatgtactcgctatgaagtcattcaacacgtggaggagcaatccaaggaaatgactgtggaggctgagaaaaaacacaaacgatttcaggaacttgacagatttatgcactattatacaagatttaaaaaccatgagcatagttatcagctagaacaacgccttcttaaaacagccaaagaaaagatggagcaattgagcagagctctcaaagaaactgaaggaggctgtccagataccactttcattgaagatgcagttcatgtgctcttaaaaactcggcgcattctcaagtgttcttatccatatggatttttcttggaacctaaaagcacaaagaaagaaatttttgaactaatgcaaacagacctagaaatggtcactgaagaccttgcccagaaagtcaataggccttaccttcgcacaccccgccacaagatcatcaaagcagcatgccttgtacagcagaagaggcaagaattcctggcatctgtggctcggggagtagctcctgcagactcaccagaagctccaaggcgcaggaatatgctgaatttcagtatcggaggaggcacagacaacgtcgtcgaggagatgttcacagtctactcagtaatcctccagaccctgatgagccaagtgaaagcactttagatattccagaaggcggcagcagcagccgcaggcctggcacatccgtggtaagttctgcatctatgagtgtgctgcacagctcttccctgcgtgactacacccctgccagtcgctctgaaaaccaggactctcttcaggctctgagttccttggatgaagacgatcccaatatacttcttgcaatacagttatcactgcaagagtctgggctggccctcgatgaagaaactagagacttcctcagtaatgaagcatccttaggtgcgataggcacttctttaccttccaggctggactctgtccccagaaatacagatagccctcgggctgcattgagcagctctgagcttttggaacttggtgacagcctcatgagactaggagcagagaatgacccattttcaactgacaccctgagctcacaccctctcagtgaggcaagaagtgatttctgtccctcatctagtgatcctgactcagctggccaggaccccaacatcaatgacaatcttctcggcaacatcatggcttggtttcatgacatgaaccctcagagtattgccctgattcctccagcaactacagaaatcagtgcagattcccagctcccctgtatcaaagatgggtcagaaggtgtgaaggatgtggaactggtgctgccagaagattcaatgtttgaagatgccagtgtcagtgaaggtagaggaacccagatagaagaaaatcctttggaagaaaatattctggcgggggaagcagcatctcaagctggtgacagtggtaacgaggcagccaacagaggagatggttcagatgtttcaagtcaaacacctcaaacctcaagtgactggcttgaacaagtacatttagtgtgaactgcacacatctgggctctaaatgaattacaggtacagatggtatgctaggtggagtatgcttgatagagactttgattcacttaattccaactcagtgataaaccactgacattagggttgaatacagagaagttcccttgaatggtagcttcattttttattttaaccttacagggaatttcctttgtacttaattgaatagcttttcccctttttgctgacaaaaagaagagcaagagaaagagaaacaaaaatgaaataaataagttgtattccacactctaagaaaatgcagtcctctatttagcctaggcttgacaatacttaaattgaacatttaaactaaaggcttactccctaatctttgggtggctttcctttaaaaaaaaaaaaaaa

SEQ ID NO: 107383 - DNA, 642 bp, Homo sapiens
  Payload ID: 1075
  Gene Symbol: ANKIB1
  Gene Name: ankyrin repeat and IBR domain containing 1
  ENST ID: ENST00000413588
  CDS Start-End: 1-254
cgctcccatctccaagaactccaaggactacacgctcttctgtcacctccccagatgaaatcagcttatctcctggggatttagacaccagtttgtgtgacatttgtatgtgcagtatctctgtatttgaagaccctgtggatatgccctgtggacatgacttttgtagaggatgttgggagtccattgtaataagcagagagagcctacctatgatatcatctgtgaattttacctgcaagataaaaatataggtttttgaatctgaaaattcaagaaggtgaagctcacaacattttttgccctgcatatgattgcttccaacttgtacctgtggatatcatagaaagtgtagtttcaaaggagatggacaaacgatacctacagtttgatattaaggcctttgttgaaaataatcctgccattaaatggtgtcctactccaggctgtgacagagcagtaagactaacgaaacaagggtcaaatacatctggatctgatacactcagcttcccattgctgagagctcctgctgttgattgtggaaaaggacacctcttctgctgggagtgccttggtgaagcacatgagccttgtgactgccaaacatggaagaattggctgcaaaaaataaccgaaatg

SEQ ID NO: 107384 - DNA, 547 bp, Homo sapiens
  Payload ID: 1075
  Gene Symbol: ANKIB1
  Gene Name: ankyrin repeat and IBR domain containing 1
  ENST ID: ENST00000442183
  CDS Start-End: 146-547
agttcttgtttgggcaaaatttcctacatttttcactatcccacaaattggctgaaatgtgaaagatgttgcagaagtgttccagaagtggctgaagatagaaggaaaaaagtgccactgcctatcagaaaaaacaaaacaaaacatgggaaatacaaccaccaaattccgtaaagcactcatcaatggtgatgaaaacctggcctgccaaatatatgaaaacaatcctcagctaaaagaatctcttgatccaaatacatcttatggggagccctaccagcacaatactccattacattatgctgctagacatggaatgaataaaatattagggacttttcttggtagagatggaaatccaaataaacggaatgtgcacaatgaaacatctatgcatttgttgtgtatgggacctcaaattatgatatctgaaggagcccttcatcctcgcttggcacgccccacagaagatgatttcagaagagcagattgtctgcagatgatcttaaaatggaaaggagcaaaacttgaccagggtgaatatgag

SEQ ID NO: 107385 - DNA, 774 bp, Homo sapiens
  Payload ID: 1075
  Gene Symbol: ANKIB1
  Gene Name: ankyrin repeat and IBR domain containing 1
  ENST ID: ENST00000439883
  CDS Start-End: 1-487
gacttttcttggtagagatggaaatccaaataaacggaatgtgcacaatgaaacatctatgcatttgttgtgtatgggacctcaaattatgatatctgaaggagcccttcatcctcgcttggcacgccccacagaagatgatttcagaagagcagattgtctgcagatgatcttaaaatggaaaggagcaaaacttgaccagggtgaatatgagagagcagctattgatgctgttgataacaaaaaaaacacacccttgcactatgctgctgcctcagggatgaaagcctgtgtagagcttttagtaaaacatggaggagacttgtttgctgagaatgaaaataaagatactccttgtgattgtgctgaaaagcaacaccacaaagatttggccctcaatctggaatctcaaatggtattctcacgggatcccgaggctgaagaaatagaagctgaatatgctgcattagacaaacgagagtactgactgctttgaaggttattgctggtttgtttagtctgaaaatggaagcagtttatctttgcaacaggaaagagaaagccatatgaaggattaaggcctcaggatcttcgtagactaaaagatatgcttattgtggaaactgcagacatgcttcaggctcctctctttactgctgaagctttacttcgagctcatgactgggacagggagaaattacttgaagcttggatgtccaacccggagaactgctgccaacgatcaggtgttcaaatgccaactccaccaccaag

SEQ ID NO: 107386 - DNA, 2062 bp, Homo sapiens
  Payload ID: 1076
  Gene Symbol: ANKHD1
  Gene Name: ankyrin repeat and KH domain containing 1
  ENST ID: ENST00000246149
  CDS Start-End: 1-2062
ttaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagacaagcaggaggacatgaagactattttggagggcatagatccggccaagcatcaggaacatgaatctgaaggtggaagaacacctttgatgaaagctgcaagagctggtcatttgtgcactgtgcagtttcttattagcaaaggtgccaatgttaacagggctacagccaataatgatcatacagtagtgtcgctggcatgtgcaggaggccacctggcagttgttgagcttctcttggctcatggggctgaccctactcatcgactcaaggatggttcaacaatgctcattgaagctgcaaagggtggccatactaatgtagtttcttatctgttggattatccaaataatgttctgtcagttcccaccacagatgtgtctcagctccctccaccttctcaagatcagtctcaggaacctgacagaacttcacaggagaactctcctgcccttttaggagtgcaaaaagctgtgagtaccagagtgcccactggttccaacagttcttctcagaccacagagtgtcttacacctgaatcctgttcgcagactacaagcaatgtggcttcccaatcgatgcctcctgtgtatccttcagttgacattgatgcacatactgagagcaatcatgacacagcattaacactagcttgtgcaggtggtcatgaagaacttgtatctgtgctcattgcacgggatgccaaaattgaacacagagacaaaaaaggtttcacaccactaatcctggcagcaacagcagggcatgttggagttgttgaaatccttttggataaaggtggagatatagaagcacagtctgaacgaactaaggatactccgctttcattggcatgttctggtggacgtcaggaggtggtagacttgctgctggctcgaggtgcaaataaagaacataggaacgtatctgattatacaccactgagtctagctgcgtctggaggatatgttaatatcattaagattctgcttaatgctggggcagaaattaattcaaggactgggagtaaactaggtatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaagggtcatgtaaaagttgttcaatatttggtaaaggaagtaaatcagttcccttctgatatagaatgcatgagatacatagcaacaattacagataaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaa

SEQ ID NO: 107387 - DNA, 7606 bp, Homo sapiens
  Payload ID: 1076
  Gene Symbol: ANKHD1
  Gene Name: ankyrin repeat and KH domain containing 1
  ENST ID: ENST00000297183
  CDS Start-End: 5006-7606
gggaggcagcaggttaggcagtgagaagttagtggcgctgctgggacgggggaaaggagacgcttcttcctcttgctgctcttctcgttcccgagatcagcggcggcggtgaccgcgagtgggtcggcaccgtctccggctccgggtgcgaacaatgctgactgatagcggaggcggcggcacctcctttgaggaggacctggactctgtggctccgcgatccgccccagctggggcctcggagccgcctccgccgggaggggtcggtctggggatccgcaccgtgaggctctttggggaggccgggccagcgtcgggagtcggcagcagcggcggcggcggcagcggcagcggtacgggcggaggggacgcggcgctggatttcaagttggcggctgccgtgctgaggaccgggggtggaggtggtgcctctggcagtgacgaggacgaagtgtccgaggttgaatcatttattttggaccaagaagatctggataacccagtgcttaaaacaacatcagagatattcttatcaagtactgcagaaggagcagacttacgcactgtggatccagagacacaggcacgactagaagcattgctagaagcagcaggaattggcaaattgtcaactgctgatggtaaagcttttgcagatcctgaggtactccggagactgacatcctcagttagttgtgcactggatgaagctgctgctgcactgacacggatgaaagcagaaaacagccacaatgcaggacaagtggacactcgcagtctagcagaagcttgttcagatggggatgttaatgctgttcgtaaattgctagatgaaggcagaagtgtaaatgaacatacagaagaaggagaaagcctgctgtgtttggcttgttcagcagggtattatgaattagcacaagtattgcttgctatgcatgctaatgttgaagatcgagggaataaaggagacataactcccctgatggcagcttccagtggaggttacttagatattgtgaaattattacttcttcatgatgctgatgtcaactcccagtctgcaacaggaaacactgcgctaacttatgcatgtgctggaggatttgttgacattgttaaagtgctccttaatgaaggtgcaaatatagaagatcataatgaaaatggacatactcccttaatggaagcagccagtgcaggtcatgtggaagttgcaagagttcttttagatcatggtgcaggcatcaacactcattctaatgaattcaaagaaagtgctctaacacttgcttgctacaaaggccatttggatatggttcgctttctacttgaagctggtgcagatcaagagcacaaaacagatgagatgcacactgccttaatggaggcctgcatggatggacatgtagaggtggcacgtttgcttttggatagtggtgctcaagtgaacatgcctgcagattcatttgaatctccattgacgctagctgcctgtggaggacatgttgaattggcagctctacttattgaaaggggagcaaatcttgaagaagttaatgatgaaggatacactcccttgatggaagctgcccgggaaggacatgaagaaatggtggcactactcttagcacaaggagcaaatataaatgcccagacagaagaaactcaagaaactgctcttactttggcttgctgtggaggattttctgaagttgcagactttcttattaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagaacatgaatctgaaggtggaagaacacctttgatgaaagctgcaagagctggtcatttgtgcactgtgcagtttcttattagcaaaggtgccaatgttaacagggctacagccaataatgatcatacagtagtgtcgctggcatgtgcaggaggccacctggcagttgttgagcttctcttggctcatggggctgaccctactcatcgactcaaggatggttcaacaatgctcattgaagctgcaaagggtggccatactaatgtagtttcttatctgttggattatccaaataatgttctgtcagttcccaccacagatgtgtctcagctccctccaccttctcaagatcagtctcaggtgccacgtgtgccaacgcatacacttgccatggttgtacctccccaggaacctgacagaacttcacaggagaactctcctgcccttttaggagtgcaaaaaggtacatccaagcagaagtccagttccctccaggtagcagatcaggacctactgccatcttttcacccataccagcctttggagtgcatagtagaggagactgaaggcaagctgaatgaactgggacaaagaattagtgctattgaaaaagcacagcttaagtcactggagttaattcaaggtgaacctctgaacaaagataagatagaagaacttaaaaagaacagagaagagcaagtccagaagaagaagaaaatattgaaagaactgcagaaagtggaaaggcagttgcagatgaaaacacagcagcaatttaccaaagaatacttggaaaccaaaggtcagaaagacacagtgtctctacaccaacagtgctctcatagaggagtcttcccagaaggggaaggagatggtagtctcccagaggatcacttttcagagttacctcaggttgacacaatcttatttaaagataatgatgttgatgatgagcaacagtctccaccatcggcagaacagattgattttgtcccagtccagcctttatcatctccacagtgtaacttttccagtgacttaggttctaatgggacaaattctcttgaacttcagaaagtatcaggtaatcagcagattgtaggacagcctcagattgctattactggacatgatcaggggctgttagttcaagaaccagatggactaatggttgcaactccagctcagacgcttaccgacactcttgatgacctgatagcagctgtgagtaccagagtgcccactggttccaacagttcttctcagaccacagagtgtcttacacctgaatcctgttcgcagactacaagcaatgtggcttcccaatcgatgcctcctgtgtatccttcagttgacattgatgcacatactgagagcaatcatgacacagcattaacactagcttgtgcaggtggtcatgaagaacttgtatctgtgctcattgcacgggatgccaaaattgaacacagagacaaaaaaggtttcacaccactaatcctggcagcaacagcagggcatgttggagttgttgaaatccttttggataaaggtggagatatagaagcacagtctgaacgaactaaggatactccgctttcattggcatgttctggtggacgtcaggaggtggtagacttgctgctggctcgaggtgcaaataaagaacataggaacgtatctgattatacaccactgagtctagctgcgtctggaggatatgttaatatcattaagattctgcttaatgctggggcagaaattaattcaaggactgggagtaaactaggtatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaagggtcatgtaaaagttgttcaatatttggtaaaggaagtaaatcagttcccttctgatatagaatgcatgagatacatagcaacaattacagataaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttgccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatggcaagtggttttgtggatttttctaaaggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcagatttggcctggcacgtgggcacctcatattggaaacatgcatctcaaatatgtcaactaa

SEQ ID NO: 107388 - DNA, 8221 bp, Homo sapiens
  Payload ID: 1076
  Gene Symbol: ANKHD1
  Gene Name: ankyrin repeat and KH domain containing 1
  Uniprot ID: Q8IWZ3
  ENST ID: ENST00000360839
  CDS Start-End: 155-7783
gggaggcagcaggttaggcagtgagaagttagtggcgctgctgggacgggggaaaggagacgcttcttcctcttgctgctcttctcgttcccgagatcagcggcggcggtgaccgcgagtgggtcggcaccgtctccggctccgggtgcgaacaatgctgactgatagcggaggcggcggcacctcctttgaggaggacctggactctgtggctccgcgatccgccccagctggggcctcggagccgcctccgccgggaggggtcggtctggggatccgcaccgtgaggctctttggggaggccgggccagcgtcgggagtcggcagcagcggcggcggcggcagcggcagcggtacgggcggaggggacgcggcgctggatttcaagttggcggctgccgtgctgaggaccgggggtggaggtggtgcctctggcagtgacgaggacgaagtgtccgaggttgaatcatttattttggaccaagaagatctggataacccagtgcttaaaacaacatcagagatattcttatcaagtactgcagaaggagcagacttacgcactgtggatccagagacacaggcacgactagaagcattgctagaagcagcaggaattggcaaattgtcaactgctgatggtaaagcttttgcagatcctgaggtactccggagactgacatcctcagttagttgtgcactggatgaagctgctgctgcactgacacggatgaaagcagaaaacagccacaatgcaggacaagtggacactcgcagtctagcagaagcttgttcagatggggatgttaatgctgttcgtaaattgctagatgaaggcagaagtgtaaatgaacatacagaagaaggagaaagcctgctgtgtttggcttgttcagcagggtattatgaattagcacaagtattgcttgctatgcatgctaatgttgaagatcgagggaataaaggagacataactcccctgatggcagcttccagtggaggttacttagatattgtgaaattattacttcttcatgatgctgatgtcaactcccagtctgcaacaggaaacactgcgctaacttatgcatgtgctggaggatttgttgacattgttaaagtgctccttaatgaaggtgcaaatatagaagatcataatgaaaatggacatactcccttaatggaagcagccagtgcaggtcatgtggaagttgcaagagttcttttagatcatggtgcaggcatcaacactcattctaatgaattcaaagaaagtgctctaacacttgcttgctacaaaggccatttggatatggttcgctttctacttgaagctggtgcagatcaagagcacaaaacagatgagatgcacactgccttaatggaggcctgcatggatggacatgtagaggtggcacgtttgcttttggatagtggtgctcaagtgaacatgcctgcagattcatttgaatctccattgacgctagctgcctgtggaggacatgttgaattggcagctctacttattgaaaggggagcaaatcttgaagaagttaatgatgaaggatacactcccttgatggaagctgcccgggaaggacatgaagaaatggtggcactactcttagcacaaggagcaaatataaatgcccagacagaagaaactcaagaaactgctcttactttggcttgctgtggaggattttctgaagttgcagactttcttattaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagaacatgaatctgaaggtggaagaacacctttgatgaaagctgcaagagctggtcatttgtgcactgtgcagtttcttattagcaaaggtgccaatgttaacagggctacagccaataatgatcatacagtagtgtcgctggcatgtgcaggaggccacctggcagttgttgagcttctcttggctcatggggctgaccctactcatcgactcaaggatggttcaacaatgctcattgaagctgcaaagggtggccatactaatgtagtttcttatctgttggattatccaaataatgttctgtcagttcccaccacagatgtgtctcagctccctccaccttctcaagatcagtctcaggtgccacgtgtgccaacgcatacacttgccatggttgtacctccccaggaacctgacagaacttcacaggagaactctcctgcccttttaggagtgcaaaaaggtacatccaagcagaagtccagttccctccaggtagcagatcaggacctactgccatcttttcacccataccagcctttggagtgcatagtagaggagactgaaggcaagctgaatgaactgggacaaagaattagtgctattgaaaaagcacagcttaagtcactggagttaattcaaggtgaacctctgaacaaagataagatagaagaacttaaaaagaacagagaagagcaagtccagaagaagaagaaaatattgaaagaactgcagaaagtggaaaggcagttgcagatgaaaacacagcagcaatttaccaaagaatacttggaaaccaaaggtcagaaagacacagtgtctctacaccaacagtgctctcatagaggagtcttcccagaaggggaaggagatggtagtctcccagaggatcacttttcagagttacctcaggttgacacaatcttatttaaagataatgatgttgatgatgagcaacagtctccaccatcggcagaacagattgattttgtcccagtccagcctttatcatctccacagtgtaacttttccagtgacttaggttctaatgggacaaattctcttgaacttcagaaagtatcaggtaatcagcagattgtaggacagcctcagattgctattactggacatgatcaggggctgttagttcaagaaccagatggactaatggttgcaactccagctcagacgcttaccgacactcttgatgacctgatagcagctgtgagtaccagagtgcccactggttccaacagttcttctcagaccacagagtgtcttacacctgaatcctgttcgcagactacaagcaatgtggcttcccaatcgatgcctcctgtgtatccttcagttgacattgatgcacatactgagagcaatcatgacacagcattaacactagcttgtgcaggtggtcatgaagaacttgtatctgtgctcattgcacgggatgccaaaattgaacacagagacaaaaaaggtttcacaccactaatcctggcagcaacagcagggcatgttggagttgttgaaatccttttggataaaggtggagatatagaagcacagtctgaacgaactaaggatactccgctttcattggcatgttctggtggacgtcaggaggtggtagacttgctgctggctcgaggtgcaaataaagaacataggaacgtatctgattatacaccactgagtctagctgcgtctggaggatatgttaatatcattaagattctgcttaatgctggggcagaaattaattcaaggactgggagtaaactaggtatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaagggtcatgtaaaagttgttcaatatttggtaaaggaagtaaatcagttcccttctgatatagaatgcatgagatacatagcaacaattacagataaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttgggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatggcaagtggttttgtggatttttctaaaggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcagatttggcctggcacgtgggcacctcatattggaaacatgcatctcaaatatgtcaactaagttagaaggtctttactctttagccttgtttaagaaacctatgaccttggaagaaccatggggatttttttttaatgtgcctaagaaattttctctgaggctttagcaatggaaatttgattgcccattgtataagaacaaattgatttcctatccacctgattatgttctctggttagtttagccattttgaacttaagatcatatgaccttagtgcttttggctaaacatacagaatactacttgtatgcagaagagaattagttgattacatgtttcaaccttttagggtgataaatacatgtataattgtttacatacttaaaaggaaaaagttgagtaaatttcttgtcatatagtggctctacgtaatgtagcctgtattaatgtgaaatatttaccagaatattcaataaaaagatgaacagtctttagaa

SEQ ID NO: 107389 - DNA, 2035 bp, Homo sapiens
  Payload ID: 1076
  Gene Symbol: ANKHD1
  Gene Name: ankyrin repeat and KH domain containing 1
  Uniprot ID: Q8IWZ3
  ENST ID: ENST00000394722
  CDS Start-End: 48-1898
ggtgaccgcgagtgggtcggcaccgtctccggctccgggtgcgaacaatgctgactgatagcggaggcggcggcacctcctttgaggaggacctggactctgtggctccgcgatccgccccagctggggcctcggagccgcctccgccgggaggggtcggtctggggatccgcaccgtgaggctctttggggaggccgggccagcgtcgggagtcggcagcagcggcggcggcggcagcggcagcggtacgggcggaggggacgcggcgctggatttcaagttggcggctgccgtgctgaggaccgggggtggaggtggtgcctctggcagtgacgaggacgaagtgtccgaggttgaatcatttattttggaccaagaagatctggataacccagtgcttaaaacaacatcagagatattcttatcaagtactgcagaaggagcagacttacgcactgtggatccagagacacaggcacgactagaagcattgctagaagcagcagcttttgcagatcctgaggtactccggagactgacatcctcagttagttgtgcactggatgaagctgctgctgcactgacacggatgaaagcagaaaacagccacaatgcaggacaagtggacactcgcagtctagcagaagcttgttcagatggggatgttaatgctgttcgtaaattgctagatgaaggcagaagtgtaaatgaacatacagaagaaggagaaagcctgctgtgtttggcttgttcagcagggtattatgaattagcacaagtattgcttgctatgcatgctaatgttgaagatcgagggaataaaggagacataactcccctgatggcagcttccagtggaggttacttagatattgtgaaattattacttcttcatgatgctgatgtcaactcccagtctgcaacaggaaacactgcgctaacttatgcatgtgctggaggatttgttgacattgttaaagtgctccttaatgaaggtgcaaatatagaagatcataatgaaaatggacatactcccttaatggaagcagccagtgcaggtcatgtggaagttgcaagagttcttttagatcatggtgcaggcatcaacactcattctaatgaattcaaagaaagtgctctaacacttgcttgctacaaaggccatttggatatggttcgctttctacttgaagctggtgcagatcaagagcacaaaacagatgagatgcacactgccttaatggaggcctgcatggatggacatgtagaggtggcacgtttgcttttggatagtggtgctcaagtgaacatgcctgcagattcatttgaatctccattgacgctagctgcctgtggaggacatgttgaattggcagctctacttattgaaaggggagcaaatcttgaagaagttaatgatgaaggatacactcccttgatggaagctgcccgggaaggacatgaagaaatggtggcactactcttagcacaaggagcaaatataaatgcccagacagaagaaactcaagaaactgctcttactttggcttgctgtggaggattttctgaagttgcagactttcttattaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagacaagcaggaggacatgaagactattttggagggcatagatccggccaagcatcaggtgagggtggcctttgatgcttgtaagctactacgtaaagaatagatgttgtaggtaaccagaactctggatatctgaattccagccaagaagttccaggaccctgctgggtgacaaaggaaatcctcttcaattgaaaaagattatgaagtcccaataaaaagagatttgtattgctggta

SEQ ID NO: 107390 - DNA, 2135 bp, Homo sapiens
  Payload ID: 1076
  Gene Symbol: ANKHD1
  Gene Name: ankyrin repeat and KH domain containing 1
  Uniprot ID: Q8IWZ3
  ENST ID: ENST00000394723
  CDS Start-End: 115-1998
ctgggacgggggaaaggagacgcttcttcctcttgctgctcttctcgttcccgagatcagcggcggcggtgaccgcgagtgggtcggcaccgtctccggctccgggtgcgaacaatgctgactgatagcggaggcggcggcacctcctttgaggaggacctggactctgtggctccgcgatccgccccagctggggcctcggagccgcctccgccgggaggggtcggtctggggatccgcaccgtgaggctctttggggaggccgggccagcgtcgggagtcggcagcagcggcggcggcggcagcggcagcggtacgggcggaggggacgcggcgctggatttcaagttggcggctgccgtgctgaggaccgggggtggaggtggtgcctctggcagtgacgaggacgaagtgtccgaggttgaatcatttattttggaccaagaagatctggataacccagtgcttaaaacaacatcagagatattcttatcaagtactgcagaaggagcagacttacgcactgtggatccagagacacaggcacgactagaagcattgctagaagcagcaggaattggcaaattgtcaactgctgatggtaaagcttttgcagatcctgaggtactccggagactgacatcctcagttagttgtgcactggatgaagctgctgctgcactgacacggatgaaagcagaaaacagccacaatgcaggacaagtggacactcgcagtctagcagaagcttgttcagatggggatgttaatgctgttcgtaaattgctagatgaaggcagaagtgtaaatgaacatacagaagaaggagaaagcctgctgtgtttggcttgttcagcagggtattatgaattagcacaagtattgcttgctatgcatgctaatgttgaagatcgagggaataaaggagacataactcccctgatggcagcttccagtggaggttacttagatattgtgaaattattacttcttcatgatgctgatgtcaactcccagtctgcaacaggaaacactgcgctaacttatgcatgtgctggaggatttgttgacattgttaaagtgctccttaatgaaggtgcaaatatagaagatcataatgaaaatggacatactcccttaatggaagcagccagtgcaggtcatgtggaagttgcaagagttcttttagatcatggtgcaggcatcaacactcattctaatgaattcaaagaaagtgctctaacacttgcttgctacaaaggccatttggatatggttcgctttctacttgaagctggtgcagatcaagagcacaaaacagatgagatgcacactgccttaatggaggcctgcatggatggacatgtagaggtggcacgtttgcttttggatagtggtgctcaagtgaacatgcctgcagattcatttgaatctccattgacgctagctgcctgtggaggacatgttgaattggcagctctacttattgaaaggggagcaaatcttgaagaagttaatgatgaaggatacactcccttgatggaagctgcccgggaaggacatgaagaaatggtggcactactcttagcacaaggagcaaatataaatgcccagacagaagaaactcaagaaactgctcttactttggcttgctgtggaggattttctgaagttgcagactttcttattaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagacaagcaggaggacatgaagactattttggagggcatagatccggccaagcatcaggtgagggtggcctttgatgcttgtaagctactacgtaaagaatagatgttgtaggtaaccagaactctggatatctgaattccagccaagaagttccaggaccctgctgggtgacaaaggaaatcctcttcaattgaaaaagattatgaagtcccaataaaaagagatttgtattgctggta

SEQ ID NO: 107391 - DNA, 3649 bp, Homo sapiens
  Payload ID: 1076
  Gene Symbol: ANKHD1
  Gene Name: ankyrin repeat and KH domain containing 1
  ENST ID: ENST00000433049
  CDS Start-End: 1-3219
cctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttgggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatgtgactctcctattccatctgtttcttcgggatcatcttcacctctttcagccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatgggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcagatttggcctggcacgtgggcacctcatattggaaacatgcatctcaaatatgtcaactaagttagaaggtctttactctttagccttgtttaagaaacctatgaccttggaagaaccatggggatttttttttaatgtgcctaagaaattttctctgaggctttagcaatggaaatttgattgcccattgtataagaacaaattgatttcctatccacctgattatgttctctggttagtttagccattttgaacttaagatcatatgaccttagtgcttttggctaaacatacagaatactacttgtatgcagaagagaattagttgattacatgtttcaaccttttagggtgataaatacatgtataattgtttacatacttaaaaggaaaaagttgagtaaatttcttgtcatatagtggctctacgtaatgtagcctgtattaatgtgaaatatttaccagaatattcaataaaaagatgaacagt

SEQ ID NO: 107392 - DNA, 4079 bp, Homo sapiens
  Payload ID: 1076
  Gene Symbol: ANKHD1
  Gene Name: ankyrin repeat and KH domain containing 1
  ENST ID: ENST00000431508
  CDS Start-End: 1-3648
gtgcaagcaggtgctgatgtggatgcagcagataaccggaaaatcacacctcttatgtcagcatttcgcaagggtcatgtaaaagttgttcaatatttggtaaaggaagtaaatcagttcccttctgatatagaatgcatgagatacatagcaacaattacagataaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttgggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatgtgactctcctattccatctgtttcttcgggatcatcttcacctctttcagccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatggcaagtggttttgtggatttttctaaaggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcagatttggcctggcacgtgggcacctcatattggaaacatgcatctcaaatatgtcaactaagttagaaggtctttactctttagccttgtttaagaaacctatgaccttggaagaaccatggggatttttttttaatgtgcctaagaaattttctctgaggctttagcaatggaaatttgattgcccattgtataagaacaaattgatttcctatccacctgattatgttctctggttagtttagccattttgaacttaagatcatatgaccttagtgcttttggctaaacatacagaatactacttgtatgcagaagagaattagttgattacatgtttcaaccttttagggtgataaatacatgtataattgtttacatacttaaaaggaaaaagttgagtaaatttcttgtcatatagtggctctacgtaatgtagcctgtattaatgtgaaatatttaccagaatattcaataaaaagatgaacagtc

SEQ ID NO: 107393 - DNA, 4814 bp, Homo sapiens
  Payload ID: 1076
  Gene Symbol: ANKHD1
  Gene Name: ankyrin repeat and KH domain containing 1
  ENST ID: ENST00000421134
  CDS Start-End: 119-4814
gctgctgggacgggggaaaggagacgcttcttcctcttgctgctcttctcgttcccgagatcagcggcggcggtgaccgcgagtgggtcggcaccgtctccggctccgggtgcgaacaatgctgactgatagcggaggcggcggcacctcctttgaggaggacctggactctgtggctccgcgatccgccccagctggggcctcggagccgcctccgccgggaggggtcggtctggggatccgcaccgtgaggctctttggggaggccgggccagcgtcgggagtcggcagcagcggcggcggcggcagcggcagcggtacgggcggaggggacgcggcgctggatttcaagttggcggctgccgtgctgaggaccgggggtggaggtggtgcctctggcagtgacgaggacgaagtgtccgaggttgaatcatttattttggaccaagaagatctggataacccagtgcttaaaacaacatcagagatattcttatcaagtactgcagaaggagcagacttacgcactgtggatccagagacacaggcacgactagaagcattgctagaagcagcaggaattggcaaattgtcaactgctgatggtaaagcttttgcagatcctgaggtactccggagactgacatcctcagttagttgtgcactggatgaagctgctgctgcactgacacggatgaaagcagaaaacagccacaatgcaggacaagtggacactcgcagtctagcagaagcttgttcagatggggatgttaatgctgttcgtaaattgctagatgaaggcagaagtgtaaatgaacatacagaagaaggagaaagcctgctgtgtttggcttgttcagcagggtattatgaattagcacaagtattgcttgctatgcatgctaatgttgaagatcgagggaataaaggagacataactcccctgatggcagcttccagtggaggttacttagatattgtgaaattattacttcttcatgatgctgatgtcaactcccagtctgcaacaggaaacactgcgctaacttatgcatgtgctggaggatttgttgacattgttaaagtgctccttaatgaaggtgcaaatatagaagatcataatgaaaatggacatactcccttaatggaagcagccagtgcaggtcatgtggaagttgcaagagttcttttagatcatggtgcaggcatcaacactcattctaatgaattcaaagaaagtgctctaacacttgcttgctacaaaggccatttggatatggttcgctttctacttgaagctggtgcagatcaagagcacaaaacagatgagatgcacactgccttaatggaggcctgcatggatggacatgtagaggtggcacgtttgcttttggatagtggtgctcaagtgaacatgcctgcagattcatttgaatctccattgacgctagctgcctgtggaggacatgttgaattggcagctctacttattgaaaggggagcaaatcttgaagaagttaatgatgaaggatacactcccttgatggaagctgcccgggaaggacatgaagaaatggtggcactactcttagcacaaggagcaaatataaatgcccagacagaagaaactcaagaaactgctcttactttggcttgctgtggaggattttctgaagttgcagactttcttattaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagacaagcaggaggacatgaagactattttggagggcatagatccggccaagcatcaggaacatgaatctgaaggtggaagaacacctttgatgaaagctgcaagagctggtcatttgtgcactgtgcagtttcttattagcaaaggtgccaatgttaacagggctacagccaataatgatcatacagtagtgtcgctggcatgtgcaggaggccacctggcagttgttgagcttctcttggctcatggggctgaccctactcatcgactcaaggatggttcaacaatgctcattgaagctgcaaagggtggccatactaatgtagtttcttatctgttggattatccaaataatgttctgtcagttcccaccacagatgtgtctcagctccctccaccttctcaagatcagtctcaggtgccacgtgtgccaacgcatacacttgccatggttgtacctccccaggaacctgacagaacttcacaggagaactctcctgcccttttaggagtgcaaaaaggtacatccaagcagaagtccagttccctccaggtagcagatcaggacctactgccatcttttcacccataccagcctttggagtgcatagtagaggagactgaaggcaagctgaatgaactgggacaaagaattagtgctattgaaaaagcacagcttaagtcactggagttaattcaaggtgaacctctgaacaaagataagatagaagaacttaaaaagaacagagaagagcaagtccagaagaagaagaaaatattgaaagaactgcagaaagtggaaaggcagttgcagatgaaaacacagcagcaatttaccaaagaatacttggaaaccaaaggtcagaaagacacagtgtctctacaccaacagtgctctcatagaggagtcttcccagaaggggaaggagatggtagtctcccagaggatcacttttcagagttacctcaggttgacacaatcttatttaaagataatgatgttgatgatgagcaacagtctccaccatcggcagaacagattgattttgtcccagtccagcctttatcatctccacagtgtaacttttccagtgacttaggttctaatgggacaaattctcttgaacttcagaaagtatcaggtaatcagcagattgtaggacagcctcagattgctattactggacatgatcaggggctgttagttcaagaaccagatggactaatggttgcaactccagctcagacgcttaccgacactcttgatgacctgatagcagctgtgagtaccagagtgcccactggttccaacagttcttctcagaccacagagtgtcttacacctgaatcctgttcgcagactacaagcaatgtggcttcccaatcgatgcctcctgtgtatccttcagttgacattgatgcacatactgagagcaatcatgacacagcattaacactagcttgtgcaggtggtcatgaagaacttgtatctgtgctcattgcacgggatgccaaaattgaacacagagacaaaaaaggtttcacaccactaatcctggcagcaacagcagggcatgttggagttgttgaaatccttttggataaaggtggagatatagaagcacagtctgaacgaactaaggatactccgctttcattggcatgttctggtggacgtcaggaggtggtagacttgctgctggctcgaggtgcaaataaagaacataggaacgtatctgattatacaccactgagtctagctgcgtctggaggatatgttaatatcattaagattctgcttaatgctggggcagaaattaattcaaggactgggagtaaactaggtatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaagggtcatgtaaaagttgttcaatatttggtaaaggaagtaaatcagttcccttctgatatagaatgcatgagatacatagcaacaattacagataaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataaga

SEQ ID NO: 107394 - DNA, 801 bp, Homo sapiens
  Payload ID: 1076
  Gene Symbol: ANKHD1
  Gene Name: ankyrin repeat and KH domain containing 1
  ENST ID: ENST00000421706
  CDS Start-End: 1-557
ccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatggcaagtggttttgtggatttttctaaaggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcaggtaaaatgggcttaatgctcttttgttttttagatttgtcacatcattctttttgttttgtgagaagtataagtactgaatatcaaaagtcataattgaccatttcgatctggattgctttttcaatatcaagatgatgctactgaacactttatttaatatatgtgtattcttcctaggcagaaacagtgaattgccattgcatttatatattcattttgtaactgtctaaagattcctaattagaaattccaatttt

SEQ ID NO: 107395 - DNA, 1826 bp, Homo sapiens
  Payload ID: 1076
  Gene Symbol: ANKHD1
  Gene Name: ankyrin repeat and KH domain containing 1
  ENST ID: ENST00000412116
  CDS Start-End: 1-1826
gaacatgaatctgaaggtggaagaacacctttgatgaaagctgcaagagctggtcatttgtgcactgtgcagtttcttattagcaaaggtgccaatgttaacagggctacagccaataatgatcatacagtagtgtcgctggcatgtgcaggaggccacctggcagttgttgagcttctcttggctcatggggctgaccctactcatcgactcaaggatggttcaacaatgctcattgaagctgcaaagggtggccatactaatgtagtttcttatctgttggattatccaaataatgttctgtcagttcccaccacagatgtgtctcagctccctccaccttctcaagatcagtctcaggtgccacgtgtgccaacgcatacacttgccatggttgtacctccccaggaacctgacagaacttcacaggagaactctcctgcccttttaggagtgcaaaaagctgtgagtaccagagtgcccactggttccaacagttcttctcagaccacagagtgtcttacacctgaatcctgttcgcagactacaagcaatgtggcttcccaatcgatgcctcctgtgtatccttcagttgacattgatgcacatactgagagcaatcatgacacagcattaacactagcttgtgcaggtggtcatgaagaacttgtatctgtgctcattgcacgggatgccaaaattgaacacagagacaaaaaaggtttcacaccactaatcctggcagcaacagcagggcatgttggagttgttgaaatccttttggataaaggtggagatatagaagcacagtctgaacgaactaaggatactccgctttcattggcatgttctggtggacgtcaggaggtggtagacttgctgctggctcgaggtgcaaataaagaacataggaacgtatctgattatacaccactgagtctagctgcgtctggaggatatgttaatatcattaagattctgcttaatgctggggcagaaattaattcaaggactgggagtaaactaggtatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaagggtcatgtaaaagttgttcaatatttggtaaaggaagtaaatcagttcccttctgatatagaatgcatgagatacatagcaacaattacagataaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaag

SEQ ID NO: 107396 - DNA, 3511 bp, Homo sapiens
  Payload ID: 1076
  Gene Symbol: ANKHD1
  Gene Name: ankyrin repeat and KH domain containing 1
  ENST ID: ENST00000435794
  CDS Start-End: 1-3073
caccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttgggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatgggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcagatttggcctggcacgtgggcacctcatattggaaacatgcatctcaaatatgtcaactaagttagaaggtctttactctttagccttgtttaagaaacctatgaccttggaagaaccatggggatttttttttaatgtgcctaagaaattttctctgaggctttagcaatggaaatttgattgcccattgtataagaacaaattgatttcctatccacctgattatgttctctggttagtttagccattttgaacttaagatcatatgaccttagtgcttttggctaaacatacagaatactacttgtatgcagaagagaattagttgattacatgtttcaaccttttagggtgataaatacatgtataattgtttacatacttaaaaggaaaaagttgagtaaatttcttgtcatatagtggctctacgtaatgtagcctgtattaatgtgaaatatttaccagaatattcaataaaaagatgaacagtctttagaa

SEQ ID NO: 107397 - DNA, 3234 bp, Homo sapiens
  Payload ID: 1076
  Gene Symbol: ANKHD1
  Gene Name: ankyrin repeat and KH domain containing 1
  ENST ID: ENST00000432301
  CDS Start-End: 1-2803
aaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttgccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatggcaagtggttttgtggatttttctaaaggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcagatttggcctggcacgtgggcacctcatattggaaacatgcatctcaaatatgtcaactaagttagaaggtctttactctttagccttgtttaagaaacctatgaccttggaagaaccatggggatttttttttaatgtgcctaagaaattttctctgaggctttagcaatggaaatttgattgcccattgtataagaacaaattgatttcctatccacctgattatgttctctggttagtttagccattttgaacttaagatcatatgaccttagtgcttttggctaaacatacagaatactacttgtatgcagaagagaattagttgattacatgtttcaaccttttagggtgataaatacatgtataattgtttacatacttaaaaggaaaaagttgagtaaatttcttgtcatatagtggctctacgtaatgtagcctgtattaatgtgaaatatttaccagaatattcaataaaaagatgaacagtc

SEQ ID NO: 107398 - DNA, 1216 bp, Homo sapiens
  Payload ID: 1076
  Gene Symbol: ANKHD1
  Gene Name: ankyrin repeat and KH domain containing 1
  ENST ID: ENST00000511151
  CDS Start-End: 113-1216
gggacgggggaaaggagacgcttcttcctcttgctgctcttctcgttcccgagatcagcggcggcggtgaccgcgagtgggtcggcaccgtctccggctccgggtgcgaacaatgctgactgatagcggaggcggcggcacctcctttgaggaggacctggactctgtggctccgcgatccgccccagctggggcctcggagccgcctccgccgggaggggtcggtctggggatccgcaccgtgaggctctttggggaggccgggccagcgtcgggagtcggcagcagcggcggcggcggcagcggcagcggtacgggcggaggggacgcggcgctggatttcaagttggcggctgccgtgctgaggaccgggggtggaggtggtgcctctggcagtgacgaggacgaagtgtccgaggttgaatcatttattttggaccaagaagatctggataacccagtgcttaaaacaacatcagagatattcttatcaagtactgcagaaggagcagacttacgcactgtggatccagagacacaggcacgactagaagcattgctagaagcagcagatcctgaggtactccggagactgacatcctcagttagttgtgcactggatgaagctgctgctgcactgacacggatgaaagcagaaaacagccacaatgcaggacaagtggacactcgcagtctagcagaagcttgttcagatggggatgttaatgctgttcgtaaattgctagatgaaggcagaagtgtaaatgaacatacagaagaaggagaaagcctgctgtgtttggcttgttcagcagggtattatgaattagcacaagtattgcttgctatgcatgctaatgttgaagatcgagggaataaaggagacataactcccctgatggcagcttccagtggaggttacttagatattgtgaaattattacttcttcatgatgctgatgtcaactcccagtctgcaacaggaaacactgcgctaacttatgcatgtgctggaggatttgttgacattgttaaagtgctccttaatgaaggtgcaaatatagaagatcataatgaaaatggacatactcccttaatggaagcagccagtgcaggtcatgtggaagttgcaagagttcttttagatcatggtgcaggcatcaacactcattctaatgaattcaaagaaagtgctctaacacttgcttgctacaaa

SEQ ID NO: 107399 - DNA, 2064 bp, Homo sapiens
  Payload ID: 1076
  Gene Symbol: ANKHD1
  Gene Name: ankyrin repeat and KH domain containing 1
  Uniprot ID: Q8IWZ3
  ENST ID: ENST00000616482
  CDS Start-End: 155-1900
gggaggcagcaggttaggcagtgagaagttagtggcgctgctgggacgggggaaaggagacgcttcttcctcttgctgctcttctcgttcccgagatcagcggcggcggtgaccgcgagtgggtcggcaccgtctccggctccgggtgcgaacaatgctgactgatagcggaggcggcggcacctcctttgaggaggacctggactctgtggctccgcgatccgccccagctggggcctcggagccgcctccgccgggaggggtcggtctggggatccgcaccgtgaggctctttggggaggccgggccagcgtcgggagtcggcagcagcggcggcggcggcagcggcagcggtacgggcggaggggacgcggcgctggatttcaagttggcggctgccgtgctgaggaccgggggtggaggtggtgcctctggcagtgacgaggacgaagtgtccgaggttgaatcatttattttggaccaagaagatctggataacccagtgcttaaaacaacatcagagatattcttatcaagtactgcagaaggagcagacttacgcactgtggatccagagacacaggcacgactagaagcattgctagaagcagcaggaattggcaaattgtcaactgctgatggtaaagcttttgcagatcctgaggtactccggagactgacatcctcagttagttgtgcactggatgaagctgctgctgcactgacacggatgaaagcagaaaacagccacaatgcaggacaagtggacactcgcagtctagcagaagcttgttcagatggggatgttaatgctgttcgtaaattgctagatgaaggcagaagtgtaaatgaacatacagaagaaggagaaagcctgctgtgtttggcttgttcagcagggtattatgaattagcacaagtattgcttgctatgcatgctaatgttgaagatcgagggaataaaggagacataactcccctgatggcagcttccagtggaggttacttagatattgtgaaattattacttcttcatgatgctgatgtcaactcccagtctgcaacaggaaacactgcgctaacttatgcatgtgctggaggatttgttgacattgttaaagtgctccttaatgaaggtgcaaatatagaagatcataatgaaaatggacatactcccttaatggaagcagccagtgcaggtcatgtggaagttgcaagagttcttttagatcatggtgcaggcatcaacactcattctaatgaattcaaagaaagtgctctaacacttgcttgctacaaaggccatttggatatggttcgctttctacttgaagctggtgcagatcaagagcacaaaacagatgagatgcacactgccttaatggaggcctgcatggatggacatgtagaggtggcacgtttgcttttggatagtggtgctcaagtgaacatgcctgcagattcatttgaatctccattgacgctagctgcctgtggaggacatgttgaattggcagctctacttattgaaaggggagcaaatcttgaagaagttaatgatgaaggatacactcccttgatggaagctgcccgggaaggacatgaagaaatggtggcactactcttagcacaaggagcaaatataaatgcccagacagaagaaactcaagaaactgctcttactttggcttgctgtggaggattttctgaagttgcagactttcttattaaggcaggggctgatatagaacttggctgctccacacctctgatggaggcatctcaggagggacacctggaattggttaaatatttgctggcttctggacaagcaggaggacatgaagactattttggagggcatagatccggccaagcatcaggtgagggtggcctttgatgcttgtaagctactacgtaaagaatagatgttgtaggtaaccagaactctggatatctgaattccagccaagaagttccaggaccctgctgggtgacaaaggaaatcctcttcaattgaaaaagattatgaagtcccaataaaaagagatttgtattgctggt

SEQ ID NO: 107400 - DNA, 2543 bp, Homo sapiens
  Payload ID: 1077
  Gene Symbol: ANKK1
  Gene Name: ankyrin repeat and kinase domain containing 1
  Uniprot ID: Q8NFD2
  ENST ID: ENST00000303941
  CDS Start-End: 95-2392
cggacccgaggagcaggaagcggcggctccttcggccacccaggcagcagccacagcggggagtgcgcggcgcggggacaggaagagaggggcaatggctgccgaccccaccgagctgcggctgggcagcctccccgtcttcacccgcgacgacttcgagggcgactggcgcctagtggccagcggcggcttcagccaggtgttccaggcgcggcacaggcgctggcggacggagtacgccatcaagtgcgccccctgccttccacccgacgccgccagctctgatgtgaattacctcattgaagaagctgccaaaatgaagaagatcaagtttcagcacatcgtgtctatctacggggtgtgcaagcagcccctgggtattgtgatggagtttatggccaacggctccctggagaaggtgctgtccacccacagcctctgctggaagctcaggttccgcatcatccatgagaccagcttggccatgaacttcctgcacagcattaagccgcctctgctccacctggacctcaagccgggcaacatactcctggacagcaacatgcatgtcaaaatttcagacttcggcctgtccaagtggatggaacagtccacccggatgcagtacatcgagaggtcggctctgcggggcatgctcagctacatcccccctgagatgttcctggagagtaacaaggccccaggacctaaatatgatgtgtacagctttgcaattgtcatctgggagctactcactcagaagaaaccatactcagggttcaacatgatgatgattattatccgagtggcggcaggcatgcggccctccctacagcctgtctctgaccaatggccaagcgaggcccagcagatggtggacctgatgaaacgctgctgggaccaggaccccaagaagaggccatgctttctagacattaccatcgagacagacatactgctgtcactgctgcagagtcgtgtggcagtcccagagagcaaggccctggccaggaaggtgtcctgcaagctgtcgctgcgccagcccggggaggttaatgaggacatcagccaggaactgatggacagtgactcaggaaactacctgaagcgggcccttcagctctccgaccgtaagaatttggtcccgagagatgaggaactgtgtatctatgagaacaaggtcacccccctccacttcctggtggcccagggcagtgtggagcaggtgaggttgctgctggcccacgaggtagacgtggactgccagacggcctctggatacacgcccctcctgatcgccgcccaggaccagcaacccgacctctgtgccctgcttttggcacatggtgctgatgccaaccgagtggatgaggatggctgggccccactgcactttgcagcccagaatggggatgacggcactgcgcgcctgctcctggaccacggggcctgtgtggatgcccaggaacgtgaagggtggacccctcttcacctggctgcacagaataactttgagaatgtggcacggcttctggtctcccgtcaggctgaccccaacctgcatgaggctgagggcaagacccccctccatgtggccgcctactttggccatgttagcctggtcaagctgctgaccagccagggggctgagttggatgctcagcagagaaacctgagaacaccactgcacctggcagtagagcggggcaaagtgagggccatccaacacctgctgaagagtggagcggtccctgatgcccttgaccagagcggctacggcccactgcacactgcagctgccaggggcaaatacctgatctgcaagatgctgctcaggtacggagccagccttgagctgcccacccaccagggctggacacccctgcatctagcagcctacaagggccacctggagatcatccatctgctggcagagagccacgcaaacatgggtgctcttggagctgtgaactggactcccctgcacctagctgcacgccacggggaggaggcggtggtgtcagcactgctgcagtgtggggctgaccccaatgctgcagagcagtcaggctggacacccctccacctggcggtccagaggagcaccttcctgagtgtcatcaacctcctagaacatcacgcaaatgtccacgcccgcaacaaggtgggctggacacccgcccacctggccgccctcaagggcaacacagccatcctcaaagtgctggtcgaggcaggcgcccagctggacgtccaggatggagtgagctgcacacccctgcaactggccctccgcagccgaaagcagggcatcatgtccttcctagagggcaaggagccgtcagtggccactctgggtggttctaagccaggagccgagatggaaatttagacaacttggccagccgtggtggctcacgtctgtaatcccagcactttgggaggctgaggcaggcagatcacctgatatcaagagtttgaggccagcctggccaacatggcaaaaccctgtctctgctaaaaatacaaaatttagctgggta

SEQ ID NO: 107401 - DNA, 508 bp, Homo sapiens
  Payload ID: 1077
  Gene Symbol: ANKK1
  Gene Name: ankyrin repeat and kinase domain containing 1
  ENST ID: ENST00000542948
  CDS Start-End: 1-164
acagcctctgctggaagctcaggttccgcatcatccatgagaccagcttggccatgaacttcctgcacagcattaagccgcctctgctccacctggacctcaagccgggcaacatactcctggacagcaacatgcatgtcaaagtgaagaaactgaggctctgagaagataagtaatttggccaagaccatccagataatttcagacttcggcctgtccaagtggatggaacagtccacccggatgcagtacatcgagaggtcggctctgcggggcatgctcagctacatcccccctgagatgttcctggagagtaacaaggccccaggacctaaatatgatgtgtacagctttgcaattgtcatctgggagctactcactcagaagaaaccatactcagggttcaacatgatgatgattattatccgagtggcggcaggcatgcggccctccctacagcctgtctctgaccaatggccaagcgaggcccagcagatggtggacctga

SEQ ID NO: 107402 - DNA, 3218 bp, Homo sapiens
  Payload ID: 1078
  Gene Symbol: ANKLE1
  Gene Name: ankyrin repeat and LEM domain containing 1
  Uniprot ID: Q8NAG6
  ENST ID: ENST00000394458
  CDS Start-End: 115-2124
agtggcacacccggtggcatcctcccacccgggctcttatcggcggtcccagaccctgcttgagcgcctccgggtgtcaagggcccctgaggacactaaagctctcgaaccccgatgtggacccccgtgcggcgcggggcagcctggctgggaaccctgctcggccctggagaggggccccccgagccgaggggaggagcggcgcatgcccacaagccccccgcgggaagtaggaaatcgaccgaccaggcggtgcgcttcggacccagccagggcatgtgctcggaggcccgcctggctcgcaggttgcgggatgcgctgcgggaggaggagccgtgggcagtagaggagctgctgcgctgcggcgcggaccctaatttggtgctagaggacggcgcagcggctgtgcacttggcggccggagcccggcacccgcgcggcctgcgttgcctcggggccctactgcgccaaggcggggaccccaacgctcgatctgtcgaggcactgacgccgctgcatgtggccgccgcgtggggctgccgccgcggcctggagctgctgctgagccaaggagcggacccggcgctgcgcgaccaggacggactccggccgctggacctggccctgcagcagggacacctggagtgcgcgcgagtcctgcaggatctcgacacgcggaccaggacccggacccggatcggggcagagactcaggagcccgagcctgcacctggcaccccaggcctctctggacctaccgatgagacgctggactccatagcactccaaaagcagccatgcagaggtgacaacagggacattggcttggaggctgacccaggaccccccagcctccctgttccccttgaaactgtggacaaacatgggagctcggcgtcccctccagggcactgggattacagctcagacgcctctttcgtcacagcggttgaggtctctggagctgaggacccagcctcggacactcccccctgggctgggtcattgccaccgaccaggcagggacttctgcatgttgtccatgccaaccagagggtacctaggtctcagggcacggaggcagaactgaatgcccgtctgcaggccctgactctgaccccaccaaatgctgctggcttccagtcctccccttcctccatgcctctcctggacaggagtccagctcatagccccccacggacaccaacccctggagcttctgactgccactgcctgtgggagcaccagacatccattgatagtgacatggccacgctctggctgacagaggatgaggcaagctctacaggtggcagggaacctgtcggcccttgccggcacctgccagtctccactgtgtctgacttggagttgctgaagggactccgagcacttggtgagaatcctcaccccatcacacccttcaccaggcagttgtaccaccagcagctggaagaagcccagattgctcctggcccagagttttcagggcacagcctagaactggctgcagccctgcggacgggctgtattccagatgtccaggcagatgaagacgcgctggcccagcagtttgagcagccagatcctgccaggaggtggcgggagggggtcgtgaagtctagcttcacctatctgctgctggaccccagggagactcaggacctgccagcccgagccttctcactgaccccagctgagcgccttcagactttcatccgtgccatcttctacgtgggcaaagggacgagggcccggccatatgtccacctctgggaggcccttggtcaccatgggcggtcaagaaaacagccccaccaggcctgccccaaggtgcgtcagatcttggacatctgggccagtggttgcggtgttgtgtccctacattgcttccagcacgtggtcgctgtggaggcttatacacgggaggcgtgtattgtggaagccctagggatccagacgctcaccaaccagaagcaagggcactgctatggagtggtggcaggctggccacctgctcgtcgccggcgcttgggggtgcacctgctgcaccgtgccctccttgtcttcctggctgaaggcgagcgacagcttcatccccaggacatccaggcccggggctgagtgctggggagttggccatccagcctggggagaaatgtttgaatgttccagctgccccatgctgacagcagcccccatctctggtttcagaaggggtgtgtgtgtgtgtgtgtgtgtgtgtgtgtgtgtgtgtgtgtgtttgtgtgtgtgtgtgtgtgtgtagggagcacccaggcagatctcccccaggctgagagaggactttgttacagatggtactgctggagaggtagtaagtagtgagctccccatcgtgggaggaggacaagaagggaagcagaaggtgctttggaacagtccggtgcttctgtaagaggcgtttgaacctgggcaactccacctggaataggagctgggtaaaatgaggctgaaacctactgggctgcattcccagatggttaaagcattctaagtcacgggatcaggtaggaggtcagcacaagataacgggtcataaagaacctgctgataaaacaggttgcagtaaagaagccggccaaaacccaccaataccaagatggcgacaagagtgacctctggtcgtcctcattgctacactcccaccagcgccatgacagtttacaaatgccatggctggccaggcgcggtggctcacgcctgtaatcctagcattttgggaggccaaggagggcagatcacctaaggtcaggagttcaagaccagcgtggccaacgtggcgaaaccctatctctactaaaaataccaaaattagctgggcatggtggcgcgtgcctgtaatcccagctactaggggggctgaggcaggaggatcgcttgaacccaggaggtggaggttgcagtgagctgagattgtaccattgcactccagcctgggcaacagagcgagagtctgtctcaaacaaacaaacaaaaaaacaaatgccacatcaacatcaggacgttaacctttagaccctatatggtctaaaaaggggaggcatgaataatccaccccttgtttagcatatcatcaagaaataaccataaaaatgggcaaccagcagccctgccctgtctatggagtagccattcttttattcctttagtttcttaataaatttgctttcactgta

SEQ ID NO: 107403 - DNA, 3081 bp, Homo sapiens
  Payload ID: 1078
  Gene Symbol: ANKLE1
  Gene Name: ankyrin repeat and LEM domain containing 1
  ENST ID: ENST00000404085
  CDS Start-End: 61-318
cctgcttgagcgcctccgggtgtcaagggcccctgaggacactaaagctctcgaaccccgatgtggacccccgtgcggcgcggggcagcctggctgggaaccctgctcggccctggagaggggccccccgagccgaggggaggagcggcgcatgcccacaagccccccgcgggaagtaggaaatcgaccgaccaggcggtgcgcttcggacccagccagggcatgtgctcggaggcccgcctggctcgcaggttgcgggatgcgctgcgggaggaggagccgtgtagaggagctgctgcgctgcggcgcggaccctaatttggtgctagaggacggcgcagcggctgtgcacttggcggccggagcccggcacccgcgcggcctgcgttgcctcggggccctactgcgccaaggcggggaccccaacgctcgatctgtcgaggcactgacgccgctgcatgtggccgccgcgtggggctgccgccgcggcctggagctgctgctgagccaaggagcggacccggcgctgcgcgaccaggacggactccggccgctggacctggccctgcagcagggacacctggagtgcgcgcgagtcctgcaggatctcgacacgcggaccaggacccggacccggatcggggcagagactcaggagcccgagcctgcacctggcaccccaggcctctctggacctaccgatgagacgctggactccatagcactccaaaagcagccatgcagaggtgacaacagggacattggcttggaggctgacccaggaccccccagcctccctgttccccttgaaactgtggacaaacatgggagctcggcgtcccctccagggcactgggattacagctcagacgcctctttcgtcacagcggttgaggtctctggagctgaggacccagcctcggacactcccccctgggctgggtcattgccaccgaccaggcagggacttctgcatgttgtccatgccaaccagagggtacctaggtctcagggcacggaggcagaactgaatgcccgtctgcaggccctgactctgaccccaccaaatgctgctggcttccagtcctccccttcctccatgcctctcctggacaggagtccagctcatagccccccacggacaccaacccctggagcttctgactgccactgcctgtgggagcaccagacatccattgatagtgacatggccacgctctggctgacagaggatgaggcaagctctacaggtggcagggaacctgtcggcccttgccggcacctgccagtctccactgtgtctgacttggagttgctgaagggactccgagcacttggcccagagttttcagggcacagcctagaactggctgcagccctgcggacgggctgtattccagatgtccaggcagatgaagacgcgctggcccagcagtttgagcagccagatcctgccaggaggtggcgggagggggtcgtgaagtctagcttcacctatctgctgctggaccccagggagactcaggacctgccagcccgagccttctcactgaccccagctgagcgccttcagactttcatccgtgccatcttctacgtgggcaaagggacgagggcccggccatatgtccacctctgggaggcccttggtcaccatgggcggtcaagaaaacagccccaccaggcctgccccaaggtgcgtcagatcttggacatctgggccagtggttgcggtgttgtgtccctacattgcttccagcacgtggtcgctgtggaggcttatacacgggaggcgtgtattgtggaagccctagggatccagacgctcaccaaccagaagcaagggcactgctatggagtggtggcaggctggccacctgctcgtcgccggcgcttgggggtgcacctgctgcaccgtgccctccttgtcttcctggctgaaggcgagcgacagcttcatccccaggacatccaggcccggggctgagtgctggggagttggccatccagcctggggagaaatgtttgaatgttccagctgccccatgctgacagcagcccccatctctggtttcagaaggggtgtgtgtgtgtgtgtgtgtgtgtgtgtgtgtgtgtgtgtgtgtttgtgtgtgtgtgtgtgtgtgtagggagcacccaggcagatctcccccaggctgagagaggactttgttacagatggtactgctggagaggtagtaagtagtgagctccccatcgtgggaggaggacaagaagggaagcagaaggtgctttggaacagtccggtgcttctgtaagaggcgtttgaacctgggcaactccacctggaataggagctgggtaaaatgaggctgaaacctactgggctgcattcccagatggttaaagcattctaagtcacgggatcaggtaggaggtcagcacaagataacgggtcataaagaacctgctgataaaacaggttgcagtaaagaagccggccaaaacccaccaataccaagatggcgacaagagtgacctctggtcgtcctcattgctacactcccaccagcgccatgacagtttacaaatgccatggctggccaggcgcggtggctcacgcctgtaatcctagcattttgggaggccaaggagggcagatcacctaaggtcaggagttcaagaccagcgtggccaacgtggcgaaaccctatctctactaaaaataccaaaattagctgggcatggtggcgcgtgcctgtaatcccagctactaggggggctgaggcaggaggatcgcttgaacccaggaggtggaggttgcagtgagctgagattgtaccattgcactccagcctgggcaacagagcgagagtctgtctcaaacaaacaaacaaaaaaacaaatgccacatcaacatcaggacgttaacctttagaccctatatggtctaaaaaggggaggcatgaataatccaccccttgtttagcatatcatcaagaaataaccataaaaatgggcaaccagcagccctgccctgtctatggagtagccattcttttattcctttagtttcttaataaatttgctttcactgta

SEQ ID NO: 107404 - DNA, 1821 bp, Homo sapiens
  Payload ID: 1078
  Gene Symbol: ANKLE1
  Gene Name: ankyrin repeat and LEM domain containing 1
  ENST ID: ENST00000404261
  CDS Start-End: 115-1434
agtggcacacccggtggcatcctcccacccgggctcttatcggcggtcccagaccctgcttgagcgcctccgggtgtcaagggcccctgaggacactaaagctctcgaaccccgatgtggacccccgtgcggcgcggggcagcctggctgggaaccctgctcggccctggagaggggccccccgagccgaggggaggagcggcgcatgcccacaagccccccgcgggaagtaggaaatcgaccgaccaggcggtgcgcttcggacccagccagggcatgtgctcggaggcccgcctggctcgcaggttgcgggatgcgctgcgggaggaggagccgtgggcagtagaggagctgctgcgctgcggcgcggaccctaatttggtgctagaggacggcgcagcggctgtgcacttggcggccggagcccggcacccgcgcggcctgcgttgcctcggggccctactgcgccaaggcggggaccccaacgctcgatctgtcgaggcactgacgccgctgcatgtggccgccgcgtggggctgccgccgcggcctggagctgctgctgagccaaggagcggacccggcgctgcgcgaccaggacggactccggccgctggacctggccctgcagcagggacacctggagtgcgcgcgagtcctgcaggatctcgacacgcggaccaggacccggacccggatcggggcagagactcaggagcccgagcctgcacctggcaccccaggcctctctggacctaccgatgagacgctggactccatagcactccaaaagcagccatgcagaggtgacaacagggacattggcttggaggctgacccaggaccccccagcctccctgttccccttgaaactgtggacaaacatgggagctcggcgtcccctccagggcactgggattacagctcagacgcctctttcgtcacagcggttgaggtctctggagctgaggacccagcctcggacactcccccctgggctgggtcattgccaccgaccaggcagggacttctgcatgttgtccatgccaaccagagggtacctaggtctcagggcacggaggcagaactgaatgcccgtctgcaggccctgactctgaccccaccaaatgctgctggcttccagtcctccccttcctccatgcctctcctggacaggagtccagctcatagccccccacggacaccaacccctggagcttctgactgccactgcctgtgggagcaccagacatccattgatagtgacatggccacgctctggctgacagaggatgaggcaagctctacaggtggcagggaacctgtcggcccttgccggcacctgccagtctccactgtgtctgacttggagttgctgaagggactccgagcacttgggagactcaggacctgccagcccgagccttctcactgaccccagctgagcgccttcagactttcatccgtgccatcttctacgtgggcaaagggacgagggcccggccatatgtccacctctgggaggcccttggtcaccatgggcggtcaagaaaacagccccaccaggcctgccccaaggtgcgtcagatcttggacatctgggccagtggttgcggtgttgtgtccctacattgcttccagcacgtggtcgctgtggaggcttatacacgggaggcgtgtattgtggaagccctagggatccagacgctcaccaaccagaagcaagggcactgctatggagtggtggcaggctggccacctgctcgtcgccggcgcttgggggtgcacctgctgcaccgtgccctccttgtcttcctggctg

SEQ ID NO: 107405 - DNA, 2294 bp, Homo sapiens
  Payload ID: 1078
  Gene Symbol: ANKLE1
  Gene Name: ankyrin repeat and LEM domain containing 1
  ENST ID: ENST00000594072
  CDS Start-End: 61-1992
cctgcttgagcgcctccgggtgtcaagggcccctgaggacactaaagctctcgaaccccgatgtggacccccgtgcggcgcggggcagcctggctgggaaccctgctcggccctggagaggggccccccgagccgaggggaggagcggcgcatgcccacaagccccccgcgggaagtaggaaatcgaccgaccaggcggtgcgcttcggacccagccagggcatgtgctcggaggcccgcctggctcgcaggttgcgggatgcgctgcgggaggaggagccgtgggcagtagaggagctgctgcgctgcggcgcggaccctaatttggtgctagaggacggcgcagcggctgtgcacttggcggccggagcccggcacccgcgcggcctgcgttgcctcggggccctactgcgccaaggcggggaccccaacgctcgatctgtcgaggcactgacgccgctgcatgtggccgccgcgtggggctgccgccgcggcctggagctgctgctgagccaaggagcggacccggcgctgcgcgaccaggacggactccggccgctggacctggccctgcagcagggacacctggagtgcgcgcgagtcctgcaggatctcgacacgcggaccaggacccggacccggatcggggcagagactcaggagcccgagcctgcacctggcaccccaggcctctctggacctaccgatgagacgctggactccatagcactccaaaagcagccatgcagaggtgacaacagggacattggcttggaggctgacccaggaccccccagcctccctgttccccttgaaactgtggacaaacatgggagctcggcgtcccctccagggcactgggattacagctcagacgcctctttcgtcacagcggttgaggtctctggagctgaggacccagcctcggacactcccccctgggctgggtcattgccaccgaccaggcagggacttctgcatgttgtccatgccaaccagagggtacctaggtctcagggcacggaggcagaactgaatgcccgtctgcaggccctgactctgaccccaccaaatgctgctggcttccagtcctccccttcctccatgcctctcctggacaggagtccagctcatagccccccacggacaccaacccctggagcttctgactgccactgcctgtgggagcaccagacatccattgatagtgacatggccacgctctggctgacagaggatgaggcaagctctacaggtggcagggaacctgtcggcccttgccggcacctgccagtctccactgtgtctgacttggagttgctgaagggactccgagcacttggcccagagttttcagggcacagcctagaactggctgcagccctgcggacgggctgtattccagatgtccaggcagatgaagacgcgctggcccagcagtttgagcagccagatcctgccaggaggtggcgggagggggtcgtgaagtctagcttcacctatctgctgctggaccccagggagactcaggacctgccagcccgagccttctcactgaccccagctgagcgccttcagactttcatccgtgccatcttctacgtgggcaaagggacgagggcccggccatatgtccacctctgggaggcccttggtcaccatgggcggtcaagaaaacagccccaccaggcctgccccaaggtgcgtcagatcttggacatctgggccagtggttgcggtgttgtgtccctacattgcttccagcacgtggtcgctgtggaggcttatacacgggaggcgtgtattgtggaagccctagggatccagacgctcaccaaccagaagcaagggcactgctatggagtggtggcaggctggccacctgctcgtcgccggcgcttgggggtgcacctgctgcaccgtgccctccttgtcttcctggctgaaggcgagcgacagcttcatccccaggacatccaggcccggggctgagtgctggggagttggccatccagcctggggagaaatgtttgaatgttccagctgccccatgctgacagcagcccccatctctggtttcagaaggggtgtgtgtgtgtgtgtgtgtgtgtgtgtgtgtgtgtgtgtgtgtttgtgtgtgtgtgtgtgtgtgtagggagcacccaggcagatctcccccaggctgagagaggactttgttacagatggtactgctggagaggtagtaagtagtgagctccccatcgtgggaggaggacaagaagggaagcagaaggtgctttggaacagtccgg

SEQ ID NO: 107406 - DNA, 2003 bp, Homo sapiens
  Payload ID: 1078
  Gene Symbol: ANKLE1
  Gene Name: ankyrin repeat and LEM domain containing 1
  ENST ID: ENST00000598347
  CDS Start-End: 1-1796
gcatgtgctcggaggcccgcctggctcgcaggttgcgggatgcgctgcgggaggaggagccgtgggcagtagaggagctgctgcgctgcggcgcggaccctaatttggtgctagaggacggcgcagcggctgtgcacttggcggccggagcccggcacccgcgcggcctgcgttgcctcggggccctactgcgccaaggcggggaccccaacgctcgatctgtcgaggcactgacgccgctgcatgtggccgccgcgtggggctgccgccgcggcctggagctgctgctgagccaaggagcggacccggcgctgcgcgaccaggacggactccggccgctggacctggccctgcagcagggacacctggagtgcgcgcgagtcctgcaggatctcgacacgcggaccaggacccggacccggatcggggcagagactcaggagcccgagcctgcacctggcaccccaggcctctctggacctaccgatgagacgctggactccatagcactccaaaagcagccatgcagaggtgacaacagggacattggcttggaggctgacccaggaccccccagcctccctgttccccttgaaactgtggacaaacatgggagctcggcgtcccctccagggcactgggattacagctcagacgcctctttcgtcacagcggttgaggtctctggagctgaggacccagcctcggacactcccccctgggctgggtcattgccaccgaccaggcagggacttctgcatgttgtccatgccaaccagagggtacctaggtctcagggcacggaggcagaactgaatgcccgtctgcaggccctgactctgaccccaccaaatgctgctggcttccagtcctccccttcctccatgcctctcctggacaggagtccagctcatagccccccacggacaccaacccctggagcttctgactgccactgcctgtgggagcaccagacatccattgatagtgacatggccacgctctggctgacagaggatgaggcaagctctacaggtggcagggaacctgtcggcccttgccggcacctgccagtctccactgtgtctgacttggagttgctgaagggactccgagcacttggcccagagttttcagggcacagcctagaactggctgcagccctgcggacgggctgtattccagatgtccaggcagatgaagacgcgctggcccagcagtttgagcagccagatcctgccaggaggtggcgggagggggtcgtgaagtctagcttcacctatctgctgctggaccccagggagactcaggacctgccagcccgagccttctcactgaccccagctgagcgccttcagactttcatccgtgccatcttctacgtgggcaaagggacgagggcccggccatatgtccacctctgggaggcccttggtcaccatgggcggtcaagaaaacagggatccagacgctcaccaaccagaagcaagggcactgctatggagtggtggcaggctggccacctgctcgtcgccggcgcttgggggtgcacctgctgcaccgtgccctccttgtcttcctggctgaaggcgagcgacagcttcatccccaggacatccaggcccggggctgagtgctggggagttggccatccagcctggggagaaatgtttgaatgttccagctgccccatgctgacagcagcccccatctctggtttcagaaggggtgtgtgtgtgtgtgtgtgtgtgtgtgtgtgtgtgtgtgtgtgtttgtgtgtgtgtgtgtgtgtgtagggagcacccaggcagatctcccccaggctgagagaggactttgttacagatggtactgctggagaggtagtaagtagtgagctccccatcgtgggaggaggacaagaagggaagcagaaggtgctttggaacagtccggtgcttctgtaagaggcgtttgaacctgggcaactccacctggaataggagctgggtaaaatgaggctg

SEQ ID NO: 107407 - DNA, 4646 bp, Homo sapiens
  Payload ID: 1079
  Gene Symbol: ANKLE2
  Gene Name: ankyrin repeat and LEM domain containing 2
  Uniprot ID: Q86XL3
  ENST ID: ENST00000357997
  CDS Start-End: 91-2907
aggcagggcgcgggcagcccggcgcggggtcctgggacgggcgcggcgcggggcgcgggcttctcggcggctgcggcccgggcggcggcgatgctgtggccgcggctggcggcggccgagtgggcggcgctggcctgggagctgctgggcgcctcggtgctgctgatcgctgtgcggtggctggtgcggcggctgggcccgcggccgggaggtctgggccgcagcgggaccccagttcctccgccaagcgcggccgccgcccccgcctcaggtgaaatgacaatggatgctctgttggctcgattgaaacttctgaatccagatgaccttagagaagaaatcgtcaaagccggattgaaatgtggacccattacatcaactacaaggttcatttttgagaaaaaattggctcaggctttactggagcaaggaggaaggctgtcttctttctaccaccatgaggcaggtgtcacagctctcagccaggacccacaaaggattttgaagccagctgaagggaacccaactgatcaggctggtttttctgaagacagagattttggttacagtgtgggcctgaatcctccagaggaggaagctgtgacatccaagacctgctcggtgccccctagtgacaccgacacctacagagctggagcgactgcgtctaaggagccgcccctgtactatggggtgtgtccagtgtatgaggacgtcccagcgagaaatgaaaggatctatgtttatgaaaataaaaaggaagcattgcaagctgtcaagatgatcaaagggtcccgatttaaagctttttctaccagagaagacgctgagaaatttgctagaggaatttgtgattatttcccttctccaagcaaaacgtccttaccactgtctcctgtgaaaacagctccactctttagcaatgacaggttgaaagatggtttgtgcttgtcggaatcagaaacagtcaacaaagagcgagcgaacagttacaaaaatccccgcacgcaggacctcaccgccaagcttcggaaagctgtggagaagggagaggaggacaccttttctgaccttatctggagcaacccccggtatctgataggctcaggagacaaccccactatcgtgcaggaagggtgcaggtacaacgtgatgcatgttgctgccaaagagaaccaggcttccatctgccagctgactctggacgtcctggagaaccctgacttcatgaggctgatgtaccctgatgacgacgaggccatgctgcagaagcgtatccgttacgtggtggacctgtacctcaacacccccgacaagatgggctatgacacaccgttgcattttgcttgtaagtttggaaatgcagatgtagtcaacgtgctttcgtcacaccatttgattgtaaaaaactcaaggaataaatatgataaaacacctgaagatgtaatttgtgaaagaagcaaaaataaatctgtggaactgaaggagcggatcagagagtatttaaagggccactactacgtgcccctcctgagagcggaagagacttcttctccagtcatcggggagctgtggtccccagaccagacggctgaggcctctcacgtcagccgctatggaggcagccccagagacccggtactgaccctgagagccttcgcagggcccctgagtccagccaaggcagaagattttcgcaagctctggaaaactccacctcgagagaaagcaggcttccttcaccacgtcaagaagtcggacccggaaagaggctttgagagagtgggaagggagctagctcatgagctggggtatccctgggttgaatactgggaatttctgggctgttttgttgatctgtcttcccaggaaggcctgcaaagactagaagaatatctcacacagcaggaaataggcaaaaaggctcaacaagaaacaggagaacgggaagcctcctgccgagataaagccaccacgtctggcagcaattccatttccgtgagggcgtttctagatgaagatgacatgagcttggaagaaataaaaaatcggcaaaatgcagctcgaaataacagcccgcccacagtcggtgcttttggacatacgaggtgcagcgccttccccttggagcaggaggcagacctcatagaagccgccgagccgggaggtccacacagcagcagaaatgggctctgccatcctctgaatcacagcaggaccctggcgggcaagagaccaaaggccccccgtggggaggaagcccatctgccacctgtctcggatttgactgttgagtttgataaactgaatttgcaaaatataggacgtagcgtttccaagacaccagatgaaagtacaaaaactaaagatcagatcctgacttcaagaatcaatgcagtagaaagagacttgttagagccttctcccgcagaccaactcgggaatggccacaggaggacagaaagtgaaatgtcagccaggatcgctaaaatgtccttgagtcccagcagccccaggcacgaggatcagctcgaggtcaccagggaaccggccaggcggctcttcctttttggagaggagccatcaaaactcgatcaggatgttttggccgctcttgaatgtgcagacgtcgacccccatcagttcccggccgtgcacagatggaagagtgctgtcctgtgctactcaccctcggacagacagagttggcccagtcccgcggtgaaaggaaggttcaagtctcagctgccagatctcagtggccctcacagctacagtccggggagaaacagcgtggctggaagcaaccccgcaaagccaggcctgggcagtcctgggcgctacagccccgtgcacgggagccagctccgcaggatggcgcgcctggctgagcttgccgccctgtaggcttggcgctgggctctcggtttgttcttcatttttaaagaaggaagggtcatatgtttattgctaaactgtcaaaaaggaatatattctgattaaattattactcctcactttgagggtgtgagaattttagaagatttaaatgttctatataacacttagatttctgatattttggaagaagttagaagttaatgaaagcaaactcagttaccaattttctggaaaatatccatgtggtaatggtagactttttaggtggcaatttctaggtctgaaatatagcagaggaaagggcgctgaggcagttgcaggcaggcagccctgtacttaccctgtactcacctcatccgacagacgctgtggatgaggaggggcttggcggaggcgtgagcaccgatgtccctttgataacctgcactcaccaagatgaactatttgccgccctgtcttttcctgggttggggggtggcatctgatggtggcagagtgcctgttggttcgcccgtgggtctcatggttcagacagagggaggtggacggcagggatcagggagccaggagcgcgcctcagacttgcagcaaccattgtgatttgggttgttcggaatatttaaattactgatcagaagatgaaagtagcttttctcttgggaagtcttgcagcccgtgggagtgataccaggagcaacacagagctcagcagcggcgccaaggtgttccctgtttcctcagcacgtgagccttcaccgcctgcttcattcaggagccagtgcagcagtaatacagtctatacattgttctgttttcaaatttatcctgaggctttgttgagcataaatgattatacgataaaggtatccgttattttggaactcatttcagttgggatctcctgtatgcagagtgttgcatttagaggtttgagtcccatcttggtttcttgccgtgctgactgtagccttcaccttgacttgaatgaaggtctgtggttggaatgtgtgaggagccgctgaggtgttcaggaggtgctgcctggaggtcggtttcttcctgggtgttacgggcaactgctcacacagttgtttctctgtgaacatttccagtgtttaatccaaaatgaaaacccaccaatgcttttgctaacttcagtgccttttataaatcatttttaaatttcctgaacttgctttttgaggatatacagggatattaagtagacgcaggattgtttttgtttgtaaaaattctgaattgaaactttgttttaaaaaaaggcttctttctttcatatgacaagagataggtcaggaatattggaatcaagatttaaatgttaaaattcgattttgttacacagggtgtgttcatttgttttgtagcagacaagatctagatcccagacagaaacaacacatgctattctaaaaagccgcattttaaaaggcaccttggttctcaaaagaaatcagaatatggatattcgtagtgatgatctgttttctctaaaatcttaccatattgtctgtatatggttgtaaattcaaatggaaagtaaaacgttttggccctgattttgtatgtggaccactgctcctgatttcccaggtcttaggccacctttgactgtttctccgtttgtttgtgggcagcgattccagtcccaacggaggcattctcgtgtgtcccggggggttatgtccttcacaaaacacttaatgaaatgaattacttcaaaa

SEQ ID NO: 107408 - DNA, 741 bp, Homo sapiens
  Payload ID: 1079
  Gene Symbol: ANKLE2
  Gene Name: ankyrin repeat and LEM domain containing 2
  ENST ID: ENST00000535036
  CDS Start-End: 1-357
gaagggtgcaggtacaacgtgatgcatgttgctgccaaagagaaccaggcttccatctgccagctgactctggacgtcctggagaaccctgacttcatgaggctgatgtaccctgatgacgacgaggccatgctgcagaagcgtatccgttacgtggtggacctgtacctcaacacccccgacaagatgggctatgacacaccgttgcattttgcttgtaagtttggaaatgcagatgtagtcaacgtgctttcgtcacaccatttgattgtaaaaaactcaaggaataaatatgataaaacacctgaagatgagctccaccttgacccagcctcacaacaaaaagtttgtgtatgaccaggcttcctgtaagtggaactcaaccaaccaagaaggtaatttgtgaaagaagcaaaaataaatctgtggaactgaaggagcggatcagagagtatttaaagggccactactacgtgcccctcctgagagcggaagagacttcttctccagtcatcggggagctgtggtccccagaccagacggctgaggcctctcacgtcagccgctatggaggcagccccagagacccggtactgaccctgagagccttcgcagggcccctgagtccagccaaggcagaagattttcgcaagctctggaaaactccacctcgagagaaagcaggcttccttcaccacgtcaagaagtcggacccggaaagaggctttgagagagtgggaa

SEQ ID NO: 107409 - DNA, 3302 bp, Homo sapiens
  Payload ID: 1079
  Gene Symbol: ANKLE2
  Gene Name: ankyrin repeat and LEM domain containing 2
  Uniprot ID: Q86XL3
  ENST ID: ENST00000542282
  CDS Start-End: 1985-2866
cagacaccaggacgcagagcgcttcacacggtgcgtatcagacaccaggatgcagagcgcttcacacggtgtatatcagacaccaggacgcagagcgcttcacatggtgtatatcagacaccaggacgcaaacgcaaagcgcttcacacggtgcacatcagacaccagcatgcagagagcttcacacggtgcatatcagacaccaggacgcagagcgcttcacacggtgcatatgagacaccaggacgcagagcgcttcacacggtgtatatcagacaccaggacgcacacgcaaagcacttcacacggtgcatatcagacaccacgatgcaaagtgcttccaaagcacagatgcactgaatggaaagagcatgatggaagaggttaatctacaaaatctaaaagtgattcataaaaacatcaacgatggccgggcacgggagctcaggcctgcaatcccagcggccgggcgtggcggctcacactataatcccagcacttagggaggccaacgtgggtggattgctgaaacccaggagttcgaaggcagcttgagcaacatagtgagactctgtctctatttatttttttaaaaaaacagaaatttgctaataactagagattcgaatctgctaaaatacaaattaaagcagatatacagtttaaactgtgtgtgtgtgtgtgtgagtgtgtgtctgtgtgagtttgtgtgtgtaaggtcataatagaaccattagcccgcaagacacttcatttataaaacaaactccctggaatgatagaaaatgaaaatgattgacatacattaaactaagaagcagtgaatcttcaacagtcacgacctgtgactctgaaccacagaactagagcgacgtcagtgccgtcgttatacaggaatcattgaagtctgaccttgctgtgttgtagctgatggtggcacagaactcacttctgtaaagcggcctcatttacagtgttgtcttgtgactatgtacattttaattagtaaatattaaataaagttgaggcatttcctaagtagcaggagccacagctcaagtgttctggatcctcctgtggccgcggccaccatcgtgaacaccaaacgggacatttctgttgcctgtcgcacagtgctgcgcccgggagctcttctgtgttatcttcacacctaaagcgcagcagggttacttcatggagttgttctggacgatcttcgggatcctctggggcactgtgacactcggagcccctggggtcgcagcagatcggagctggagggtggctgggggtgcagggcagtcatctcgcccatcacctgggctgcccttggcgttttcatgtccctgcctttgaaagaaaagtcagcctggcagctttatttccctcctcgtctgaaatagggtctcactctgtggcacaggatggaaagcaatggtgcagtcacagcccactgcagcctccccctcctgggctcaagcgatcctcccacttgagcctcccaaatagctgagactacaggtgcgtgccaccatgtcagctaatttttctatagagaacggggtttcgctatgttgcccaggcagtcttgaactcctggggtccagcgacccccctgccatggcctcccagagtgctgggattgcaggcgtgagcttctgtgcctggccccagcagcctgattgtgtctggagggtcctgtttgcccttttccagggagtcgtgtgggtggttttccatcctgaaatctgatgaggaggttttggatgcaagagttgctgttgctggggtcacggcagttggtcgcggatggagtggggaggttttgggtataagagttgctgttgctggggtcacggcagttggtcatggatggggcggagcagctccgtggcttcctgtcgttcccatcactgaagtgctccttgttgtcctcacaggcagcaattccatttccgtgagggcgtttctagatgaagatgacatgagcttggaagaaataaaaaatcggcaaaatgcagctcgaaataacagcccgcccacagtcggtgcttttggacatacgaggtgcagcgccttccccttggagcaggaggcagacctcatagaagccgccgagccgggaggtccacacagcagcagaaatgggctctgccatcctctgaatcacagcaggaccctggcgggcaagagaccaaaggccccccgtggggaggaagcccatctgccacctgtctcggatttgactgttgagtttgataaactgaatttgcaaaatataggacgtagcgtttccaagacaccagatgaaagtacaaaaactaaagatcagatcctgacttcaagaatcaatgcagtagaaagagacttgttagagccttctcccgcagaccaactcgggaatggccacaggaggacagaaagtgaaatgtcagccaggatcgctaaaatgtccttgagtcccagcagccccaggcacgaggatcagctcgaggtcaccagggaaccggccaggcggctcttcctttttggagaggagccatcaaaactcgatcaggatgttttggccgctcttgaatgtgcagacgtcgacccccatcagttcccggccgtgcacagatggaagagtgctgtcctgtgctactcaccctcggacagacagagttggcccagtcccgcggtgaaaggaaggttcaagtctcagctgccagatctcagtggccctcacagctacagtccggggagaaacagcgtggctggaagcaaccccgcaaagccaggcctgggcagtcctgggcgctacagccccgtgcacgggagccagctccgcaggatggcgcgcctggctgagcttgccgccctgtaggcttggcgctgggctctcggtttgttcttcatttttaaagaaggaagggtcatatgtttattgctaaactgtcaaaaaggaatatattctgattaaattattactcctcactttgagggtgtgagaattttagaagatttaaatgttctatataacacttagatttctgatattttggaagaagttagaagttaatgaaagcaaactcagttaccaattttctggaaaatatccatgtggtaatggtagactttttaggtggcaatttctaggtctgaaatatagcagaggaaagggcgctgaggcagttgcaggcaggcagccctgtacttaccctgtactcacctcatccgacagacgctgtggatgaggaggggcttggcggaggcgtgagcaccgatgtccctttgataacctgcactcaccaagatgaact

SEQ ID NO: 107410 - DNA, 2446 bp, Homo sapiens
  Payload ID: 1079
  Gene Symbol: ANKLE2
  Gene Name: ankyrin repeat and LEM domain containing 2
  Uniprot ID: Q86XL3
  ENST ID: ENST00000542657
  CDS Start-End: 1456-2337
atatcagacaccaggacgcaaacgcaaagcgcttcacacggtgcacatcagacaccagcatgcagagagcttcacacggtgcatatcagacaccaggacgcagagcgcttcacacggtgcatatgagacaccaggacgcagagcgcttcacacggtgtatatcagacaccaggacgcacacgcaaagcacttcacacggtgcatatcagacaccacgatgcaaagtgcttccaaagcacagatgcactgaatggaaagagcatgatggaagaggttaatctacaaaatctaaaagtgattcataaaaacatcaacgatggccgggcacgggagctcaggcctgcaatcccagcggccgggcgtggcggctcacactataatcccagcacttagggaggccaacgtgggtggattgctgaaacccaggagttcgaaggcagcttgagcaacatagtgagactctgtctctatttatttttttaaaaaaacagaaatttgctaataactagagattcgaatctgctaaaatacaaattaaagcagatatacagtttaaactgtgtgtgtgtgtgtgtgagtgtgtgtctgtgtgagtttgtgtgtgtaaggtcataatagaaccattagcccgcaagacacttcatttataaaacaaactccctggaatgatagaaaatgaaaatgattgacatacattaaactaagaagcagtgaatcttcaacagtcacgacctgtgactctgaaccacagaactagagcgacgtcagtgccgtcgttatacaggaatcattgaagtctgaccttgctgtgttgtagctgatggtggcacagaactcacttctgtaaagcggcctcatttacagtgttgtcttgtgactatgtacattttaattagtaaatattaaataaagttgaggcatttcctaagtagcaggagccacagctcaagtgttctggatcctcctgtggccgcggccaccatcgtgaacaccaaacgggacatttctgttgcctgtcgcacagtgctgcgcccgggagctcttctgtgttatcttcacacctaaagcgcagcagggttacttcatggagttgttctggacgatcttcgggatcctctggggcactgtgacactcggagcccctggggtcgcagcagatcggagctggagggtggctgggggtgcagggcagtcatctcgcccatcacctgggctgcccttggcgttttcatgtccctgcctttgaaagaaaagtcagcctggcagctttatttccctcctcgtctgaaatagggtctcactctgtggcacaggatggaaagcaatggtgcagtcacagcccactgcagcctccccctcctgggctcaagcgatcctcccacttgagcctcccaaatagctgagactacaggcagcaattccatttccgtgagggcgtttctagatgaagatgacatgagcttggaagaaataaaaaatcggcaaaatgcagctcgaaataacagcccgcccacagtcggtgcttttggacatacgaggtgcagcgccttccccttggagcaggaggcagacctcatagaagccgccgagccgggaggtccacacagcagcagaaatgggctctgccatcctctgaatcacagcaggaccctggcgggcaagagaccaaaggccccccgtggggaggaagcccatctgccacctgtctcggatttgactgttgagtttgataaactgaatttgcaaaatataggacgtagcgtttccaagacaccagatgaaagtacaaaaactaaagatcagatcctgacttcaagaatcaatgcagtagaaagagacttgttagagccttctcccgcagaccaactcgggaatggccacaggaggacagaaagtgaaatgtcagccaggatcgctaaaatgtccttgagtcccagcagccccaggcacgaggatcagctcgaggtcaccagggaaccggccaggcggctcttcctttttggagaggagccatcaaaactcgatcaggatgttttggccgctcttgaatgtgcagacgtcgacccccatcagttcccggccgtgcacagatggaagagtgctgtcctgtgctactcaccctcggacagacagagttggcccagtcccgcggtgaaaggaaggttcaagtctcagctgccagatctcagtggccctcacagctacagtccggggagaaacagcgtggctggaagcaaccccgcaaagccaggcctgggcagtcctgggcgctacagccccgtgcacgggagccagctccgcaggatggcgcgcctggctgagcttgccgccctgtaggcttggcgctgggctctcggtttgttcttcatttttaaagaaggaagggtcatatgtttattgctaaactgtcaaaaaggaatatattctgattaaattattactcctc

SEQ ID NO: 107411 - DNA, 1557 bp, Homo sapiens
  Payload ID: 1079
  Gene Symbol: ANKLE2
  Gene Name: ankyrin repeat and LEM domain containing 2
  ENST ID: ENST00000538766
  CDS Start-End: 784-1557
atagaaggtaccatataatgctatggattccttgggaaaaaataggccatagccacaaagctaaattatgctgtaatcaaataaagcttcgtggaattgtttagaatattttctcaaaatatgtgcccagtgtcaggtgtacaactggaacccagaaaggacctccaggctttcgtgtgcctggccatgactagaaccacgggcaagttcacagggctgttccgtgatcatgaacacgtccgtctgtgggagttgaactgtgtgacctgggttgctggcgtgagggtctgtcgggctgaggcctccttcctgcctgcagccggttcacggctcctgagagctgtgccgggtcctgcttacctgtgaggaggcgtgctgtttcagaaaatgcaccgtatgatttcagctgccagttaaggataaaggaaaattataaccatgattgcagacattgctttggtacttgaagctttagtggcttttttctgtgtagttctgagtattttttctggtttcacagctggttaattgtgttttgtttcttacagggagctagctcatgagctggggtatccctgggttgaatactgggaatttctgggctgttttgttgatctgtcttcccaggaaggcctgcaaagactagaagaatatctcacacagcaggaaataggcaaaaaggctcaacaagaaacaggagaacgggaagcctcctgccgagataaagccaccacgtctggcagcaattccatttccgtgagggcgtttctagatgaagatgacatgagcttggaagaaataaaaaatcggcaaaatgcagctcgaaataacagcccgcccacagtcggtgcttttggacatacgaggtgcagcgccttccccttggagcaggaggcagacctcatagaagccgccgagccgggaggtccacacagcagcagaaatgggctctgccatcctctgaatcacagcaggaccctggcgggcaagagaccaaaggccccccgtggggaggaagcccatctgccacctgtctcggatttgactgttgagtttgataaactgaatttgcaaaatataggacgtagcgtttccaagacaccagatgaaagtacaaaaactaaagatcagatcctgacttcaagaatcaatgcagtagaaagagacttgttagagccttctcccgcagaccaactcgggaatggccacaggaggacagaaagtgaaatgtcagccaggatcgctaaaatgtccttgagtcccagcagccccaggcacgaggatcagctcgaggtcaccagggaaccggccaggcggctcttcctttttggagaggagccatcaaaactcgatcaggatgttttggccgctcttgaatgtgcagacgtcgacccccatcagttcccggccgtgcacagatggaagagtgctgtcctgtgctactcaccctcggacagacagagttggcccagtcccgcggtgaaaggaaggttcaagtctcagctgccagatctcagtggccctcacagctacagtccggggagaaacagcgtggct

SEQ ID NO: 107412 - DNA, 3228 bp, Homo sapiens
  Payload ID: 1080
  Gene Symbol: ANKMY1
  Gene Name: ankyrin repeat and MYND domain containing 1
  Uniprot ID: Q9P2S6
  ENST ID: ENST00000272972
  CDS Start-End: 216-3041
ggcaagcagtcgggacgggagcgcgggcgtccgcggtggctgcagtcccgtcggtctccctgctgtccggcgcgagctcttcgagtcttgcttgggatgtttcagcagcccctgagaaggaagaggaggaagctgagggcccgctgagggcgcaggacctgagggagtcctacatccagctcgtccagggtgtgcaggagtggcaggatggttgcatgtaccagggggagtttgggttgaacatgaagcttggatatggcaaattctcttggcccacaggcgagtcataccatgggcagttttaccgggaccactgccatggcctgggtacctacatgtggccagatggctccagtttcacgggcacattttacctcagccaccgagaaggctacggcaccatgtacatgaagacacggcttttccaggggctatacaaagcggaccagcggtttgggccaggtgtcgagacctaccccgatggcagccaggacgtggggctgtggttccgagagcagctcatcaagctgtgcacccagatccccagtggcttctccctcctcagataccctgagttctccagcttcatcacccacagccctgccaggatcagcctctcagaagaggagaaaacggagtggggactgcaggagggacaggatccctttttctatgactataagcggtttcttctgaatgacaacctaacgctgcctccagaaatgtatgtctactcgaccaacagtgaccacctgcccatgacaagctctttccgcaaagagctggacgcccgcatcttcctcaatgaaattcctccgttcgttgaggatggagaaccatggttcataatcaatgagacccctttgttggtcaaaatccagaagcaaacttacaagttcaggaacaagccagctcacaccagctggaacatgggcgccatcctggaggggaagcgcagtggctttgcaccctgtgggcccaaagagcaactttccatggagatgatcctaaaggctgaggaagggaaccacgaatggatttgtaggatcctgaaggacaactttgctagtgctgacgtggcggacgcaaagggctacactgtgcttgctgcggctgctactcactgccacaacgacattgtcaaccttctcctggactgtggggccgacgtgaacaagtgctcagatgagggtctcacggcactcagcatgtgtttcctcctccactaccccgcccagtccttcaagcccaatgttgctgaacggaccatacctgagccccaggaacctccaaaattcccagttgttccaatcctttcatcatcatttatggacacaaacctggagtctctgtactatgaggtgaacgtgccttcccagggtagctatgagctgaggccaccgccagcaccactgctcctgccacgcgtctcaggcagccacgagggcggccacttccaggacaccgggcagtgtggggggtccatagaccacaggagcagctctctgaagggggactccccgttggtgaagggcagccttggccatgtggaaagcgggcttgaggacgtgttgggaaacacagaccggggcagtctgtgcagtgctgagacgaaatttgagtccaacgtgtgtgtgtgcgacttctccatcgagctctcgcaggccatgctggagagaagcgcccagtcccacagcttgctgaagatggcctcgccctcaccgtgcaccagcagcttcgacaaagggaccatgcggaggatggcgctgtccatgatcgagcggaggaagcgctggcggaccatcaagctgctgctgcgccggggcgcggaccccaacctgtgctgcgtgcccatgcaggtcctgttccttgctgtgaaggccggggacgtggatggggtgaggctgctgctggagcacggggcgaggaccgacatctgctttccgccgcagctgagcaccctgacaccactccacatcgctgccgcccttcctggggaggagggggtacagattgtggagctgctgttgcatgccatcaccgatgtggacgccaaggcatccgacgaggacgacacttacaagcccggcaagctggacctgctgccctcaagtctgaagctcagcaatgagccaggccctccccaagcctactacagcacggacacagccctcccggaggaggggggcaggacggctctgcacatggcctgcgagcgggaggatgacaacaagtgtgccagggacatagtccggctccttctatcccacggagcaaatcctaacctgctgtggagtggccactccccgctctccctgtccattgccagtgggaatgagctggttgtgaaggagctcctgacccagggagctgaccccaacctgcccctgaccaaaggcttgggcagtgccctgtgtgttgcctgtgacctgacctacgagcaccagaggaacatggacagcaagctggccctgattgaccgactcatcagtcacggggccgacatcctgaagcctgtaatgctcaggcagggagaaaaggaggcagtgggcacagccgtggactatggctacttcagattcttccaggaccggaggattgcccgctgccccttccacacgctgatgccagcagagcgcgagacgttcctggcgcggaagcggctcctggagtacatgggcttgcagctacggcaggctgtctttgccaaggagagccagtgggaccccacgtggctgtacctgtgcaagagagcggagctgatccccagccacaggatgaagaagaagggccccagcctgcccaggggcctggatgtgaaggagcaggggcaaattcccttcttcaagttctgctaccagtgtggccgctccatcggggtccgcctcttgccctgccctcgctgctacgggatcctgacctgcagcaagtactgcaagaccaaggcctggaccgagttccacaagaaggactgcggggacctggtggccatcgtgacacaactggagcaagtttccaggaggagagaagaattccagtgaagcagcagctgcacgtccgaggcttggggaggacccaggactgtgtgggtttcttacctgcctgagccacctcagggaatcttccagcctaatgcaggcatttctgcacctttggggtcatgctttgtagcagtgtctcccttgcgacctcgcaataaattggccccacggggtgattttgacagtc

SEQ ID NO: 107413 - DNA, 2499 bp, Homo sapiens
  Payload ID: 1080
  Gene Symbol: ANKMY1
  Gene Name: ankyrin repeat and MYND domain containing 1
  Uniprot ID: Q9P2S6
  ENST ID: ENST00000361678
  CDS Start-End: 159-2312
cggggctgtctccagggaaacgcgacgctctccgtaggcgcagggctggcaagcagtcgggacgggagcgcgggcgtccgcggtggctgcagtcccgtcggtctccctgctgtccggcgcgagctcttcgagtcttgcttggttggaagaccacagacatggaaggggcccatgcctcccttagcttagaggacgaagtctctggggctggcagccgccaacgcccgctagaggggaagggcggcgagacccctgctgccgaggagccggggtccctgaagaactacgctgtcttcgccacaagggatgtttcagcagcccctgagaaggaagaggaggaagctgagggcccgctgagggcgcaggacctgagggagtcctacatccagctcgtccagggtgtgcaggagtggcaggatggttgcatgtaccagggggagtttgggttgaacatgaagcttggatatggcaaattctcttggcccacaggcgagtcataccatgggcagttttaccgggaccactgccatggcctgggtacctacatgtggccagatggctccagtttcacgggcacattttacctcagccaccgagaaggctacggcaccatgtacatgaagacacggcttttccagactcactgccacaacgacattgtcaaccttctcctggactgtggggccgacgtgaacaagtgctcagatgagggtctcacggcactcagcatgtgtttcctcctccactaccccgcccagtccttcaagcccaatgttgctgaacggaccatacctgagccccaggaacctccaaaattcccagttgttccaatcctttcatcatcatttatggacacaaacctggagtctctgtactatgaggtgaacgtgccttcccagggtagctatgagctgaggccaccgccagcaccactgctcctgccacgcgtctcaggcagccacgagggcggccacttccaggacaccgggcagtgtggggggtccatagaccacaggagcagctctctgaagggggactccccgttggtgaagggcagccttggccatgtggaaagcgggcttgaggacgtgttgggaaacacagaccggggcagtctgtgcagtgctgagacgaaatttgagtccaacgtgtgtgtgtgcgacttctccatcgagctctcgcaggccatgctggagagaagcgcccagtcccacagcttgctgaagatggcctcgccctcaccgtgcaccagcagcttcgacaaagggaccatgcggaggatggcgctgtccatgatcgagcggaggaagcgctggcggaccatcaagctgctgctgcgccggggcgcggaccccaacctgtgctgcgtgcccatgcaggtcctgttccttgctgtgaaggccggggacgtggatggggtgaggctgctgctggagcacggggcgaggaccgacatctgctttccgccgcagctgagcaccctgacaccactccacatcgctgccgcccttcctggggaggagggggtacagattgtggagctgctgttgcatgccatcaccgatgtggacgccaaggcatccgacgaggacgacacttacaagcccggcaaggttgtgaaggagctcctgacccagggagctgaccccaacctgcccctgaccaaaggcttgggcagtgccctgtgtgttgcctgtgacctgacctacgagcaccagaggaacatggacagcaagctggccctgattgaccgactcatcagtcacggggccgacatcctgaagcctgtaatgctcaggcagggagaaaaggaggcagtgggcacagccgtggactatggctacttcagattcttccaggaccggaggattgcccgctgccccttccacacgctgatgccagcagagcgcgagacgttcctggcgcggaagcggctcctggagtacatgggcttgcagctacggcaggctgtctttgccaaggagagccagtgggaccccacgtggctgtacctgtgcaagagagcggagctgatccccagccacaggatgaagaagaagggccccagcctgcccaggggcctggatgtgaaggagcaggggcaaattcccttcttcaagttctgctaccagtgtggccgctccatcggggtccgcctcttgccctgccctcgctgctacgggatcctgacctgcagcaagtactgcaagaccaaggcctggaccgagttccacaagaaggactgcggggacctggtggccatcgtgacacaactggagcaagtttccaggaggagagaagaattccagtgaagcagcagctgcacgtccgaggcttggggaggacccaggactgtgtgggtttcttacctgcctgagccacctcagggaatcttccagcctaatgcaggcatttctgcacctttggggtcatgctttgtagcagtgtctcccttgcgacctcgcaataaattggccccacggggtgattttgacagtc

SEQ ID NO: 107414 - DNA, 2449 bp, Homo sapiens
  Payload ID: 1080
  Gene Symbol: ANKMY1
  Gene Name: ankyrin repeat and MYND domain containing 1
  ENST ID: ENST00000373318
  CDS Start-End: 100-2262
ggacgggagcgcgggcgtccgcggtggctgcagtcccgtcggtctccctgctgtccggcgcgagctcttcgagtcttgcttggttggaagaccacagacatggaaggggcccatgcctcccttagcttagaggacgaagtctctggggctggcagccgccaacgcccgctagaggggaagggcggcgagacccctgctgccgaggagccggggtccctgaagaactacgctgtcttcgccacaagggatgtttcagcagcccctgagaaggaagaggaggaagctgagggcccgctgagggcgcaggacctgagggagtcctacatccagctcgtccagggtgtgcaggagtggcaggatggttgcatgtaccagggggagtttgggttgaacatgaagcttggatatggcaaattctcttggcccacaggcgagtcataccatgggcagttttaccgggaccactgccatggcctgggtacctacatgtggccagatggctccagtttcacgggcacattttacctcagccaccgagaaggctacggcaccatgtacatgaagacacggcttttccagactcactgccacaacgacattgtcaaccttctcctggactgtggggccgacgtgaacaagtgctcagatgagggtctcacggcactcagcatgtgtttcctcctccactaccccgcccagtccttcaagcccaatgttgctgaacggaccatacctgagccccaggaacctccaaaattcccagttgttccaatcctttcatcatcatttatggacacaaacctggagtctctgtactatgaggtgaacgtgccttcccagggtagctatgagctgaggccaccgccagcaccactgctcctgccacgcgtctcaggcagccacgagggcggccacttccaggacaccgggcagtgtggggggtccatagaccacaggagcagctctctgaagggggactccccgttggtgaagggcagccttggccatgtggaaagcgggcttgaggacgtgttgggaaacacagaccggggcagtctgtgcagtgctgagacgaaatttgagtccaacgtgtgtgtgtgcgacttctccatcgagctctcgcaggccatgctggagagaagcgcccagtcccacagcttgctgaagatggcctcgccctcaccgtgcaccagcagcttcgacaaagggaccatgcggaggatggcgctgtccatgatcgagcggaggaagcgctggcggaccatcaagctgctgctgcgccggggcgcggaccccaacctgtgctgcgtgcccatgcaggtcctgttccttgctgtgaaggccggggacgtggatggggtgaggctgctgctggagcacggggcgaggaccgacatctgctttccgccgcagctgagcaccctgacaccactccacatcgctgccgcccttcctggggaggagggggtacagattgtggagctgctgttgcatgccatcaccgatgtggacgccaaggcatccgacgaggacgacacttacaagcccggcaagctggacctgctgccctcaagtctgaagctcagcaatgagccaggccctccccaagcctactacagcacggacacagccctcccggaggaggggggcaggacggctctgcacatggcctgcgagcgggaggatgacaacaagattgaccgactcatcagtcacggggccgacatcctgaagcctgtaatgctcaggcagggagaaaaggaggcagtgggcacagccgtggactatggctacttcagattcttccaggaccggaggattgcccgctgccccttccacacgctgatgccagcagagcgcgagacgttcctggcgcggaagcggctcctggagtacatgggcttgcagctacggcaggctgtctttgccaaggagagccagtgggaccccacgtggctgtacctgtgcaagagagcggagctgatccccagccacaggatgaagaagaagggccccagcctgcccaggggcctggatgtgaaggagcaggggcaaattcccttcttcaagttctgctaccagtgtggccgctccatcggggtccgcctcttgccctgccctcgctgctacgggatcctgacctgcagcaagtactgcaagaccaaggcctggaccgagttccacaagaaggactgcggggacctggtggccatcgtgacacaactggagcaagtttccaggaggagagaagaattccagtgaagcagcagctgcacgtccgaggcttggggaggacccaggactgtgtgggtttcttacctgcctgagccacctcagggaatcttccagcctaatgcaggcatttctgcacctttggggtcatgctttgtagcagtgtctcccttgcgacctcgcaataaattggccccacggggtgattttgacagtc

SEQ ID NO: 107415 - DNA, 3221 bp, Homo sapiens
  Payload ID: 1080
  Gene Symbol: ANKMY1
  Gene Name: ankyrin repeat and MYND domain containing 1
  ENST ID: ENST00000391987
  CDS Start-End: 426-1166
cggggctgtctccagggaaacgcgacgctctccgtaggcgcagggctggcaagcagtcgggacgggagcgcgggcgtccgcggtggctgcagtcccgtcggtctccctgctgtccggcgcgagctcttcgagtcttgcttggttggaagaccacagacatggaaggggcccatgcctcccttagcttagaggacgaagtctctggggctggcagccgccaacgcccgctagaggggaagggcggcgagacccctgctgccgaggagccggggtccctgaagaactacgctgtcttcgccacaagggatgtttcagcagcccctgagaaggaagaggaggaagctgagggcccgctgagggcgcaggacctgagggagtcctacatccagctcgtccagggtgtgcaggagtggcaggatggttgcatgtaccagggggagtttgggttgaacatgaagcttggatatggcaaattctcttggcccacaggcgagtcataccatgggcagttttaccgggaccactgccatggcctgggtacctacatgtggccagatggctccagtttcacgggcacattttacctcagccaccgagaaggctacggcaccatgtacatgaagacacggcttttccaggggctatacaaagcggaccagcggtttgggccaggtgtcgagacctaccccgatggcagccaggacgtggggctgtggttccgagagcagctcatcaagctgtgcacccagatccccagtggcttctccctcctcagataccctgagttctccagcttcatcacccacagccctgccaggatcagcctctcagaagaggagaaaacggagtggggactgcaggagggacaggatccctttttctatgactataagcggtttcttctgaatgacaacctaacgctgcctccagaaatgtatgtctactcgaccaacagtgaccacctgcccatgacaagctctttccgcaaagagctggacgcccgcatcttcctcaatgaaattcctccgttcgttgaggatggagaaccatggttcataatcaatgagacccctttgttggtcaaaatccagaagcaaacttacaagttcagactcactgccacaacgacattgtcaaccttctcctggactgtggggccgacgtgaacaagtgctcagatgagggtctcacggcactcagcatgtgtttcctcctccactaccccgcccagtccttcaagcccaatgttgctgaacggaccatacctgagccccaggaacctccaaaattcccagttgttccaatcctttcatcatcatttatggacacaaacctggagtctctgtactatgaggtgaacgtgccttcccagggtagctatgagctgaggccaccgccagcaccactgctcctgccacgcgtctcaggcagccacgagggcggccacttccaggacaccgggcagtgtggggggtccatagaccacaggagcagctctctgaagggggactccccgttggtgaagggcagccttggccatgtggaaagcgggcttgaggacgtgttgggaaacacagaccggggcagtctgtgcagtgctgagacgaaatttgagtccaacgtgtgtgtgtgcgacttctccatcgagctctcgcaggccatgctggagagaagcgcccagtcccacagcttgctgaagatggcctcgccctcaccgtgcaccagcagcttcgacaaagggaccatgcggaggatggcgctgtccatgatcgagcggaggaagcgctggcggaccatcaagctgctgctgcgccggggcgcggaccccaacctgtgctgcgtgcccatgcaggtcctgttccttgctgtgaaggccggggacgtggatggggtgaggctgctgctggagcacggggcgaggaccgacatctgctttccgccgcagctgagcaccctgacaccactccacatcgctgccgcccttcctggggaggagggggtacagattgtggagctgctgttgcatgccatcaccgatgtggacgccaaggcatccgacgaggacgacacttacaagcccggcaagctggacctgctgccctcaagtctgaagctcagcaatgagccaggccctccccaagcctactacagcacggacacagccctcccggaggaggggggcaggacggctctgcacatggcctgcgagcgggaggatgacaacaagtgtgccagggacatagtccggctccttctatcccacggagcaaatcctaacctgctgtggagtggccactccccgctctccctgtccattgccagtgggaatgagctggttgtgaaggagctcctgacccagggagctgaccccaacctgcccctgaccaaaggcttgggcagtgccctgtgtgttgcctgtgacctgacctacgagcaccagaggaacatggacagcaagctggccctgattgaccgactcatcagtcacggggccgacatcctgaagcctgtaatgctcaggcagggagaaaaggaggcagtgggcacagccgtggactatggctacttcagattcttccaggaccggaggattgcccgctgccccttccacacgctgatgccagcagagcgcgagacgttcctggcgcggaagcggctcctggagtacatgggcttgcagctacggcaggctgtctttgccaaggagagccagtgggaccccacgtggctgtacctgtgcaagagagcggagctgatccccagccacaggatgaagaagaagggccccagcctgcccaggggcctggatgtgaaggagcaggggcaaattcccttcttcaagttctgctaccagtgtggccgctccatcggggtccgcctcttgccctgccctcgctgctacgggatcctgacctgcagcaagtactgcaagaccaaggcctggaccgagttccacaagaaggactgcggggacctggtggccatcgtgacacaactggagcaagtttccaggaggagagaagaattccagtgaagcagcagctgcacgtccgaggcttggggaggacccaggactgtgtgggtttcttacctgcctgagccacctcagggaatcttccagcctaatgcaggcatttctgcacctttggggtcatgctttgtagcagtgtctcccttgcgacctcgcaataaattggccccacggggtgattttgacagtc

SEQ ID NO: 107416 - DNA, 569 bp, Homo sapiens
  Payload ID: 1080
  Gene Symbol: ANKMY1
  Gene Name: ankyrin repeat and MYND domain containing 1
  ENST ID: ENST00000391988
  CDS Start-End: 1-569
gaagcgctggcggaccatcaagctgctgctgcgccggggcgcggaccccaacctgtgctgcgtgcccatgcaggtcctgttccttgctgtgaaggccggggacgtggatggggtgaggctgctgctggagcacggggcgaggaccgacatctgctttccgccgcagctgagcaccctgacaccactccacatcgctgccgcccttcctggggaggagggggtacagattgtggagctgctgttgcatgccatcaccgatgtggacgccaaggcatccgacgaggacgacacttacaagcccggcaagtgtgccagggacatagtccggctccttctatcccacggagcaaatcctaacctgctgtggagtggccactccccgctctccctgtccattgccagtgggaatgagctggttgtgaaggagctcctgacccagggagctgaccccaacctgcccctgaccaaaggcttgggcagtgccctgtgtgttgcctgtgacctgacctacgagcaccagaggaacatggacagcaagctggccctgattgaccgactcatcagtcacg

SEQ ID NO: 107417 - DNA, 2874 bp, Homo sapiens
  Payload ID: 1080
  Gene Symbol: ANKMY1
  Gene Name: ankyrin repeat and MYND domain containing 1
  ENST ID: ENST00000403283
  CDS Start-End: 161-2692
ctcgaaacaccgcccccctaaaggcccgcccacctggaaggccttcgccaggctgaggccgcggtgccgcatgaggtacgcggtgcagacggcggccgagcggctgcggccgttcttgcagtagactaggcaggcgccgccggcgcgcaccgcggcctccatggcggcgcacgtgggctccaggtgcgccagcaggtcctcagccgggtcgtcgaacacgggcacgcgcagctctgccacgccgggcgcgcgcgggccgggctgctggcgggagacgttgacgcacagcgtgactcccgcgcgcgccagctgctcctccgcgcccgcggctcgcgcgctcccgaggaagagtgagggcgcgacgcgcaccaacggtggaggttggaagaccacagacatggaaggggcccatgcctcccttagcttagaggacgaagtctctggggctggcagccgccaacgcccgctagaggggaagggcggcgagacccctgctgccgaggagccggggtccctgaagaactacgctgtcttcgccacaagggatgtttcagcagcccctgagaaggaagaggaggaagctgagggcccgctgagggcgcaggacctgagggagtcctacatccagctcgtccagggtgtgcaggagtggcaggatggttgcatgtaccagggggagtttgggttgaacatgaagcttggatatggcaaattctcttggcccacaggcgagtcataccatgggcagttttaccgggaccactgccatggcctgggtacctacatgtggccagatggctccagtttcacgggcacattttacctcagccaccgagaaggctacggcaccatgtacatgaagacacggcttttccagactcactgccacaacgacattgtcaaccttctcctggactgtggggccgacgtgaacaagtgctcagatgagggtctcacggcactcagcatgtgtttcctcctccactaccccgcccagtccttcaagcccaatgttgctgaacggaccatacctgagccccaggaacctccaaaattcccagttgttccaatcctttcatcatcatttatggacacaaacctggagtctctgtactatgaggtgaacgtgccttcccagggtagctatgagctgaggccaccgccagcaccactgctcctgccacgcgtctcaggcagccacgagggcggccacttccaggacaccgggcagtgtggggggtccatagaccacaggagcagctctctgaagggggactccccgttggtgaagggcagccttggccatgtggaaagcgggcttgaggacgtgttgggaaacacagaccggggcagtctgtgcagtgctgagacgaaatttgagtccaacgtgtgtgtgtgcgacttctccatcgagctctcgcaggccatgctggagagaagcgcccagtcccacagcttgctgaagatggcctcgccctcaccgtgcaccagcagcttcgacaaagggaccatgcggaggatggcgctgtccatgatcgagcggaggaagcgctggcggaccatcaagctgctgctgcgccggggcgcggaccccaacctgtgctgcgtgcccatgcaggtcctgttccttgctgtgaaggccggggacgtggatggggtgaggctgctgctggagcacggggcgaggaccgacatctgctttccgccgcagctgagcaccctgacaccactccacatcgctgccgcccttcctggggaggagggggtacagattgtggagctgctgttgcatgccatcaccgatgtggacgccaaggcatccgacgaggacgacacttacaagcccggcaagctggacctgctgccctcaagtctgaagctcagcaatgagccaggccctccccaagcctactacagcacggacacagccctcccggaggaggggggcaggacggctctgcacatggcctgcgagcgggaggatgacaacaaggttgtgaaggagctcctgacccagggagctgaccccaacctgcccctgaccaaaggcttgggcagtgccctgtgtgttgcctgtgacctgacctacgagcaccagaggaacatggacagcaagctggccctgattgaccgactcatcagtcacggggccgacatcctgaagcctgtaatgctcaggcagggagaaaaggaggcagtgggcacagccgtggactatggctacttcagattcttccaggaccggaggattgcccgctgccccttccacacgctgatgccagcagagcgcgagacgttcctggcgcggaagcggctcctggagtacatgggcttgcagctacggcaggctgtctttgccaaggagagccagtgggaccccacgtggctgtacctgtgcaagagagcggagctgatccccagccacaggatgaagaagaagggccccagcctgcccaggggcctggatgtgaaggagcaggggcaaattcccttcttcaagttctgctaccagtgtggccgctccatcggggtccgcctcttgccctgccctcgctgctacgggatcctgacctgcagcaagtactgcaagaccaaggcctggaccgagttccacaagaaggactgcggggacctggtggccatcgtgacacaactggagcaagtttccaggaggagagaagaattccagtgaagcagcagctgcacgtccgaggcttggggaggacccaggactgtgtgggtttcttacctgcctgagccacctcagggaatcttccagcctaatgcaggcatttctgcacctttggggtcatgctttgtagcagtgtctcccttgcgacctcgcaataaattggccccacggggtgattttga

SEQ ID NO: 107418 - DNA, 2396 bp, Homo sapiens
  Payload ID: 1080
  Gene Symbol: ANKMY1
  Gene Name: ankyrin repeat and MYND domain containing 1
  ENST ID: ENST00000406958
  CDS Start-End: 101-2209
gggacgggagcgcgggcgtccgcggtggctgcagtcccgtcggtctccctgctgtccggcgcgagctcttcgagtcttgcttggttggaagaccacagacatggaaggggcccatgcctcccttagcttagaggacgaagtctctggggctggcagccgccaacgcccgctagaggggaagggcggcgagacccctgctgccgaggagccggggtccctgaagaactacgctgtcttcgccacaagggatgtttcagcagcccctgagaaggaagaggaggaagctgagggcccgctgagggcgcaggacctgagggagtcctacatccagctcgtccagggtgtgcaggagtggcaggatggttgcatgtaccagggggagtttgggttgaacatgaagcttggatatggcaaattctcttggcccacaggcgagtcataccatgggcagttttaccgggaccactgccatggcctgggtacctacatgtggccagatggctccagtttcacgggcacattttacctcagccaccgagaaggctacggcaccatgtacatgaagacacggcttttccagactcactgccacaacgacattgtcaaccttctcctggactgtggggccgacgtgaacaagtgctcagatgagggtctcacggcactcagcatgtgtttcctcctccactaccccgcccagtccttcaagcccaatgttgctgaacggaccatacctgagccccaggaacctccaaaattcccagttgttccaatcctttcatcatcatttatggacacaaacctggagtctctgtactatgagctctcgcaggccatgctggagagaagcgcccagtcccacagcttgctgaagatggcctcgccctcaccgtgcaccagcagcttcgacaaagggaccatgcggaggatggcgctgtccatgatcgagcggaggaagcgctggcggaccatcaagctgctgctgcgccggggcgcggaccccaacctgtgctgcgtgcccatgcaggtcctgttccttgctgtgaaggccggggacgtggatggggtgaggctgctgctggagcacggggcgaggaccgacatctgctttccgccgcagctgagcaccctgacaccactccacatcgctgccgcccttcctggggaggagggggtacagattgtggagctgctgttgcatgccatcaccgatgtggacgccaaggcatccgacgaggacgacacttacaagcccggcaagctggacctgctgccctcaagtctgaagctcagcaatgagccaggccctccccaagcctactacagcacggacacagccctcccggaggaggggggcaggacggctctgcacatggcctgcgagcgggaggatgacaacaagtgtgccagggacatagtccggctccttctatcccacggagcaaatcctaacctgctgtggagtggccactccccgctctccctgtccattgccagtgggaatgagctggttgtgaaggagctcctgacccagggagctgaccccaacctgcccctgaccaaaggcttgggcagtgccctgtgtgttgcctgtgacctgacctacgagcaccagaggaacatggacagcaagctggccctgattgaccgactcatcagtcacggggccgacatcctgaagcctgtaatgctcaggcagggagaaaaggaggcagtgggcacagccgtggactatggctacttcagattcttccaggaccggaggattgcccgctgccccttccacacgctgatgccagcagagcgcgagacgttcctggcgcggaagcggctcctggagtacatgggcttgcagctacggcaggctgtctttgccaaggagagccagtgggaccccacgtggctgtacctgtgcaagagagcggagctgatccccagccacaggatgaagaagaagggccccagcctgcccaggggcctggatgtgaaggagcaggggcaaattcccttcttcaagttctgctaccagtgtggccgctccatcggggtccgcctcttgccctgccctcgctgctacgggatcctgacctgcagcaagtactgcaagaccaaggcctggaccgagttccacaagaaggactgcggggacctggtggccatcgtgacacaactggagcaagtttccaggaggagagaagaattccagtgaagcagcagctgcacgtccgaggcttggggaggacccaggactgtgtgggtttcttacctgcctgagccacctcagggaatcttccagcctaatgcaggcatttctgcacctttggggtcatgctttgtagcagtgtctcccttgcgacctcgcaataaattggccccacggggtgattttgacagtc

SEQ ID NO: 107419 - DNA, 3304 bp, Homo sapiens
  Payload ID: 1080
  Gene Symbol: ANKMY1
  Gene Name: ankyrin repeat and MYND domain containing 1
  ENST ID: ENST00000405002
  CDS Start-End: 483-1361
aaaggcccgcccacctggaaggccttcgccaggctgaggccgcggtgccgcatgaggtacgcggtgcagacggcggccgagcggctgcggccgttcttgcagtagactaggcaggcgccgccggcgcgcaccgcggcctccatggcggcgcacgtgggctccaggtgcgccagcaggtcctcagccgggtcgtcgaacacgggcacgcgcagctctgccacgccgggcgcgcgcgggccgggctgctggcgggagacgttgacgcacagcgtgactcccgcgcgcgccagctgctcctccgcgcccgcggctcgcgcgctcccgaggaagagtgagggcgcgacgcgcaccaacggtggagggatgtttcagcagcccctgagaaggaagaggaggaagctgagggcccgctgagggcgcaggacctgagggagtcctacatccagctcgtccagggtgtgcaggagtggcaggatggttgcatgtaccagggggagtttgggttgaacatgaagcttggatatggcaaattctcttggcccacaggcgagtcataccatgggcagttttaccgggaccactgccatggcctgggtacctacatgtggccagatggctccagtttcacgggcacattttacctcagccaccgagaaggctacggcaccatgtacatgaagacacggcttttccagactcactgccacaacgacattgtcaaccttctcctggactgtggggccgacgtgaacaagtgctcagatgagggtctcacggcactcagcatgtgtttcctcctccactaccccgcccagtccttcaagcccaatgttgctgaacggaccatacctgagccccaggaacctccaaaattcccagttgttccaatcctttcatcatcatttatggacacaaacctggagtctctgtactatgaggtgaacgtgccttcccagggtagctatgagctgaggccaccgccagcaccactgctcctgccacgcgtctcaggcagccacgagggcggccacttccaggacaccgggcagtgtggggggtccatagaccacaggagcagctctctgaagggggactccccgttggtgaagggcagccttggccatgtggaaagcgggcttgaggacgtgttgggaaacacagaccggggcagtctgtgcagtgctgagacgaaatttgagtccaacgtgtgtgtgtgcgacttctccatcgagctctcgcaggccatgctggagagaagcgcccagtcccacagcttgctgaagatggcctcgccctcaccgtgcaccagcagcttcgacaaagggaccatgcggaggatggcgctgtccatgatcgagtaggtcctggcaccagctggtgggggtggagggccaccatcagggctgaatcctatgctcagcagacccacgtctcttccctgtgccagtgggaggcgttgtgtctggagatgtgtgtctgaatgtgtgagcatccctgtgtcggtggctccacgccatggccagccctgtgggggtgccacggtgacgggctgttttcagtgccaccccagccctgtgggggtgccacggtgacgggctgttttcagtaccacgccagccctgctttggcctttggcactggcctgaagtgtctctgtgggagcctcagcaggggccactgtcaggggtcctatcctagccatagtgcacgtgagtgacacctgcctgggcagctctcacacccctgctgtccaccctgtctataccagtgtgtctcaaaatgtggtctatgcacccccgggggtccaagaccctttcagggagtctgtggggtcaaaatgattctcttgataaccctgagactctgttagccttctccttgtgttgatgttggtggatggtatgaagacagggccgtgcagaccaccagcccccagcgtgcagggcagcagtgcccggcctgcttgggggcatggtattccttcaccacggtgtgcacttgcggggatgcctgtctcactgaagaatgcctttgacaaagcagaaaagcaatgacaaattgcattaaatcttgctccttgcgtacacacccctcgaatattctgggtcggaaaacatgggaaggacactgatgtgtgtctgccacagaccaaggcacaccgcttccccgcaagaagcgcttcccccagggccagagtagcaacagaatgcggcatcttcccaacctcctgccccatttttgattggaagaatgaccactggtatgtggctgttcattctcctgaacacagcctgccactttaaggaaaacatatgacactatttgttgctggcgaaatttacattttcaagtgaatagcagaattctggacacttgccaccaccaccaagaccttcatagcttcccttaactttgagacatgggtgttcagaggtttttcacgtgagatggcgttagcagcgcagttttgtgatactgcctgaagacatgccgacagtgcccagatctcttctattggtgagccagcttttcccacacggccaagttctgatgttgaaccattgccaggtgggtgaagatccattgacagtgagaggtgggcccgtgggcttcagtgcagccaggcgcagaaggctggttcatgagtgtccagctccgccaggtagctagctcaccacccccagcctgggttcatgtagttcaaataggaagaccacgatgatcagaaaggctgctcaaatactccttcgtccagccgcgtacctgggggaggctgaatctccactcacttccaccaaggctgtgcagagcagataggggaatccagcaaaggtggaaaacagtgccatccttctccccaactggttttgttttgtaaaataactttttgtgacagtgttacttattagtaacatgcagtgggtttgttatggttaacaagttggtgagcattattgagaggtgaagccagctgagcttctgggttgggtggggacttggagaacttttgtgtctagctaaaggattgtaaatgcaccaatcaatgctcagtgtctagctaaaggattgtaaatgcaccaatcagcactctgtaaaattgaccaatcagcgttctgtaaaatggaccaatcagtggtctgtaaaatggaccagtcagcaggatgtgggcggggccaaaaaagggaataaaagctggccaccgccaggctccccaccagcctgcagcgacaacctgcttagtttcctttctgtgctgtggaagctttgttctttcagtcttcacaataaatcttgctgctgctca

SEQ ID NO: 107420 - DNA, 252 bp, Homo sapiens
  Payload ID: 1080
  Gene Symbol: ANKMY1
  Gene Name: ankyrin repeat and MYND domain containing 1
  ENST ID: ENST00000407275
  CDS Start-End: 1-252
gccccttccacacgctgatgccagcagagcgcgagacgttcctggcgcggaagcggctcctggagtacatgggcttgcagctacggcaggctgtctttgccaaggagagccagtgggaccccacgtggctgtacctgtgcaagagagaattcccttcttcaagttctgctaccagtgtggccgctccatcggggtccgcctcttgccctgccctcgctgctacgggatcctgacctgcagcaagtactgcaa

SEQ ID NO: 107421 - DNA, 1827 bp, Homo sapiens
  Payload ID: 1080
  Gene Symbol: ANKMY1
  Gene Name: ankyrin repeat and MYND domain containing 1
  Uniprot ID: Q9P2S6
  ENST ID: ENST00000405523
  CDS Start-End: 159-1478
cggggctgtctccagggaaacgcgacgctctccgtaggcgcagggctggcaagcagtcgggacgggagcgcgggcgtccgcggtggctgcagtcccgtcggtctccctgctgtccggcgcgagctcttcgagtcttgcttggttggaagaccacagacatggaaggggcccatgcctcccttagcttagaggacgaagtctctggggctggcagccgccaacgcccgctagaggggaagggcggcgagacccctgctgccgaggagccggggtccctgaagaactacgctgtcttcgccacaagggatgtttcagcagcccctgagaaggaagaggaggaagctgagggcccgctgagggcgcaggacctgagggagtcctacatccagctcgtccagggtgtgcaggagtggcaggatggttgcatgtaccagggggagtttgggttgaacatgaagcttggatatggcaaattctcttggcccacaggcgagtcataccatgggcagttttaccgggaccactgccatggcctgggtacctacatgtggccagatggctccagtttcacgggcacattttacctcagccaccgagaaggctacggcaccatgtacatgaagacacggcttttccagactcactgccacaacgacattgtcaaccttctcctggactgtggggccgacgtgaacaagtgctcagatgagggtctcacggcactcagcatgtgtttcctcctccactaccccgcccagtccttcaagcccaatgttgctgaacggaccatacctgagccccaggaacctccaaaattcccagttgttccaatcctttcatcatcatttatggacacaaacctggagtctctgtactatgaggtgaacgtgccttcccagggtagctatgagctgaggccaccgccagcaccactgctcctgccacgcgtctcaggcagccacgagggcggccacttccaggacaccgggcagtgtggggggtccatagaccacaggagcagctctctgaagggggactccccgttggtgaagggcagccttggccatgtggaaagcgggcttgaggacgtgttgggaaacacagaccggggcagtctgtgcagtgctgagacgaaatttgagtccaacgtgtgtgtgtgcgacttctccatcgagctctcgcaggccatgctggagagaagcgcccagtcccacagcttgctgaagatggcctcgccctcaccgtgcaccagcagcttcgacaaagggaccatgcggaggatggcgctgtccatgatcgagcggaggaagcgctggcggaccatcaagctgctgctgcgccggggcgcggaccccaacctgtgctgcgtgcccatgcaggtcctgttccttgctgtgaaggccggggacgtggatggggtgaggctgctgctggagcacggggcgaggaccgacatctgctttccgccgcagtgttgaagcaaactaaggggaagcgcatcctgaaggccccttggaaaggggagacttatattcaggaggaggcgggcctcctttcaacccacgctcagcatcacaaggacgcaggcaggagaggcaaagggttttggtgctgaggttttatctttagctcaacagatccagccgcaaaatatttagctgagaaaaaatcttcgaaggggaatctgattttatattttttttcttaagaagtgcctttcccagcggacggcttcttccctctctgaggccacacccacccgtgagcaagcggcttcacagggcattttgctctggaataaattagcctgctagttcttcgaagaaa

SEQ ID NO: 107422 - DNA, 3232 bp, Homo sapiens
  Payload ID: 1080
  Gene Symbol: ANKMY1
  Gene Name: ankyrin repeat and MYND domain containing 1
  ENST ID: ENST00000401804
  CDS Start-End: 140-3232
acgcgacgctctccgtaggcgcagggctggcaagcagtcgggacgggagcgcgggcgtccgcggtggctgcagtcccgtcggtctccctgctgtccggcgcgagctcttcgagtcttgcttggttggaagaccacagacatggaaggggcccatgcctcccttagcttagaggacgaagtctctggggctggcagccgccaacgcccgctagaggggaagggcggcgagacccctgctgccgaggagccggggtccctgaagaactacgctgtcttcgccacaagggatgtttcagcagcccctgagaaggaagaggaggaagctgagggcccgctgagggcgcaggacctgagggagtcctacatccagctcgtccagggtgtgcaggagtggcaggatggttgcatgtaccagggggagtttgggttgaacatgaagcttggatatggcaaattctcttggcccacaggcgagtcataccatgggcagttttaccgggaccactgccatggcctgggtacctacatgtggccagatggctccagtttcacgggcacattttacctcagccaccgagaaggctacggcaccatgtacatgaagacacggcttttccaggggctatacaaagcggaccagcggtttgggccaggtgtcgagacctaccccgatggcagccaggacgtggggctgtggttccgagagcagctcatcaagctgtgcacccagatccccagtggcttctccctcctcagataccctgagttctccagcttcatcacccacagccctgccaggatcagcctctcagaagaggagaaaacggagtggggactgcaggagggacaggatccctttttctatgactataagcggtttcttctgaatgacaacctaacgctgcctccagaaatgtatgtctactcgaccaacagtgaccacctgcccatgacaagctctttccgcaaagagctggacgcccgcatcttcctcaatgaaattcctccgttcgttgaggatggagaaccatggttcataatcaatgagacccctttgttggtcaaaatccagaagcaaacttacaagttcaggaacaagccagctcacaccagctggaacatgggcgccatcctggaggggaagcgcagtggctttgcaccctgtgggcccaaagagcaactttccatggagatgatcctaaaggctgaggaagggaaccacgaatggatttgtaggatcctgaaggacaactttgctagtgctgacgtggcggacgcaaagggctacactgtgcttgctgcggctgctactcactgccacaacgacattgtcaaccttctcctggactgtggggccgacgtgaacaagtgctcagatgagggtctcacggcactcagcatgtgtttcctcctccactaccccgcccagtccttcaagcccaatgttgctgaacggaccatacctgagccccaggaacctccaaaattcccagttgttccaatcctttcatcatcatttatggacacaaacctggagtctctgtactatgaggtgaacgtgccttcccagggtagctatgagctgaggccaccgccagcaccactgctcctgccacgcgtctcaggcagccacgagggcggccacttccaggacaccgggcagtgtggggggtccatagaccacaggagcagctctctgaagggggactccccgttggtgaagggcagccttggccatgtggaaagcgggcttgaggacgtgttgggaaacacagaccggggcagtctgtgcagtgctgagacgaaatttgagtccaacgtgtgtgtgtgcgacttctccatcgagctctcgcaggccatgctggagagaagcgcccagtcccacagcttgctgaagatggcctcgccctcaccgtgcaccagcagcttcgacaaagggaccatgcggaggatggcgctgtccatgatcgagcggaggaagcgctggcggaccatcaagctgctgctgcgccggggcgcggaccccaacctgtgctgcgtgcccatgcaggtcctgttccttgctgtgaaggccggggacgtggatggggtgaggctgctgctggagcacggggcgaggaccgacatctgctttccgccgcagctgagcaccctgacaccactccacatcgctgccgcccttcctggggaggagggggtacagattgtggagctgctgttgcatgccatcaccgatgtggacgccaaggcatccgacgaggacgacacttacaagcccggcaagctggacctgctgccctcaagtctgaagctcagcaatgagccaggccctccccaagcctactacagcacggacacagccctcccggaggaggggggcaggacggctctgcacatggcctgcgagcgggaggatgacaacaagtgtgccagggacatagtccggctccttctatcccacggagcaaatcctaacctgctgtggagtggccactccccgctctccctgtccattgccagtgggaatgagctggttgtgaaggagctcctgacccagggagctgaccccaacctgcccctgaccaaaggcttgggcagtgccctgtgtgttgcctgtgacctgacctacgagcaccagaggaacatggacagcaagctggccctgattgaccgactcatcagtcacggggccgacatcctgaagcctgtaatgctcaggcagggagaaaaggaggcagtgggcacagccgtggactatggctacttcagattcttccaggaccggaggattgcccgctgccccttccacacgctgatgccagcagagcgcgagacgttcctggcgcggaagcggctcctggagtacatgggcttgcagctacggcaggctgtctttgccaaggagagccagtgggaccccacgtggctgtacctgtgcaagagagcggagctgatccccagccacaggatgaagaagaagggccccagcctgcccaggggcctggatgtgaaggagcaggggcaaattcccttcttcaagttctgctaccagtgtggccgctccatcggggtccgcctcttgccctgccctcgctgctacgggatcctgacctgcagcaagtactgcaagaccaaggcctggaccgagttccacaagaaggactgcggggacctggtggccatcgtgacacaactggagcaagtttccaggaggagagaagaattccagtga

SEQ ID NO: 107423 - DNA, 565 bp, Homo sapiens
  Payload ID: 1080
  Gene Symbol: ANKMY1
  Gene Name: ankyrin repeat and MYND domain containing 1
  ENST ID: ENST00000443318
  CDS Start-End: 1-565
gcgctcccgaggaagagtgagggcgcgacgcgcaccaacggtggaggggctatacaaagcggaccagcggtttgggccaggtgtcgagacctaccccgatggcagccaggacgtggggctgtggttccgagagcagctcatcaagctgtgcacccagatccccagtggcttctccctcctcagataccctgagttctccagcttcatcacccacagccctgccaggatcagcctctcagaagaggagaaaacggagtggggactgcaggagggacaggatccctttttctatgactataagcggtttcttctgaatgacaacctaacgctgcctccagaaatgtatgtctactcgaccaacagtgaccacctgcccatgacaagctctttccgcaaagagctggacgcccgcatcttcctcaatgaaattcctccgttcgttgaggatggagaaccatggttcataatcaatgagacccctttgttggtcaaaatccagaagcaaacttacaagttcagactcactgccacaacgacattgtcaaccttctcctggactgtgggg

SEQ ID NO: 107424 - DNA, 652 bp, Homo sapiens
  Payload ID: 1080
  Gene Symbol: ANKMY1
  Gene Name: ankyrin repeat and MYND domain containing 1
  ENST ID: ENST00000411765
  CDS Start-End: 430-652
acagcgtgactcccgcgcgcgccagctgctcctccgcgcccgcggctcgcgcgctcccgaggaagagtgagggcgcgacgcgcaccaacggtggaggaaggcccagctgtttcccaccatggtgcctctgtacatcccagtccagttcctgaaatgcgctctgtagcctggagagctcctgcgcatcctgtgaagccccatcaagaatccgctctcctgcagtccttccccgaggccctcggagggtccaagacagccaatccctcttctctgcggtgactcttgcggcctccctcatctcgttccctccgcaggcctcgagttacccttgcgccttccacatttactgaatgaacaaaggccggggctggaatcaggcagggcttgagcaagtcgtggctccacgtgctaggttggaagaccacagacatggaaggggcccatgcctcccttagcttagaggacgaagtctctggggctggcagccgccaacgcccgctagaggggaagggcggcgagacccctgctgccgaggagccggggtccctgaagaactacgctgtcttcgccacaagggatgtttcagcagcccctgagaaggaagaggaggaagctgagggcccgctgagggcgcaggacctgagggagtcct

SEQ ID NO: 107425 - DNA, 555 bp, Homo sapiens
  Payload ID: 1080
  Gene Symbol: ANKMY1
  Gene Name: ankyrin repeat and MYND domain containing 1
  ENST ID: ENST00000441168
  CDS Start-End: 52-555
aaaggcccgcccacctggaaggccttcgccaggctgaggccgcggtgccgcatgagggatgtttcagcagcccctgagaaggaagaggaggaagctgagggcccgctgagggcgcaggacctgagggagtcctacatccagctcgtccagggtgtgcaggagtggcaggatggttgcatgtaccagggggagtttgggttgaacatgaagcttggatatggcaaattctcttggcccacaggcgagtcataccatgggcagttttaccgggaccactgccatggcctgggtacctacatgtggccagatggctccagtttcacgggcacattttacctcagccaccgagaaggctacggcaccatgtacatgaagacacggcttttccagactcactgccacaacgacattgtcaaccttctcctggactgtggggccgacgtgaacaagtgctcagatgagggtctcacggcactcagcatgtgtttcctcctccactaccccgcccagtccttcaagcccaatgttgctgaacggaccatacctgagccccag

SEQ ID NO: 107426 - DNA, 945 bp, Homo sapiens
  Payload ID: 1080
  Gene Symbol: ANKMY1
  Gene Name: ankyrin repeat and MYND domain containing 1
  ENST ID: ENST00000418708
  CDS Start-End: 264-945
cgagaggccgctagcagcgccctgcggaccggcccgcagccccggcgcccgccccggactcacggcgggggcgtcggtcgaggtgtaccgcaggatgacctggaagggctggtgcgcctgcagctcgggcggcagcgtgacgggatgtttcagcagcccctgagaaggaagaggaggaagctgagggcccgctgagggcgcaggacctgagggagtcctacatccagctcgtccagggtgtgcaggagtggcaggatggttgcatgtaccagggggagtttgggttgaacatgaagcttggatatggcaaattctcttggcccacaggcgagtcataccatgggcagttttaccgggaccactgccatggcctgggtacctacatgtggccagatggctccagtttcacgggcacattttacctcagccaccgagaaggctacggcaccatgtacatgaagacacggcttttccaggggctatacaaagcggaccagcggtttgggccaggtgtcgagacctaccccgatggcagccaggacgtggggctgtggttccgagagcagctcatcaagctgtgcacccagatccccagtggcttctccctcctcagataccctgagttctccagcttcatcacccacagccctgccaggatcagcctctcagaagaggagaaaacggagtggggactgcaggagggacaggatccctttttctatgactataagcggtttcttctgaatgacaacctaacgctgcctccagaaatgtatgtctactcgaccaacagtgaccacctgcccatgacaagctctttccgcaaagagctggacgcccgcatcttcctcaatgaaattcctccgttcgttgaggatggagaaccatggttcataatcaatgagacccctttgttggtcaaaatccagaagcaaacttacaagt

SEQ ID NO: 107427 - DNA, 2555 bp, Homo sapiens
  Payload ID: 1081
  Gene Symbol: ANKMY2
  Gene Name: ankyrin repeat and MYND domain containing 2
  Uniprot ID: Q8IV38
  ENST ID: ENST00000306999
  CDS Start-End: 245-1570
caatgacaggcggcaggcggtgaccgccgcagggcctgcggagaccgtccgcctggctcgcccgagctcgcccgctgtccgccagcccgcgggagggaggagagaagcgaagcgtttccgcggttggctactcagtgtcttggtctcaagttgcctcattgcggctggcgttcccaatacagacgcatcgtttcttttttaatactccctaagaaagggaataaccttcaagctggcgggagcaatggttcacataaagaaaggcgagctgacccaggaggagaaggagctactggaagtcatcgggaaaggtactgtccaagaagctggaacattattatccagcaagaatgttcgtgtcaactgtttggacgagaatggaatgactcctctaatgcatgcagcatataaaggaaaactcgatatgtgcaaattactactgcgacatggagccgatgtaaattgtcatcagcatgaacatggatacacagccctcatgtttgctgcactttctggtaataaagacatcacatgggtaatgttagaagctggtgctgagacagatgttgtcaactctgtgggaagaacagcagctcagatggcagcctttgtgggtcaacatgattgtgtgaccataatcaacaatttctttcctcgagagagactggattattacactaagccccagggactggataaagagccaaaactgcccccaaagttggcaggcccgctgcacaaaattatcaccacaacgaatcttcatcctgtcaagatcgtgatgcttgtaaatgagaatcctctgctgacagaagaagcagccctgaataaatgctacagagtgatggatttgatttgtgagaaatgtatgaagcaaagagacatgaatgaagtattggctatgaagatgcattacataagctgtatctttcagaaatgcattaacttcttaaaagatggagagaataaactggacaccttgatcaaaagcttgttaaaaggccgagcttctgatggctttccagtgtatcaagaaaagatcattagagaaagtatcagaaaatttccttactgtgaagctacactcctccagcagctggttcgaagcattgctcctgttgaaattggttctgatcccactgcattctccgtccttacccaagccatcactggccaggtgggttttgtggatgtggaattttgcactacctgtggagaaaagggagcaagtaaaagatgttcagtttgcaaaatggtaatatattgtgatcaaacctgccagaaaacacactggtttactcataagaaaatctgtaagaatctgaaggacatttacgaaaagcaacagttggaggctgccaaagaaaagagacaagaggaaaaccacggcaaacttgatgtcaattctaactgtgttaatgaagagcaaccagaggctgaagtaggtatctctcaaaaggattccaatcctgaagattccggggaaggaaagaaagaatctcttgaaagcgaagctgagttggaaggcttacaggatgctcctgcagggccacaggtgtctgaggagtaaaagccagagcaagtgccagtgtggatgatcctcaccctgcaagaagctggaaaactcctaggaatgcattgtcctcaccttgttatacctgcgtggcaccatggcaggattccacatttcatagaatacaggttttcaagcaaacccctgttgaccatgccctaatttcctattgatttctgttctataattgaatggatattcctatggaaaattttttgtttcaaaatacaggaaaaacattcctattacctttctgaggctggctttccagcaattgtttcaaaggaaaatagatccccttaaagaaaaaatacaggctttagggaacaaagggacaagcagaacaggtgtggaagagagattttcaggaagggaaaaatttatagctacagagggtagttagaaaaatcataacttatatgtgaataaaatacatataagcagcatttacggtagtggcattctacttattaagatgcaatgaaatgaagaaaggctttatgttcaaggacctttgccatagttcagctaattgtagttttatatagaaatgatcctgaacactctgaacttgacgtagtcctgcggtgatattctatctgcagtatttgtacctccagaatggcagatccctcagcaggaacaaaggcatattgacggttctctcagcgtatgcattaaaaaaggtacttcctgaaacttttgattcaataatgactaaacatactatgtacacaattactgtaaggctaattcacgtgccatactccacctgaaagcctgagttatcttgctataagcttttcatggagcacttcctttccagaaactgatttgtaactcatttagagaatgtcctggcgtcggtttttagcatatgtggtatttaaacagagctagaatgtgatgtctgaagataatgctgcatttctgggtttcttgtgtggattttaaaataaattgtgcctacaaatataaacaa

SEQ ID NO: 107428 - DNA, 2599 bp, Homo sapiens
  Payload ID: 1081
  Gene Symbol: ANKMY2
  Gene Name: ankyrin repeat and MYND domain containing 2
  ENST ID: ENST00000447802
  CDS Start-End: 183-1208
cgagctcgcccgctgtccgccagcccgcgggagggaggagagaagcgaagcgtttccgcggttggctactcagtgtcttggtctcaagttgcctcattgcggctggcgttcccaatacagacgcatcgtttcttttttaatactccctaagaaagggaataaccttcaagctggcgggagcaatggttcacataaagaaaggcgagctgacccaggaggagaaggagctactggaagtcatcgggaaaggtactgtccaagaagctggaacattattatccagcaagaatgttcgtgtcaactgtttggacgagaatggaatgactcctctaatgcatgcagcatataaaggaaaactcgatatgtgcaaattactactgcgacatggagccgatgtaaattgtcatcagcatgaacatggatacacagccctcatgtttgctgcactttctggtaataaagacatcacatgggtaatgttagaagctggtgctgagacagatgttgtcaactctgtgggaagaacagcagctcagatggcagcctttgtgggtcaacatgattgtgtgaccataatcaacaatttctttcctcgagagagactggattattacactaagccccagggactggataaagagccaaaactgcccccaaagttggcaggcccgctgcacaaaattatcaccacaacgaatcttcatcctgtcaagatcgtgatgcttgtaaatgagaatcctctgctgacagaagaagcagccctgaataaatgctacagagtgatggatttgatttgtgagaaatgtatgaagcaaagagacatgaatgaagtattggctatgaagatgcattacataagctgtatctttcagaaatgcattaacttcttaaaagatggagagaataaactggacaccttgatcaaaagcttgttaaaaggccgagcttctgatggctttccagtgtatcaagaaaagatcattagagaaagtatcagaaaatttccttactgtgaagctacactcctccagcagctggttcgaagcattgctcctgttgaaattggttctgatcccactgcattctccgtccttacccaagccatcactggccaggtgggttttgtggatgtggaattttgcactacctgtggagaaaagggagcaagtaaaagatgttcagtttgcaaaatgtgcagagaactttgaaatcatgtgagaaagtgtatgaatgcaaggatgaatgaagaattggggccaataatacaatatatgtataagggcctaccacagtgcttggcatacagtaatatattgtgatcaaacctgccagaaaacacactggtttactcataagaaaatctgtaagaatctgaaggacatttacgaaaagcaacagttggaggctgccaaagaaaagagacaagaggaaaaccacggcaaacttgatgtcaattctaactgtgttaatgaagagcaaccagaggctgaagtaggtatctctcaaaaggattccaatcctgaagattccggggaaggaaagaaagaatctcttgaaagcgaagctgagttggaaggcttacaggatgctcctgcagggccacaggtgtctgaggagtaaaagccagagcaagtgccagtgtggatgatcctcaccctgcaagaagctggaaaactcctaggaatgcattgtcctcaccttgttatacctgcgtggcaccatggcaggattccacatttcatagaatacaggttttcaagcaaacccctgttgaccatgccctaatttcctattgatttctgttctataattgaatggatattcctatggaaaattttttgtttcaaaatacaggaaaaacattcctattacctttctgaggctggctttccagcaattgtttcaaaggaaaatagatccccttaaagaaaaaatacaggctttagggaacaaagggacaagcagaacaggtgtggaagagagattttcaggaagggaaaaatttatagctacagagggtagttagaaaaatcataacttatatgtgaataaaatacatataagcagcatttacggtagtggcattctacttattaagatgcaatgaaatgaagaaaggctttatgttcaaggacctttgccatagttcagctaattgtagttttatatagaaatgatcctgaacactctgaacttgacgtagtcctgcggtgatattctatctgcagtatttgtacctccagaatggcagatccctcagcaggaacaaaggcatattgacggttctctcagcgtatgcattaaaaaaggtacttcctgaaacttttgattcaataatgactaaacatactatgtacacaattactgtaaggctaattcacgtgccatactccacctgaaagcctgagttatcttgctataagcttttcatggagcacttcctttccagaaactgatttgtaactcatttagagaatgtcctggcgtcggtttttagcatatgtggtatttaaacagagctagaatgtgatgtctgaagataatgctgcatttctgggtttcttgtgtggattttaaaataaattgtgcctacaaatat

SEQ ID NO: 107429 - DNA, 587 bp, Homo sapiens
  Payload ID: 1081
  Gene Symbol: ANKMY2
  Gene Name: ankyrin repeat and MYND domain containing 2
  ENST ID: ENST00000453623
  CDS Start-End: 90-299
tcattgcggctggcgttcccaatacagacgcatcgtttcttttttaatactccctaagaaagggaataaccttcaagctggcgggagcaatggttcacataaagaaaggcgagctgacccaggaggagaaggagctactggaagtcatcgggaaaggcgtgccccacttccgcagtgctgagtcccagcggggagccccgaggacgagccagaagccatatttccccggagtccccgagtggacgtcccagaggagttccctgccgagtcccgttacctggcaggtgacatcagcgtgactgcatgcttcttctgcaccctcacggtgcagggatggtgatgcgtactgtccaagaagctggaacattattatccagcaagaatgttcgtgtcaactgtttggacgagaatggaatgactcctctaatgcatgcagcatataaaggaaaactcgatatgtgcaaattactactgcgacatggagccgatgtaaattgtcatcagcatgaacatggatacacagccctcatgtttgctgcactttctggtaataaagacatcacatgggtaatgttagaagctggtgc

SEQ ID NO: 107430 - DNA, 1270 bp, Homo sapiens
  Payload ID: 1081
  Gene Symbol: ANKMY2
  Gene Name: ankyrin repeat and MYND domain containing 2
  ENST ID: ENST00000628652
  CDS Start-End: 245-1270
caatgacaggcggcaggcggtgaccgccgcagggcctgcggagaccgtccgcctggctcgcccgagctcgcccgctgtccgccagcccgcgggagggaggagagaagcgaagcgtttccgcggttggctactcagtgtcttggtctcaagttgcctcattgcggctggcgttcccaatacagacgcatcgtttcttttttaatactccctaagaaagggaataaccttcaagctggcgggagcaatggttcacataaagaaaggcgagctgacccaggaggagaaggagctactggaagtcatcgggaaaggtactgtccaagaagctggaacattattatccagcaagaatgttcgtgtcaactgtttggacgagaatggaatgactcctctaatgcatgcagcatataaaggaaaactcgatatgtgcaaattactactgcgacatggagccgatgtaaattgtcatcagcatgaacatggatacacagccctcatgtttgctgcactttctggtaataaagacatcacatgggtaatgttagaagctggtgctgagacagatgttgtcaactctgtgggaagaacagcagctcagatggcagcctttgtgggtcaacatgattgtgtgaccataatcaacaatttctttcctcgagagagactggattattacactaagccccagggactggataaagagccaaaactgcccccaaagttggcaggcccgctgcacaaaattatcaccacaacgaatcttcatcctgtcaagatcgtgatgcttgtaaatgagaatcctctgctgacagaagaagcagccctgaataaatgctacagagtgatggatttgatttgtgagaaatgtatgaagcaaagagacatgaatgaagtattggctatgaagatgcattacataagctgtatctttcagaaatgcattaacttcttaaaagatggagagaataaactggacaccttgatcaaaagcttgttaaaaggccgagcttctgatggctttccagtgtatcaagaaaagatcattagagaaagtatcagaaaatttccttactgtgaagctacactcctccagcagctggttcgaagcattgctcctgttgaaattggttctgatcccactgcattctccgtccttacccaagccatcactggccaggtgggttttgtggatgtggaattttgcactacctgtggagaaaagggagcaagtaaaagatgttcagtttgcaaaatgtgcagagaactttga

SEQ ID NO: 107431 - DNA, 210 bp, Homo sapiens
  Payload ID: 1081
  Gene Symbol: ANKMY2
  Gene Name: ankyrin repeat and MYND domain containing 2
  ENST ID: ENST00000627859
  CDS Start-End: 1-210
atggttcacataaagaaaggcgagctgacccaggaggagaaggagctactggaagtcatcgggaaaggcgtgccccacttccgcagtgctgagtcccagcggggagccccgaggacgagccagaagccatatttccccggagtccccgagtggacgtcccagaggagttccctgccgagtcccgttacctggcaggtgacatcagcgtga

SEQ ID NO: 107432 - DNA, 6994 bp, Homo sapiens
  Payload ID: 1082
  Gene Symbol: ASB1
  Gene Name: ankyrin repeat and SOCS box containing 1
  Uniprot ID: Q9Y576
  ENST ID: ENST00000264607
  CDS Start-End: 248-1255
tcggttagccgcgaagttcccgccggacgaagggaccagccagcgccctgctagacagcgaggccggaagcggaggcgtggcccctgcgcggccccggaaaccagtgaggccggcgcgcgcccgccggaagccgcgaccccgacgcgccccccattgccctcggcgccggaagtggtcgcgggtcgttctgcttcctgcccgaggggcgtgcgcgggtcaggggcggccgcggaggcggaagcatccatggcggagggcggcagcccagacgggcgggcagggccgggctccgcaggtcgtaatctgaaggagtggctgagggagcaattttgtgatcatccgctggagcactgtgaggacacgaggctccatgatgcagcttacgtcggggacctccagaccctcaggagcctattgcaagaggagagctaccggagccgcatcaacgagaagtctgtctggtgctgtggctggctcccctgcacaccgttgcgaatcgcggccactgcaggccatgggagctgtgtggacttcctcatccggaagggggccgaggtggatctggtggacgtaaaaggacagacggccctgtatgtggctgtggtgaacgggcacctagagagtacccagatccttctcgaagctggcgcggaccccaacggaagccggcaccatcgcagcacccctgtctaccacgcctctcgcgtgggccgggcagacatcctgaaggccctcatcaggtacggggctgatgttgacgtcaaccaccacctgactcctgatgtccagcctcgattctcccggcggctcacctccttggtggtctgccccttgtacatcagcgcagcctaccacaacctccagtgcttccggctgctcctcctggctggcgcgaaccctgacttcaactgcaatggtcctgtcaacacacagggattctacaggggctcccctgggtgcgtcatggatgctgttctgcgccacggctgtgaggcagccttcgtgagcctgctggtagaatttggagccaacctgaatctagtgaagtgggaatcgctgggcccagagtcgagaggaagaagaaaagtggaccctgaggccttgcaggtctttaaagaggccagaagtgttcccagaaccttgctgtgtctgtgccgtgtggctgtgagaagagctcttggcaaacaccggcttcatctgattccttcgctgcctctgccagaccccataaagaagtttctactccatgagtagactccaagtgctgcggttgattccagtgagggagaaagtgatctgcagggaggtggacaccgagccctgagtgctgtgctgctgctggtctcctgatggctgttgctgcagaagatgtcctcgtagactgtcattgctcctcaggtgcctgggccgctgaacagtccttgggtcattgtcagctgagaggcttatactaaagttattattgtttttcccaagttctctgttctggattttcagttgcatattaatgtaacgggccatggggtatgtacatgtaggggctgaggttggaggcctactaatttccctgtagggaagactcccagcacttctggaactgtgcttctctttatttttctacttctcaatttgatggttcgattaaagccttctagtatctcaatgaaaagggagtttcgtaagcaaaatagaggacagaaatgcagttcatgaacttgctggttggtttttcctgctcctggggtaacacatgcgcttgtcatacacgccccttccttgccccttcagtattctctctttgcgatggaggtctcatagtgagtgtcttcactcaagggtggtttcctggctgcacggcacctgttccaacacctactgtgcctctcatcaggtgtcacgatttttctgccacttcaccttagggagcttccagtgattgattttaggaggcccacaccaaactccccaggaaatgactgccttccttgggaccaaggaccgttccaacagcattcactgccagttctaataggcgaggaaaatgcccgaggcgctgtcttctgtcccccacacgtaccagaaagtgaaaaatgcagcgagtcctctgggtggttatgagcctccaggcgcatgctgtccagtggacagaacatctggcggttggttgattgctctcttttgtcttggtcgctgcttctagaatctatgcaggggatagcagtgaggtcagaagtctttcccgggagagagatggcctgggttatcattgctgatagctttggctgcatgagttgggcttccccttacccagggctgcacagccaggtgtgagggtcaccggcaggtgggctggtggctgcagcctcagagccctcccaggttgctgctgtttccagtgaatcacatttcgtcatttgaagcccatgaggaccattgtgtggatccatggtgattctagacttcagatatatttaggaaggcgcagatttcaaatctgtgtttgattttctgtaataagagaaatccaatttgtaaaacttgaacaatgataccgttttatttacttagtagcatcactgtgtgtcttagcaggcaggcagtgtctggccattattgcgttctacagccagaggatagaattctatacccccaaccccttgtgtcacaaatgggctctgtgtgggtcaccccagctgacccgtgtatgtgcagatgcagttccgaagggaagaacagtcctcgggtgattcagaggggaaaatgcaatccgggaggtgtttcctcagctgaggtgacactgttagaagctgtgatggttgtgtaaatgtgggctgtgtgctgttcccgaggggagcttgggattgggtcctgctgaagccaggagggtcttcccaagataggagaggaaccgcaggtggtgagcggctggggagggccaggacagccggggctgggtgctgcaggggcttcagcccgggagagggggtgggcgtgttctttgtggtaccaaagtgggactaggacaaaaattgggctgtggctggggcaggagctatagggagttaaggaatgatgatacggaagttggagccaccaccgtggactgggccttgtcactggaggtcgtaggcagtggctcatcaccctggtagggctgataggggctttcagggaggctggttagctccctgcactctggctctttactggcttactgtttagctcctcccacctcgaggctcttcttcctgccaccctttgggctcagaggagggtggcttttttcgaggtgagccatgttgtagacacatgatacgctctgcgtctgctctactgagtactttctgcaggggcctgttaaggacgaggcctccccagccctgcccggtgcaggaggtggctcagttattgaaccttttgggaagcagcacctgggaatgctgcctcgtgggagtcccatgcgtgagtgtggtggtgtgaccttcaggctgcacagaggcaaggacccagatgtggcagcatgggcgtcatgctcctttgcacagcccagggcctgttttggagggaccaggtcactgcccctggtctctctaggaggagtggactgaatggatcgttgcagagaagactcacccagacctggccagggaatgatgtatctggggagagaatgagctggaggagggggcctctcatggcccttccctggcctgtggcccagcctggctggcctgcaggtgtctagggtctcagcttttcatttgcagaggacatgttcaacttcctctctgttcaagccagcctttgccaattttttcagaatccaaacaatttggaggtttggtatcttgtttcatagctgccaaatatgaatctgaaaacagggtgggtagctaaggtcattcctcctgggttttagtggcattgccttccttcactaaagctcccttttttttctgttggcaaggacaggttacagaataggaagagtagcactttccgcctaagcactttaggaaatcacctttctaagccctggggcgcccaagtcccatgggacagggaaacgtggtcctcagtgaggctgctgcctggctggcccggagtcctccctaggagaggggctcgatgggctgggggaaggagcctgaaggttgcccctggttgcatcccagaagcatctgactgtcaccactgccagtggctgtggaacagtcctgggccctgggccttggctgctgtcaacagatgggctgggctgggctgtggtggggtgggggacaacgttggtaactctgagaattcagctttggagtcccgggtgaggggttttagataaacccatcaatatcacccacattctgtgactctttgcatcactcgtgttatttatttatttatttatattctgccttgttccagaaaagtgtttaaggcaacaatgcttgttttttggtgttttcttttgacatttgaaaatttagtacattgttaaaatgtacttgttaaacaggtaattttaaagagaaggaacaattgtttttagtaagttttctttttcctttttcaatgaattgattcttcaaattaaaagttcttgagagaaggagaggaagatacagcagacataggactgagccaaggaagagtctgcctgagagagacgcttggcctgtgctttgctgccatccgtgcggccttggccacatccctattaacagaggcagctccacttcagacagggacaaggcttcctgctgtgcctttctggcagggttttgtggggtcacatgggaagcaatgtgttacgcaagcagtctccatgtgtgtgtaaactgctgtcctggtgacttgtccctcttcttagtggaaatgcatttgagatggtgacagggctggatgaacgtgtgaccctgggagatccgggctggactgtggaccccgatgggccagagtccttgtggcccacagcatagcactggggacagagcgctctatgcaggtgaggcgtatgagaacagcatggtaaataattgatgaagtcacatttgttcaacttaaaggattgttctttattctgaagttattttcttccttatttggatgataaaatttccttttatgtaatgaaggtaaaagtagagggcaatatttttgctttttgaaatgctcttggttgcaaaacaaaatgttggttgctgtttgtcagccccagaatttcttcttaagttcgcctgtctctgaaatcccaaagtcacggaaccgcagtctagctgtggtgcatgtttacgtattggtgagaaattcctcttgggttcttgaacagcctgtacgctggcaggcagcactgcagcatttctgctgctcatggccaagaacgagtctggagatcgctgcgtgcggttttaggaagtgccaacacccgtggtgatgggcctctggccacccctggatccatgggacacactcacaggaagctgatgtggccttctcggtgaggactgcaccttaacctgggcactgggagcctgtggcccccctgtatgttggtgatgacactagtgtgggtcttctggctctggggctacagcttctgcctcctcacctggccgtcggtactcggcaagcaggcctggcctcccggggcctggatccctaccggctgggattggcctcctggaagtacctgtttgggccatgtgacctcctttctcacttatgcctcactcccctcctcccgctccaaacccgaacctctcagtgtggaatgaacgctccaaacccgaacctctcagtgtggaatgaacgctccaaacccgaacctctcagtgtggaatgaaacagtttagatgtgtacatgatgcacgtgggtgggattcacatcccaggagaattccacggagaggaatgtgcagattttgaagtgtacagtgatgtgtggaataaatactagaaattctcagcagacagtgggatggagaagtgagtgggggcaggagggggatttctgttgccttgacatgtcgttgctcagtgcctggattgcaggcgagtctctcttttttatgttgctttgatttcaagatctcttagatatactaggtagtgtatgaatgtgcataaatccagtttgagaatggtgtttatgaagaagctgtttcgtgtgtacagttgctgctgtaatttagccagcagtgccctgccctgccctgcagtgtctgctcagctcccactgcttctctttgctgttgggcatgtgaggcatgacttggaggggggcctggtgcctggggacctgctgaagagaatgctcaccaccagctctctgtttccctttctgctttggtaatcaacacgtgtttgcctgcagtggccgggaccgtgactgtttctgcccttgtgcctagttaagagccttcaaaagcataatgaacacttttgatatgatattgtaactttagtaaatgctttacttccctctaattgcccccaaatgccttaattttgtggactgtttatttcaacaggtggaagtgttggtcgtgcgaaatcttggtattcgcatttcaagaagggagttcttttttctttcttctttctatggaacgtttcaagtgattggatagaaagaagggctctgaagcaggagttttcacctgctctgagggaacttggggctccagggacgtaccccaaatgttgcccaggttgaaactccctgacagcctgttctacgtagtggctcgtggtttccagtttgaagagagttgtgcccctaaaagtgtttgaaacctgtggctttcaagcaaggtaccgttgtccccacagtgttccgtggggtagggggtgatggagactgtgggcaagcctgttgtttttggccccctgttgttacatgggacctgttttgacggtgggagggtgagatgtgaagatgtgggatgaacctggaatgaacgaattaaataaagacatgcatccatctgtcagcga

SEQ ID NO: 107433 - DNA, 878 bp, Homo sapiens
  Payload ID: 1082
  Gene Symbol: ASB1
  Gene Name: ankyrin repeat and SOCS box containing 1
  ENST ID: ENST00000409297
  CDS Start-End: 68-772
gggtcgttctgcttcctgcccgaggggcgtgcgcgggtcaggggcggccgcggaggcggaagcatccatggcggagggcggcagcccagacgggcgggcagggccgggctccgcaggtcgtaatctgaaggagtggctgagggagcaattttgtgatcatccgctggagcactgtgaggacacgaggctccatgatgcagcttacgtcggggacctccagaccctcaggagcctattgcaagaggagagctaccggaggtacggggctgatgttgacgtcaaccaccacctgactcctgatgtccagcctcgattctcccggcggctcacctccttggtggtctgccccttgtacatcagcgcagcctaccacaacctccagtgcttccggctgctcctcctggctggcgcgaaccctgacttcaactgcaatggtcctgtcaacacacagggattctacaggggctcccctgggtgcgtcatggatgctgttctgcgccacggctgtgaggcagccttcgtgagcctgctggtagaatttggagccaacctgaatctagtgaagtgggaatcgctgggcccagagtcgagaggaagaagaaaagtggaccctgaggccttgcaggtctttaaagaggccagaagtgttcccagaaccttgctgtgtctgtgccgtgtggctgtgagaagagctcttggcaaacaccggcttcatctgattccttcgctgcctctgccagaccccataaagaagtttctactccatgagtagactccaagtgctgcggttgattccagtgagggagaaagtgatctgcagggaggtggacaccgagccctgagtgctgtgctgctgctggtctcctgatggctgttgc

SEQ ID NO: 107434 - DNA, 1048 bp, Homo sapiens
  Payload ID: 1082
  Gene Symbol: ASB1
  Gene Name: ankyrin repeat and SOCS box containing 1
  ENST ID: ENST00000438264
  CDS Start-End: 43-228
ggcgtgcgcgggtcaggggcggccgcggaggcggaagcatccatggcggagggcggcagcccagacgggcgggcagggccgggctccgcagccgcatcaacgagaagtctgtctggtgctgtggctggctcccctgcacaccgttgcgaatcgcggccactgcaggccatgggagctgtgtggacttcctcatccggaagggggccgaggtggatctggtggacgtaaaaggacagacggccctgtatgtggctgtggtgaacgggcacctagagagtacccagatccttctcgaagctggcgcggaccccaacggaagccggcaccatcgcagcacccctgtctaccacgcctctcgcgtgggccgggcagacatcctgaaggccctcatcaggtacggggctgatgttgacgtcaaccaccacctgactcctgatgtccagcctcgattctcccggcggctcacctccttggtggtctgccccttgtacatcagcgcagcctaccacaacctccagtgcttccggctgctcctcctggctggcgcgaaccctgacttcaactgcaatggtcctgtcaacacacagggattctacaggggctcccctgggtgcgtcatggatgctgttctgcgccacggctgtgaggcagccttcgtgagcctgctggtagaatttggagccaacctgaatctagtgaagtgggaatcgctgggcccagagtcgagaggaagaagaaaagtggaccctgaggccttgcaggtctttaaagaggccagaagtgttcccagaaccttgctgtgtctgtgccgtgtggctgtgagaagagctcttggcaaacaccggcttcatctgattccttcgctgcctctgccagaccccataaagaagtttctactccatgagtagactccaagtgctgcggttgattccagtgagggagaaagtgatctgcagggaggtggacaccgagccctgagtgctgtgctgctgctggtctcctgatggctgttgctgcagaagatgtcctcgtagactgtcattgctcc

SEQ ID NO: 107435 - DNA, 1820 bp, Homo sapiens
  Payload ID: 1083
  Gene Symbol: ASB10
  Gene Name: ankyrin repeat and SOCS box containing 10
  Uniprot ID: Q8WXI3
  ENST ID: ENST00000275838
  CDS Start-End: 262-1551
aggtcctaagggcttgagtgaaaggagaagcccccggctgtttctccccgacctcaaagcttgcccaatagcctacaccttggcccaagaacacagtcatgtggagcccagaatagctcctgctggatgcgtggccaggtcagcctcggagcgtgggacacaggggccttctgtctgtctgtatttccctcctgctctctctctctctctctgcctttggcatatacctctcctcctccccactcccctttccctgcccacatgctcatgagttggtctccagaagagtgcaaggggcagggagagcccctcgatgacagacaccccctctgtgccaggctggtggagaagcccagcagagggtctgaggagcacctcaagtctggcccgggacccatcgtcacccgcacagcctcaggacctgcccttgccttctggcaggcagtgctggctggggacgtgggctgtgtctcccgcatcctcgcggactccagtactggcctggctcctgattccgtctttgataccagcgacccagagcgatggagggatttccgcttcaacatccgtgctctgagactctggtctctgacatacgaagaggagctgaccaccccactgcatgtggcagccagccgtggccacacggaagtcctgcggctgctgctgaggcggcgagcaaggccagacagtgcccctgggggccgcaccgccctgcacgaggcctgtgctgcaggccacactgcctgtgttcatgtgctgctggtggcaggagccgaccccaacatcgctgaccaggatgggaaacgccccctgcatctctgccgggggcctggcacccttgagtgtgcggagctgctcctcaggtttggagcgagagtggatggtcggtccgaggaagaagaggagacccctttgcatgtggccgcccggcttggccatgtggagctggcagatctgcttctaagacggggggcatgtcctgatgcccgcaatgccgaaggctggaccccactgctggctgcctgtgacgtccgctgccagtccatcaccgatgccgaggccaccaccgcccgctgcctgcagctgtgcagcttgctgctttcagctggagcagacgctgatgctgcggaccaggacaagcagcgacccctgcacctggcctgccgccgtggccatgcagctgtcgtggagctgctcctgtcctgtggtgtcagcgccaacaccatggactatgggggacacacgcccctgcactgtgctctgcagggcccagctgcagccctggcccagagccccgagcacgtggttcgggctctgctcaaccatggcgccgtccgtgtctggccaggggccctccccaagaaacatcagcgtttctactcctccctcttcgccttggtgaggcagcccaggtcgctgcagcatttgagccgctgtgcgctccgctcccacctggagggcagcctgccccaagcgctgccccgcctccccctgccaccgcgcctgctccgctacctgcagctggattttgagggcgtgctctactagatgtccatggccttttgagagggcctgaaagcagatgccccagcctgcagagggcgcgcctctgcactaactcaggccaggtagccctggcagcaggaggcccagctccgcaggcaggtgtggatgctgcaattcccaatgcagagaagcggaccgacagcggcagccgggtgatgtctgatgaagacacactcctactggggctctcctgaggcccccttctagcctgtgcaaaccctgtatgtgcattaaaaatctccaggtctgtg

SEQ ID NO: 107436 - DNA, 1738 bp, Homo sapiens
  Payload ID: 1083
  Gene Symbol: ASB10
  Gene Name: ankyrin repeat and SOCS box containing 10
  Uniprot ID: Q8WXI3
  ENST ID: ENST00000377867
  CDS Start-End: 111-1469
cctgcgcctcccatgctgggccccacccagctcgggcccagcacccacctgcccagtccaccagcaacatcgctgggagtcgtgctgctttggctctcccagaacaagccatgccctggggaaagaactcctctccccactggggacaccatctggggtgccttccctccgccccggcctgccggatctggaggccccactcccgcccagcctgggagccccctcggccatcaccactgctctgccaagacatggccctgcagaatgccctctacaccggggacctggcaaggttgcaggagctgttccccccgcacagcacagccgacctgctgctggagagccgggccgcagagcctcgctggagcagccaccagaggggactctggtctctgacatacgaagaggagctgaccaccccactgcatgtggcagccagccgtggccacacggaagtcctgcggctgctgctgaggcggcgagcaaggccagacagtgcccctgggggccgcaccgccctgcacgaggcctgtgctgcaggccacactgcctgtgttcatgtgctgctggtggcaggagccgaccccaacatcgctgaccaggatgggaaacgccccctgcatctctgccgggggcctggcacccttgagtgtgcggagctgctcctcaggtttggagcgagagtggatggtcggtccgaggaagaagaggagacccctttgcatgtggccgcccggcttggccatgtggagctggcagatctgcttctaagacggggggcatgtcctgatgcccgcaatgccgaaggctggaccccactgctggctgcctgtgacgtccgctgccagtccatcaccgatgccgaggccaccaccgcccgctgcctgcagctgtgcagcttgctgctttcagctggagcagacgctgatgctgcggaccaggacaagcagcgacccctgcacctggcctgccgccgtggccatgcagctgtcgtggagctgctcctgtcctgtggtgtcagcgccaacaccatggactatgggggacacacgcccctgcactgtgctctgcagggcccagctgcagccctggcccagagccccgagcacgtggttcgggctctgctcaaccatggcgccgtccgtgtctggccaggggccctccccaaggtgctggagcgctggagcacgtgccctcggaccatcgaggtcctgatgaacacctacagtgttgtgcagcttcccgaggaggccgtcggcctggtgactcctgaaactctgcagaaacatcagcgtttctactcctccctcttcgccttggtgaggcagcccaggtcgctgcagcatttgagccgctgtgcgctccgctcccacctggagggcagcctgccccaagcgctgccccgcctccccctgccaccgcgcctgctccgctacctgcagctggattttgagggcgtgctctactagatgtccatggccttttgagagggcctgaaagcagatgccccagcctgcagagggcgcgcctctgcactaactcaggccaggtagccctggcagcaggaggcccagctccgcaggcaggtgtggatgctgcaattcccaatgcagagaagcggaccgacagcggcagccgggtgatgtctgatgaagacacactcctactggggctctcctgaggcccccttctagcctgtgcaaaccctgtatgtgcattaaaaatctccaggtctgtg

SEQ ID NO: 107437 - DNA, 1694 bp, Homo sapiens
  Payload ID: 1083
  Gene Symbol: ASB10
  Gene Name: ankyrin repeat and SOCS box containing 10
  Uniprot ID: Q8WXI3
  ENST ID: ENST00000420175
  CDS Start-End: 26-1429
tccccactcccctttccctgcccacatgctcatgagttggtctccagaagagtgcaaggggcagggagagcccctcgatgacagacaccccctctgtgccaggctggtggagaagcccagcagagggtctgaggagcacctcaagtctggcccgggacccatcgtcacccgcacagcctcaggacctgcccttgccttctggcaggcagtgctggctggggacgtgggctgtgtctcccgcatcctcgcggactccagtactggcctggctcctgattccgtctttgataccagcgacccagagcgatggagggatttccgcttcaacatccgtgctctgagactctggtctctgacatacgaagaggagctgaccaccccactgcatgtggcagccagccgtggccacacggaagtcctgcggctgctgctgaggcggcgagcaaggccagacagtgcccctgggggccgcaccgccctgcacgaggcctgtgctgcaggccacactgcctgtgttcatgtgctgctggtggcaggagccgaccccaacatcgctgaccaggatgggaaacgccccctgcatctctgccgggggcctggcacccttgagtgtgcggagctgctcctcaggtttggagcgagagtggatggtcggtccgaggaagaagaggagacccctttgcatgtggccgcccggcttggccatgtggagctggcagatctgcttctaagacggggggcatgtcctgatgcccgcaatgccgaaggctggaccccactgctggctgcctgtgacgtccgctgccagtccatcaccgatgccgaggccaccaccgcccgctgcctgcagctgtgcagcttgctgctttcagctggagcagacgctgatgctgcggaccaggacaagcagcgacccctgcacctggcctgccgccgtggccatgcagctgtcgtggagctgctcctgtcctgtggtgtcagcgccaacaccatggactatgggggacacacgcccctgcactgtgctctgcagggcccagctgcagccctggcccagagccccgagcacgtggttcgggctctgctcaaccatggcgccgtccgtgtctggccaggggccctccccaaggtgctggagcgctggagcacgtgccctcggaccatcgaggtcctgatgaacacctacagtgttgtgcagcttcccgaggaggccgtcggcctggtgactcctgaaactctgcagaaacatcagcgtttctactcctccctcttcgccttggtgaggcagcccaggtcgctgcagcatttgagccgctgtgcgctccgctcccacctggagggcagcctgccccaagcgctgccccgcctccccctgccaccgcgcctgctccgctacctgcagctggattttgagggcgtgctctactagatgtccatggccttttgagagggcctgaaagcagatgccccagcctgcagagggcgcgcctctgcactaactcaggccaggtagccctggcagcaggaggcccagctccgcaggcaggtgtggatgctgcaattcccaatgcagagaagcggaccgacagcggcagccgggtgatgtctgatgaagacacactcctactggggctctcctgaggcccccttctagcctgtgcaaaccctgtatgtgcattaaaaatctccaggtc

SEQ ID NO: 107438 - DNA, 779 bp, Homo sapiens
  Payload ID: 1083
  Gene Symbol: ASB10
  Gene Name: ankyrin repeat and SOCS box containing 10
  ENST ID: ENST00000415615
  CDS Start-End: 57-404
agtccaccagcaacatcgctgggagtcgtgctgctttggctctcccagaacaagccatgccctggggaaagaactcctctccccactggggacaccatctggggtgccttccctccgccccggcctgccggatctggaggccccactcccgcccagcctgggagccccctcggccatcaccactgctctgccaagacatggccctgcagaatgccctctacaccggggacctggcaaggttgcaggagctgttccccccgcacagcacagccgacctgctgctggagagccgggccgcagagcctcgctggagcagccaccagaggggtgaggggcatctgggggttgctgagaaccagggggctgggctgactgcctcggccacagaggtcctaagggcttgagtgaaaggagaagcccccggctgtttctccccgacctcaaagcttgcccaatagcctacaccttggcccaagaacacagtcatgtggagcccagaatagctcctgctggatgcgtggccaggctggtggagaagcccagcagagggtctgaggagcacctcaagtctggcccgggacccatcgtcacccgcacagcctcaggacctgcccttgccttctggcaggcagtgctggctggggacgtgggctgtgtctcccgcatcctcgcggactccagtactggcctggctcctgattccgtctttgataccagcgacccagagcgatggagggatttccgcttcaacatccgtgctctgagactctggtctctga

SEQ ID NO: 107439 - DNA, 2168 bp, Homo sapiens
  Payload ID: 1084
  Gene Symbol: ASB11
  Gene Name: ankyrin repeat and SOCS box containing 11, E3 ubiquitin protein ligase
  Uniprot ID: Q8WXH4
  ENST ID: ENST00000344384
  CDS Start-End: 74-982
agacaactcagaagacactagacaacagcagtcttatctaaagaaataagacctccaaggacgaagcatcagaatgcttcaattaactggggaaaatgagaagaattgtgaagtttcagaacgtatcagaaggtccggaccatggaaagagatttcttttggggattatatttgtcacacatttcagggagattgctgggctgatcgatccccacttcatgaagctgcagctcaggggcgcttactggcccttaaaactttaattgcacaaggtgtcaatgtgaaccttgtgacaattaaccgggtgtcttctctccacgaggcatgccttggaggtcacgtggcctgtgccaaagccttattggaaaatggtgcacacgtcaatggagtgacagttcacggagccacacccctcttcaatgcttgctgcagcggcagtgctgcatgtgtcaatgtgctgctggagttcggagccaaggcccagttggaggtgcacctggcctcgcccatccatgaggcagtgaagagaggtcacagagagtgcatggagatcctgctggcaaataatgttaacattgaccatgaggtgcctcagctcggaactcccctatatgtggcctgcacctaccagagggtagactgtgtgaagaaacttctagaattaggagccagtgtcgaccatggccagtggctggacaccccactccatgctgcagcgaggcagtccaatgtggaggtcatccacctgctaaccgactatggagctaacctgaagcgtagaaatgctcagggcaaaagtgcgcttgatctggcggctccaaaaagcagcgtggagcaggcactcttgctccgtgaaggcccacctgctctttcccagctctgccgcctgtgtgtccggaagtgtctcggtcgagcatgtcatcaagccatccacaagctacatctgccagagccactcgaacgattcctcctataccaatagtcctaagtgttcctgggaagatacttggaatgacacagattgttgtctgctgtacctagagtacctaatgtagaagctcaacagcttagactcctagtatctttaaatgagctcagtcgaagtaaatcccccatgagctagaacacttgaggagtggaaactcctggttagtttaatgttctcattaaccaaggggcaagtagaaaccatttagcttttagctcttgttgttaagaaacttaaaagaactgtgaagtagagtgaaaacaataggctgttttttgatgattcgggatcttcttgtacctaaaagtcaacattctgaatattgtatagacacatataaattcaggtggataagattataacaaatgttaggtattccaagatatgttcttgatttagttccttccttcagcccttccccactttttttctttctttccttgaataaatctggtataattttgattttttgtatatatatacgtatatatatatacatacatatacgtatatatatatacgtatatatatacacacacacacatgcactcatatatttaatgttttcaaagtccttaatatatatagttcatatatgttttcaaagtccttaatatatgtataaagcttatatatatatgttttcaaagttctttatatataaagttatatatatttatatagactttatatatatatacatatataaagttaaggacttcagaaacattgtagttaactgaggcttccagttactgcggtcctggttgataagagagactttggaagagatcagtgcacccagaggttggcatctattgcttattgcttctgatattaaatgctgttatttgaagtaagcagttctaggattgagaacactgggtgtccccaacaacctgaacccacaggcattgtctgaggcatgttgcaacccaagcactggcttattttcaaagtcaagatgctcagggtttttgaaataattacatactgatgccagccaccaaagtgggctcaatgctgggtcaatatttttttctgtggataggggcccaaaataagcacaaaggtatataaaaagaggcttctccttttctgtcttctccttcttctcatttctctctccttctgtcacccctcctcttcctctattctttctcttttttgtgaatttaga

SEQ ID NO: 107440 - DNA, 2748 bp, Homo sapiens
  Payload ID: 1084
  Gene Symbol: ASB11
  Gene Name: ankyrin repeat and SOCS box containing 11, E3 ubiquitin protein ligase
  Uniprot ID: Q8WXH4
  ENST ID: ENST00000380470
  CDS Start-End: 20-940
atacagagcataagccaaaatggaagatggtcctgttttctatggctttaaaaacatttttattacaatgtttgctacgttttttttctttaagcttttaattaaagtttttttggctctcctaacccatttctatatcgtcaaaggaaatagaaaagaagcggctaggatagcagaagagatctatggtggaatttcagattgctgggctgatcgatccccacttcatgaagctgcagctcaggggcgcttactggcccttaaaactttaattgcacaagcatgccttggaggtcacgtggcctgtgccaaagccttattggaaaatggtgcacacgtcaatggagtgacagttcacggagccacacccctcttcaatgcttgctgcagcggcagtgctgcatgtgtcaatgtgctgctggagttcggagccaaggcccagttggaggtgcacctggcctcgcccatccatgaggcagtgaagagaggtcacagagagtgcatggagatcctgctggcaaataatgttaacattgaccatgaggtgcctcagctcggaactcccctatatgtggcctgcacctaccagagggtagactgtgtgaagaaacttctagaattaggagccagtgtcgaccatggccagtggctggacaccccactccatgctgcagcgaggcagtccaatgtggaggtcatccacctgctaaccgactatggagctaacctgaagcgtagaaatgctcagggcaaaagtgcgcttgatctggcggctccaaaaagcagcgtggagcaggcactcttgctccgtgaaggcccacctgctctttcccagctctgccgcctgtgtgtccggaagtgtctcggtcgagcatgtcatcaagccatccacaagctacatctgccagagccactcgaacgattcctcctataccaatagtcctaagtgttcctgggaagatacttggaatgacacagattgttgtctgctgtacctagagtacctaatgtagaagctcaacagcttagactcctagtatctttaaatgagctcagtcgaagtaaatcccccatgagctagaacacttgaggagtggaaactcctggttagtttaatgttctcattaaccaaggggcaagtagaaaccatttagcttttagctcttgttgttaagaaacttaaaagaactgtgaagtagagtgaaaacaataggctgttttttgatgattcgggatcttcttgtacctaaaagtcaacattctgaatattgtatagacacatataaattcaggtggataagattataacaaatgttaggtattccaagatatgttcttgatttagttccttccttcagcccttccccactttttttctttctttccttgaataaatctggtataattttgattttttgtatatatatacgtatatatatatacatacatatacgtatatatatatacgtatatatatacacacacacacatgcactcatatatttaatgttttcaaagtccttaatatatatagttcatatatgttttcaaagtccttaatatatgtataaagcttatatatatatgttttcaaagttctttatatataaagttatatatatttatatagactttatatatatatacatatataaagttaaggacttcagaaacattgtagttaactgaggcttccagttactgcggtcctggttgataagagagactttggaagagatcagtgcacccagaggttggcatctattgcttattgcttctgatattaaatgctgttatttgaagtaagcagttctaggattgagaacactgggtgtccccaacaacctgaacccacaggcattgtctgaggcatgttgcaacccaagcactggcttattttcaaagtcaagatgctcagggtttttgaaataattacatactgatgccagccaccaaagtgggctcaatgctgggtcaatatttttttctgtggataggggcccaaaataagcacaaaggtatataaaaagaggcttctccttttctgtcttctccttcttctcatttctctctccttctgtcacccctcctcttcctctattctttctcttttttgtgaatttagaacatgggaactggatagacttttaattattgtaagtattactgtcatggttcagtattcagttctaaaatgaaaattccctctcagatcatcctaagactcatttcacacatgtttttttttcccccaatttttctagacctttggctctcaactggagacaattttgccccactcccactgagacatttgtcaatgtctgcagacatgtttagttgcaacaactgggggagaattgctactatcatctagacggtggagatcagggatgcagctaatcaccctacagtgcacaggagccagcaacaaagaattatcagatctggccgggcatggtggctcacgcctgtaatcccagcattttgggaggccgaggcaggcagatcgcactgtcaggagttcgagaaccgcctggccactatggtgaaaccctgtctctactaaaaatacaaaagttagccaggcgtggtggcaggtgcctatagtcccagctacttgggaggctgaggcaggagaatcacttgaacccgggaggcggagattgcagtaagccaagatcacgccactgcactccagcctgggtgacagagcgagactccgtctcaaaacaaaaaaaaaaaaaa

SEQ ID NO: 107441 - DNA, 1484 bp, Homo sapiens
  Payload ID: 1084
  Gene Symbol: ASB11
  Gene Name: ankyrin repeat and SOCS box containing 11, E3 ubiquitin protein ligase
  Uniprot ID: Q8WXH4
  ENST ID: ENST00000480796
  CDS Start-End: 52-1023
aactcagtgaaattttacagtcctaggaccctatacagagcataagccaaaatggaagatggtcctgttttctatggctttaaaaacatttttattacaatgtttgctacgttttttttctttaagcttttaattaaagtttttttggctctcctaacccatttctatatcgtcaaaggaaatagaaaagaagcggctaggatagcagaagagatctatggtggaatttcagattgctgggctgatcgatccccacttcatgaagctgcagctcaggggcgcttactggcccttaaaactttaattgcacaaggtgtcaatgtgaaccttgtgacaattaaccgggtgtcttctctccacgaggcatgccttggaggtcacgtggcctgtgccaaagccttattggaaaatggtgcacacgtcaatggagtgacagttcacggagccacacccctcttcaatgcttgctgcagcggcagtgctgcatgtgtcaatgtgctgctggagttcggagccaaggcccagttggaggtgcacctggcctcgcccatccatgaggcagtgaagagaggtcacagagagtgcatggagatcctgctggcaaataatgttaacattgaccatgaggtgcctcagctcggaactcccctatatgtggcctgcacctaccagagggtagactgtgtgaagaaacttctagaattaggagccagtgtcgaccatggccagtggctggacaccccactccatgctgcagcgaggcagtccaatgtggaggtcatccacctgctaaccgactatggagctaacctgaagcgtagaaatgctcagggcaaaagtgcgcttgatctggcggctccaaaaagcagcgtggagcaggcactcttgctccgtgaaggcccacctgctctttcccagctctgccgcctgtgtgtccggaagtgtctcggtcgagcatgtcatcaagccatccacaagctacatctgccagagccactcgaacgattcctcctataccaatagtcctaagtgttcctgggaagatacttggaatgacacagattgttgtctgctgtacctagagtacctaatgtagaagctcaacagcttagactcctagtatctttaaatgagctcagtcgaagtaaatcccccatgagctagaacacttgaggagtggaaactcctggttagtttaatgttctcattaaccaaggggcaagtagaaaccatttagcttttagctcttgttgttaagaaacttaaaagaactgtgaagtagagtgaaaacaataggctgttttttgatgattcgggatcttcttgtacctaaaagtcaacattctgaatattgtatagacacatataaattcaggtggataagattataacaaatgttaggtattccaagatatgttcttgatttagttccttccttcagcccttccccactttttttctttctttccttgaataaatctggt

SEQ ID NO: 107442 - DNA, 1089 bp, Homo sapiens
  Payload ID: 1084
  Gene Symbol: ASB11
  Gene Name: ankyrin repeat and SOCS box containing 11, E3 ubiquitin protein ligase
  ENST ID: ENST00000485437
  CDS Start-End: 1-675
atggaagatggtcctgttttctatggctttaaaaacatttttattacaatgtttgctacgttttttttctttaagcttttaattaaagtttttttggctctcctaacccatttctatatcgtcaaaggaaatagaaaagaagcggctaggatagcagaagagatctatggtggaatttcagattgctgggctgatcgatccccacttcatgaagctgcagctcaggggcgcttactggcccttaaaactttaattgcacaaggtgtcaatgtgaaccttgtgacaattaaccgggtgtcttctctccacgaggcatgccttggaggtcacgtggcctgtgccaaagccttattggaaaatggtgcacacgtcaatggagtgacagttcacggagccacacccctcttcaatgcttgctgcagcggcagtgctgcatgtgtcaatgtgctgctggagttcggagccaaggcccagttggaggtgcacctggcctcgcccatccatgaggcagtgaagagagagtctcgtgctgttgcccaggctgcagtgcagtggcatgatttctgctcattgcaacctctggctcctgggttcaagcgattctcctgcctcagcctcccaagtagctgggattacaggtcacagagagtgcatggagatcctgctggcaaataatgttaacattgaccatgaggtgcctcagctcggaactcccctatatgtggcctgcacctaccagagggtagactgtgtgaagaaacttctagaattaggagccagtgtcgaccatggccagtggctggacaccccactccatgctgcagcgaggcagtccaatgtggaggtcatccacctgctaaccgactatggagctaacctgaagcgtagaaatgctcagggcaaaagtgcgcttgatctggcggctccaaaaagcagcgtggagcaggcactcttgctccgtgaaggcccacctgctctttcccagctctgccgcctgtgtgtccggaagtgtctcggtcgagcatgtcatcaagccatccacaagctacatctgccagagccactcgaacgattcctcctataccaata

SEQ ID NO: 107443 - DNA, 1289 bp, Homo sapiens
  Payload ID: 1085
  Gene Symbol: ASB12
  Gene Name: ankyrin repeat and SOCS box containing 12
  Uniprot ID: Q8WXK4
  ENST ID: ENST00000362002
  CDS Start-End: 194-1150
actgactcctagtctttcaacggcattgttaacagtgggaaacgagagccccagctgctccaggttggggccgtgggggctccctaaggaggggacaccagggccccaatgtttcacagaggggcggggggcagcgaccctgggcagcatggcctcaggctgaagcccgatctggcatttccttgtgctcataatgagaatagttctccaattagccaagatgaacctcatggacatcaccaagatcttctccctcctgcagcccgacaaggaggaggaggacactgacacagaggagaagcaggctctcaatcaagcagtgtatgacaacgactcctatactttggaccagcttttgcgccaggagcgttacaaacgtttcatcaacagcaggagtggctggggtgttcctgggacacccttgcgcttggctgcttcttatggccacttgagctgtttgcaagtcctcttagcccatggtgctgatgttgacagcttggatgtcaaggcacagacgccacttttcactgctgtcagtcatggccatctggactgtgtacgtgtgcttttggaagctggtgcctctcctggtggtagcatctacaacaactgttctcccgtgctcacagctgcccgtgatggtgctgttgctatcctgcaggagctcctagaccatggtgcagaggccaacgtcaaagctaaactaccagtctgggcatcaaacatagcttcatgttctggccccctctatttggccgcagtctacgggcacctggactgtttccgcctgcttttgctccacggggcagaccctgactacaactgcactgaccagggcctattggctcgtgtcccaagaccccgcaccctccttgaaatctgcctccatcataattgtgagccagagtatatccagctgttaatcgattttggtgctaatatctaccttccatctctctcccttgacctgacctcacaagatgataaaggcattgcattgctgctacaggcccgagccactccacggtcacttctatcacaggtccgtttagtcgtccgcagagccttgtgccaggctggccagccacaagccatcaaccagctggatattcctcccatgttgattagctacctaaaacaccaactgtaatcttgcagtctccccaggaacttatgatgcctccgaaaaccacctggggactcacgtagctggagagcattacagcctcatccacttacctggagctgctctcctgtattatcctccacaataaaattctccagaaaat

SEQ ID NO: 107444 - DNA, 2699 bp, Homo sapiens
  Payload ID: 1086
  Gene Symbol: ASB13
  Gene Name: ankyrin repeat and SOCS box containing 13
  Uniprot ID: Q8WXK3
  ENST ID: ENST00000357700
  CDS Start-End: 28-864
gtcgccgcgcggccgccggtgagccgcatggagccccgggcggcggacggctgcttcctgggcgacgtgggtttctgggtggagcggacccctgtgcacgaggcagcccagcggggtgagagcctgcagctgcaacagctgatcgagagcggcgcctgcgtgaaccaggtcaccgtggactccatcacgcccctgcacgcagccagtctgcagggccaggcgcggtgtgtgcagctgctgctggcggctggggcccaggtggatgctcgcaacatcgacggcagcaccccgctctgcgatgcctgcgcctcgggcagcatcgagtgtgtgaagctcttgctgtcctacggggccaaggtcaaccctcccctgtacacagcgtcccccctgcacgaggcctgcatgagcgggagttccgaatgtgtgaggcttcttattgacgtcggggccaatctggaagcgcacgattgccattttgggacccctctgcacgttgcctgtgcccgggagcatctggactgtgtcaaagtgctgctcaatgcaggggccaacgtgaatgcggcaaagcttcatgagactgcccttcaccacgcggccaaggtcaagaatgttgacctcatcgagatgcttatcgagtttggcggcaacatctacgcccgggacaaccgcgggaagaagccgtctgactacacgtggagcagcagcgctcccgccaagtgcttcgagtactacgaaaagacacctctgactctgtcacagctctgcagggtgaacttgaggaaggccactggcgtccgagggctggagaagattgccaagttaaacatcccgccccggctcattgattacctctcctacaactgaattgcaggtggggtccggaccgtggctgcccccgttgtgcccagcattgcccgggtgagggctctgcctgttcctctgaagcagcgtgattgctgtagatagaacaacgctccttcgagtcccttcctgcgatcctgtttaggcttctctcctggatcctggataatgtttccagggtgttgggaaggcctgcgtctcaggtcacagttgtgggtgtggccctgcgctgttctacagaacctaccctctcaatgggcatgggcccaaccatccagttttcctcttttacggaccatcctcaaaggcactctcaggacagacggcgtggggagcacagaggaggctggcagagctggggactgagggcattgttgctgattctcactcaccggggcagcctgccgcagatgcacaggccccaggtgcaggccaccacctccgggtcggcaccaggactgccctcggtgctcatagggaatggctgggcccacggaaggtcggcctgggatgtggcctgggactgctgctctgctggctgctgtgtggatgcttttcctggagcactttccaaggcatcccccagccccaagcctgcgcgcatctgtcactcagggactttctatgggtctttgtgggggaaggccctggctttgtattccccacaagtagcactgagtttcttaggaaatttgtcttcagtattaggtctccaactcttgtaaaaagtttatatgtaggataaaaaccttttagaggacacgtaggcggtaccactaaggttttggtaatgagccattcaaaccgacagcagtgtgaaggtgtgtcaaggtgtatattctcgtggctcggcattctcagtgcaaaggcctgtttggagactctgtgggaattgtttttcatctgtttctatggttgtcaaatgaattcttcacccaccctacagtttgctaactccttgaagctatcaaattagtaagaccatctatcacatccagcattgtcccagtgctttgagttggacgggaatgggactctgcagccaaggcaggataagaaaatcttgcaatcccgtcctgcagtgatagaaacaggtcgttctgcattataagccataggtggagcattcggtagcgtattcagactgcatgggccggcctaggagtctttgccttcataaattttaagaaccccgcccacaacagggagttaaactggaggactttgcatgattagttcagggatgagtggtttctggggcatctgaggtcaggagtttgaaaccagcctggccaacttgatgaaaccccatctctacccattctggagaacaggtcacgcctgtcctggagacagtgtgccgggaaaagggaacgtggtactcactggatgcacccaggccggcccgagcctcccaccgcagacagtgtggaacagagtgagcctgagctgcccaaggcgatgccctttgtgctgtatgactggaggcctctccgcgtgggtacttgggggtggggccacaaatctggcgaaaaacttcatgctggccgccgtgaggttttactccagcgttcccgccattgtcatggcgggtcttcgtcctaaactgagaagaaaagcattcctgtttgatcaccgccttagttaccagttctggatcagtcagtgtttctgcatggaataacaaccattaaaaaaagcactgggttctgccctttcatctttgtaagagattcttgcctctagcaatgacaacctgtgatgtctcacagtagagcacttagcgcagaatcaggtccccacggctgttgctcaataaaagtggcggaataaagtgc

SEQ ID NO: 107445 - DNA, 2780 bp, Homo sapiens
  Payload ID: 1086
  Gene Symbol: ASB13
  Gene Name: ankyrin repeat and SOCS box containing 13
  Uniprot ID: Q8WXK3
  ENST ID: ENST00000459912
  CDS Start-End: 28-549
gtcgccgcgcggccgccggtgagccgcatggagccccgggcggcggacggctgcttcctgggcgacgtgggtttctgggtggagcggacccctgtgcacgaggcagcccagcggggtgagagcctgcagctgcaacagctgatcgagagcggcgcctgcgtgaaccaggtcaccgtggactccatcacgcccctgcacgcagccagtctgcagggccaggcgcggtgtgtgcagctgctgctggcggctggggcccaggtggatgctcgcaacatcgacggcagcaccccgctctgcgatgcctgcgcctcgggcagcatcgagtgtgtgaagctcttgctgtcctacggggccaaggtcaaccctcccctgtacacagcgtcccccctgcacgaggcctgcatgagcgggagttccgaatgtgtgaggcttcttattgacgtcggggccaatctggaagcgcacgattgccattttgggacccctctgcacgttgcctgtgcccgggagcatctggactgtgtcaaagtgctgctcaatgcagcttgatgaatgtctgctcttatcgtgagaaagttgaggagtgcagagcttactctcttctctgaattgcctactgttttgggggccaacgtgaatgcggcaaagcttcatgagactgcccttcaccacgcggccaaggtcaagaatgttgacctcatcgagatgcttatcgagtttggcggcaacatctacgcccgggacaaccgcgggaagaagccgtctgactacacgtggagcagcagcgctcccgccaagtgcttcgagtactacgaaaagacacctctgactctgtcacagctctgcagggtgaacttgaggaaggccactggcgtccgagggctggagaagattgccaagttaaacatcccgccccggctcattgattacctctcctacaactgaattgcaggtggggtccggaccgtggctgcccccgttgtgcccagcattgcccgggtgagggctctgcctgttcctctgaagcagcgtgattgctgtagatagaacaacgctccttcgagtcccttcctgcgatcctgtttaggcttctctcctggatcctggataatgtttccagggtgttgggaaggcctgcgtctcaggtcacagttgtgggtgtggccctgcgctgttctacagaacctaccctctcaatgggcatgggcccaaccatccagttttcctcttttacggaccatcctcaaaggcactctcaggacagacggcgtggggagcacagaggaggctggcagagctggggactgagggcattgttgctgattctcactcaccggggcagcctgccgcagatgcacaggccccaggtgcaggccaccacctccgggtcggcaccaggactgccctcggtgctcatagggaatggctgggcccacggaaggtcggcctgggatgtggcctgggactgctgctctgctggctgctgtgtggatgcttttcctggagcactttccaaggcatcccccagccccaagcctgcgcgcatctgtcactcagggactttctatgggtctttgtgggggaaggccctggctttgtattccccacaagtagcactgagtttcttaggaaatttgtcttcagtattaggtctccaactcttgtaaaaagtttatatgtaggataaaaaccttttagaggacacgtaggcggtaccactaaggttttggtaatgagccattcaaaccgacagcagtgtgaaggtgtgtcaaggtgtatattctcgtggctcggcattctcagtgcaaaggcctgtttggagactctgtgggaattgtttttcatctgtttctatggttgtcaaatgaattcttcacccaccctacagtttgctaactccttgaagctatcaaattagtaagaccatctatcacatccagcattgtcccagtgctttgagttggacgggaatgggactctgcagccaaggcaggataagaaaatcttgcaatcccgtcctgcagtgatagaaacaggtcgttctgcattataagccataggtggagcattcggtagcgtattcagactgcatgggccggcctaggagtctttgccttcataaattttaagaaccccgcccacaacagggagttaaactggaggactttgcatgattagttcagggatgagtggtttctggggcatctgaggtcaggagtttgaaaccagcctggccaacttgatgaaaccccatctctacccattctggagaacaggtcacgcctgtcctggagacagtgtgccgggaaaagggaacgtggtactcactggatgcacccaggccggcccgagcctcccaccgcagacagtgtggaacagagtgagcctgagctgcccaaggcgatgccctttgtgctgtatgactggaggcctctccgcgtgggtacttgggggtggggccacaaatctggcgaaaaacttcatgctggccgccgtgaggttttactccagcgttcccgccattgtcatggcgggtcttcgtcctaaactgagaagaaaagcattcctgtttgatcaccgccttagttaccagttctggatcagtcagtgtttctgcatggaataacaaccattaaaaaaagcactgggttctgccctttcatctttgtaagagattcttgcctctagcaatgacaacctgtgatgtctcacagtagagcacttagcgcagaatcaggtccccacggctgttgctcaataaaagtggcggaataaagtgc

SEQ ID NO: 107446 - DNA, 3175 bp, Homo sapiens
  Payload ID: 1087
  Gene Symbol: ASB14
  Gene Name: ankyrin repeat and SOCS box containing 14
  Uniprot ID: A6NK59
  ENST ID: ENST00000389601
  CDS Start-End: 122-1885
agtccttaacagtgaaaacttcactgctgtcctagaggataaaacaaaagttgatctcttcacaactggaaaaatacttttaattcactctgactttaaagtaaacctgtccacgtttcacatggataattacaccagcgatgaagacatagatgaagactttgacacccagctcatcattcaacagagtttgcaggatatttataagccaggaacagcacaacatgcacctaaggatgagagtttgcattcctttttgagcgctgactataagaagatagttgaaacaatagagaaagtgggtaaggaagatgcattgtcacacttaaccaagtaccattccgcatttggtgaagcagatgagataggctggattcctctgcataaggctgcagtgcaattaaataggaaaattttggaaataaccctaagcgcttcagaccccagtctgtgggagcaaaccactcacaatggtgaaacgccactttttttggctgtcagcagttgcctcttagaaaatgccacttttcttcttctcaatggctgcaatccaaatgctaagaatttcgaaggcaattctcctcttcttgcagctgtgctgcgtgactgctatgacatggctgccttgctgatcaactatggagcagatgtcaatctgcgttgtgccaacgagaggacagctctccacgaagcagccaaactgggcagagaggacatggtgaagcttatgctggtttctggggcacaccctgacccacagagcacgtatggattcactcctcttgctcttgctgcccaaagtggacacactgaaatcatggaaatgttactgcggaaaggcaagatcttctgtttggcctctgattcttcttccatcttacttgaagccgcaagtggaggaaatccagatgctgtggctctcttgctggagtatggagctgatgccaacatccctaagaattcaggccacctgcccatccatgtggcagctgacaggggccacttactagctctaaagatactgattccagttacggatcttgctgccattaagcagagtgggatcagtccagttcactgtgcagcagcaggagcacatcctcagtgcctggaactcctcatccaggctggatttgatgtgaacttcatgctggatcagagaattaacaaacactacgatgaccacaggaagtcagctttgtattttgctgtatcaaacagtgacctctcttcagtcaagctgcttctgagtgctggagctctgcctaatcaagacccggttaactgcctccagatagccctcaggatgggcaactatgagctgatcagtctgctgctaaggcatggggccaatgtcaattacttctgcagagttaaccctttacatttcccatcagcactgcaatacactctgaaagatgaagtcatgctcaggatgctgctgaactatgggtatgacacagagcgatgttttgattgcccacatggagacaaagtccatccttcctatactgttgaaggctggacatctacagttatcaaagatactaagttctgtgaagtaataactttgtcatggctgcaacatctctctggaaaggttgttcgagtgatgcttgattatgttgatcaagttcggatctgttcaaagttgaaagctgtgctccaaaaacaggggatctggtcagaaatacattttatcttaacaaaccctcgctccctaaaacatttgtgccgcctaaagatccggaaatgcatgggacggttacatttgcgctgccctgtcttcatgtcatttcttccattacccaatcgtctaaaagcatatgtcctttacaaagaatacgacctttatggacaaggaatttttacaggaacctggtaatcaaaccattctaatggaaaaggacaacaaactgcccctcactactggcttggtttggtctactggaagcagctatcaaccgactttgttcttccaagtcctagtggaaaagacaaaaaagaaactaagttacttgtctgcagtcaaatggcaaattatgcagttaagatacattcttgagagccacttcttctgtcataaatatgtatgcatacttctgacaacttgataaaaagaaaagctacacccaaacaatacaacaccaaaatgaattttggcaccatcctataaaagccagcattcaaactaaaatctaatattttatctttctttttttatgaccaacaaccaaataaagcccatcatcaatcatctctcactatatattatagtaaaaccctcgaaagggatcacccccacactcctttcccttcccctctccagcccttttctccatccctgtccaattcatctttgctaaatcaggtgtcaccttccctcagcctcgcctatcaagaaagcctcacttcaatgtcatctttgccacttccctcttctttgtccagagagccagcccacagccaatgcttattgatctgttctaagcatcccagctgtctcctcttttctattcctactgtcaatctacaacccataacacgctcttacaatttcatggatcatttaatgcattcttcaagttttgctctgaaatttgtcttttaaaattattctgttggatggacaatgatttgacactcctggcaatattaaaaatatacatttcattatatatttcatataacatatatatttatttatttcccccccatagaaggcaaaatggctttcagcaatggcagttaagtctacacagcctctcaactgctttgacagagacaacctcctctgaaatattaaagttctggtatatttttgaaacagtcatattacatgtcaacgtaactataatgtaaacatcatatcaaaaaacagatgtgacccttttctgctatggtatgaatcatctgtttatgaagtggctgaacaagcagaaacagcccttcatttggaaattcaaatctgaaagtcatagtgctgaattaagtcttcacaaacaacacataaagatccagacattaggactgtataccttttcaatctgtttttgtttattgagttctttctgttgcttctcttttactctctctatttctttttgtttttctgatgccctacgatcctaaagaacagatgaataaaactaatgaattaaatatgaaataactt

SEQ ID NO: 107447 - DNA, 3179 bp, Homo sapiens
  Payload ID: 1087
  Gene Symbol: ASB14
  Gene Name: ankyrin repeat and SOCS box containing 14
  Uniprot ID: A6NK59
  ENST ID: ENST00000487349
  CDS Start-End: 122-1885
agtccttaacagtgaaaacttcactgctgtcctagaggataaaacaaaagttgatctcttcacaactggaaaaatacttttaattcactctgactttaaagtaaacctgtccacgtttcacatggataattacaccagcgatgaagacatagatgaagactttgacacccagctcatcattcaacagagtttgcaggatatttataagccaggaacagcacaacatgcacctaaggatgagagtttgcattcctttttgagcgctgactataagaagatagttgaaacaatagagaaaggtaaggaagatgcattgtcacacttaaccaagtaccattccgcatttggtgaagcagatgagataggctggattcctctgcataaggctgcagtgcaattaaataggaaaattttggaaataaccctaagcgcttcagaccccagtctgtgggagcaaaccactcacaatggtgaaacgccactttttttggctgtcagcagttgcctcttagaaaatgccacttttcttcttctcaatggctgcaatccaaatgctaagaatttcgaaggcaattctcctcttcttgcagctgtgctgcgtgactgctatgacatggctgccttgctgatcaactatggagcagatgtcaatctgcgttgtgccaacgagaggacagctctccacgaagcagccaaactgggcagagaggacatggtgaagcttatgctggtttctggggcacaccctgacccacagagcacgtatggattcactcctcttgctcttgctgcccaaagtggacacactgaaatcatggaaatgttactgcggaaaggagctaatgctcatggtcaggcctctgattcttcttccatcttacttgaagccgcaagtggaggaaatccagatgctgtggctctcttgctggagtatggagctgatgccaacatccctaagaattcaggccacctgcccatccatgtggcagctgacaggggccacttactagctctaaagatactgattccagttacggatcttgctgccattaagcagagtgggatcagtccagttcactgtgcagcagcaggagcacatcctcagtgcctggaactcctcatccaggctggatttgatgtgaacttcatgctggatcagagaattaacaaacactacgatgaccacaggaagtcagctttgtattttgctgtatcaaacagtgacctctcttcagtcaagctgcttctgagtgctggagctctgcctaatcaagacccggttaactgcctccagatagccctcaggatgggcaactatgagctgatcagtctgctgctaaggcatggggccaatgtcaattacttctgcagagttaaccctttacatttcccatcagcactgcaatacactctgaaagatgaagtcatgctcaggatgctgctgaactatgggtatgacacagagcgatgttttgattgcccacatggagacaaagtccatccttcctatactgttgaaggctggacatctacagttatcaaagatactaagttctgtgaagtaataactttgtcatggctgcaacatctctctggaaaggttgttcgagtgatgcttgattatgttgatcaagttcggatctgttcaaagttgaaagctgtgctccaaaaacaggggatctggtcagaaatacattttatcttaacaaaccctcgctccctaaaacatttgtgccgcctaaagatccggaaatgcatgggacggttacatttgcgctgccctgtcttcatgtcatttcttccattacccaatcgtctaaaagcatatgtcctttacaaagaatacgacctttatggacaaggaatttttacaggaacctggtaatcaaaccattctaatggaaaaggacaacaaactgcccctcactactggcttggtttggtctactggaagcagctatcaaccgactttgttcttccaagtcctagtggaaaagacaaaaaagaaactaagttacttgtctgcagtcaaatggcaaattatgcagttaagatacattcttgagagccacttcttctgtcataaatatgtatgcatacttctgacaacttgataaaaagaaaagctacacccaaacaatacaacaccaaaatgaattttggcaccatcctataaaagccagcattcaaactaaaatctaatattttatctttctttttttatgaccaacaaccaaataaagcccatcatcaatcatctctcactatatattatagtaaaaccctcgaaagggatcacccccacactcctttcccttcccctctccagcccttttctccatccctgtccaattcatctttgctaaatcaggtgtcaccttccctcagcctcgcctatcaagaaagcctcacttcaatgtcatctttgccacttccctcttctttgtccagagagccagcccacagccaatgcttattgatctgttctaagcatcccagctgtctcctcttttctattcctactgtcaatctacaacccataacacgctcttacaatttcatggatcatttaatgcattcttcaagttttgctctgaaatttgtcttttaaaattattctgttggatggacaatgatttgacactcctggcaatattaaaaatatacatttcattatatatttcatataacatatatatttatttatttcccccccatagaaggcaaaatggctttcagcaatggcagttaagtctacacagcctctcaactgctttgacagagacaacctcctctgaaatattaaagttctggtatatttttgaaacagtcatattacatgtcaacgtaactataatgtaaacatcatatcaaaaaacagatgtgacccttttctgctatggtatgaatcatctgtttatgaagtggctgaacaagcagaaacagcccttcatttggaaattcaaatctgaaagtcatagtgctgaattaagtcttcacaaacaacacataaagatccagacattaggactgtataccttttcaatctgtttttgtttattgagttctttctgttgcttctcttttactctctctatttctttttgtttttctgatgccctacgatcctaaagaacagatgaataaaactaatgaattaaatatgaaataactttaaa

SEQ ID NO: 107448 - DNA, 2706 bp, Homo sapiens
  Payload ID: 1088
  Gene Symbol: ASB15
  Gene Name: ankyrin repeat and SOCS box containing 15
  Uniprot ID: Q8WXK1
  ENST ID: ENST00000275699
  CDS Start-End: 43-1809
gtagattagctcaacactcgagaatcattgcagcttcaaggaatggatactaatgatgaccctgatgaagaccatcttacaagttatgatattcagctaagtattcaagaatccattgaagccagcaagactgcactttgtcctgaaagatttgtacccctaagtgctcaaaacagaaaacttgtggaggccataaaacaaggtcacattcctgagctccaggagtatgtaaaatataaatatgcaatggatgaagctgatgaaaaaggatggtttccattgcatgaagctgttgttcaacccattcaacaaatacttgagattgttctggatgcatcctataagacactctgggaattcaagacctgtgatggagaaacacccttgactttggcagtcaaagctggtctggtggaaaatgtaagaactttattagaaaagggagtgtggcccaacacaaaaaatgataaaggagagaccccccttctgattgctgtgaaaaagggctcctatgacatggtgtcgactctgatcaaacataacactagcctagaccagccctgtgtcaagcgatggtcagcaatgcatgaagcagccaagcaaggccgaaaagatatcgtagctctgctgctgaaacatggaggcaatgtccacctgagagatggatttggagtcacaccactaggcgtcgctgccgagtatggtcactgtgacgtgttagaacatctaatccacaaaggtggtgatgtgcttgctttggcggatgatggggcgtcggtgctgtttgaggcagcaggaggtggcaatcccgactgcatttccctcctgctggaatatggaggaagcggaaatgtacctaaccgagcaggacatcttcctatacaccgagctgcctatgaggggcattatcttgcactgaaatatcttatcccagtaacatctaaaaatgcaattcggaaaagtgggctaacaccaattcactcagcagcagatggacaaaatgcacagtgtctagaactgctcattgaaaatggttttgatgtcaacactctacttgctgaccacatttcccagagctatgacgatgagaggaagactgcgctgtattttggcgtttctaataatgacgttcattgcacagaagtccttctggctgcaggtgcagacccaaacttagatcccctcaactgtctacttgttgcagtgagggccaataattatgaaattgtcaggctgcttctctcccatggagctaatgtcaattgttattttatgcatgtgaatgacactcgtttccccagtgtcattcaatatgctctaaacgacgaggtaatgctgaggctattgctgaataatggctatcaagtggagatgtgctttgactgcatgcatggtgacatctttggaaattcatttgtgtggtcagagatacaggaagaggtgctgccaggatggacatcttgtgtaataaaagataacccgttctgtgagtttattacagttccttggatgaagcacttggtaggcagagttactcgtgtactaatagattacatggattatgttcctctgtgtgctaaactgaagtctgcactagaagtacagagagaatggccagaaatccgccaaatactagagaatccttgttcattgaagcatttgtgtcggttaaaaattcgaaggcttatgggtctccagaaactctgccagccagcctcagtggagaagcttcctctaccaccagctattcaaagatacatattatttaaagagtatgatctctatggacaagagctaaaattgacataacttaatattttaaaatgtgatttaaaaaaaatgttgaaatgtgattccctcagataatttcttgtaaccattttacatccttaattgtaaagtgtatttaaattcattgacagttttataggttatcatgtgttcttatgggaacaccatgatttatgtctttaaagacatttgcattttttaaagatagtattttgaacttagatttgtatctttgtttgctacaagtcatcaaactctccctatcaagtggctcctacaatatccacaatcaagtctctatgtttaaaaaacagataaccactttctcaaacccacatctgccagttgctggccagattctcctgtctttcacggtcttgctgtgtaaaagagctcctcctgcctgtaagttcacagactgtgatctggcatctgaccctccactgcttttctcaaggtccctgacaatctctttgttggtaaattcagtgaacattcttcagtccctcttccaatcgattcctacagcatctaacattgttgcctgttccttgcttgaaatgatatctctttccttgtttctcgcaaaacctgttctcttgggtgtcctcccacctccctggacactctgtctctggcttctttctgcctagctcatctctagccaatcttacagttatatatcttaagccctcttctctttgttctttaagttatatatcctaagccctctttgctttgttctctgggatattttatccacatccatggtcttaatcattttgctagagactacaaaatttccatccaaagctcagctctttctctcatgttctcctgacctatgtagacaattggcctcatgaacatttgaacacaaagacacctcaaattcaacatgtccccagatgaact

SEQ ID NO: 107449 - DNA, 2817 bp, Homo sapiens
  Payload ID: 1088
  Gene Symbol: ASB15
  Gene Name: ankyrin repeat and SOCS box containing 15
  Uniprot ID: Q8WXK1
  ENST ID: ENST00000434204
  CDS Start-End: 165-1931
cttcctctgatttaggaaggcaagtccctggataagaatgacaagatgatcattccaaaaggataaatcctgatgattctctcagggacctctagtagattagctcaacactcgagaatcattgcagcttcaagaacttgtctcgttcaaaattatatgcaggaatggatactaatgatgaccctgatgaagaccatcttacaagttatgatattcagctaagtattcaagaatccattgaagccagcaagactgcactttgtcctgaaagatttgtacccctaagtgctcaaaacagaaaacttgtggaggccataaaacaaggtcacattcctgagctccaggagtatgtaaaatataaatatgcaatggatgaagctgatgaaaaaggatggtttccattgcatgaagctgttgttcaacccattcaacaaatacttgagattgttctggatgcatcctataagacactctgggaattcaagacctgtgatggagaaacacccttgactttggcagtcaaagctggtctggtggaaaatgtaagaactttattagaaaagggagtgtggcccaacacaaaaaatgataaaggagagaccccccttctgattgctgtgaaaaagggctcctatgacatggtgtcgactctgatcaaacataacactagcctagaccagccctgtgtcaagcgatggtcagcaatgcatgaagcagccaagcaaggccgaaaagatatcgtagctctgctgctgaaacatggaggcaatgtccacctgagagatggatttggagtcacaccactaggcgtcgctgccgagtatggtcactgtgacgtgttagaacatctaatccacaaaggtggtgatgtgcttgctttggcggatgatggggcgtcggtgctgtttgaggcagcaggaggtggcaatcccgactgcatttccctcctgctggaatatggaggaagcggaaatgtacctaaccgagcaggacatcttcctatacaccgagctgcctatgaggggcattatcttgcactgaaatatcttatcccagtaacatctaaaaatgcaattcggaaaagtgggctaacaccaattcactcagcagcagatggacaaaatgcacagtgtctagaactgctcattgaaaatggttttgatgtcaacactctacttgctgaccacatttcccagagctatgacgatgagaggaagactgcgctgtattttggcgtttctaataatgacgttcattgcacagaagtccttctggctgcaggtgcagacccaaacttagatcccctcaactgtctacttgttgcagtgagggccaataattatgaaattgtcaggctgcttctctcccatggagctaatgtcaattgttattttatgcatgtgaatgacactcgtttccccagtgtcattcaatatgctctaaacgacgaggtaatgctgaggctattgctgaataatggctatcaagtggagatgtgctttgactgcatgcatggtgacatctttggaaattcatttgtgtggtcagagatacaggaagaggtgctgccaggatggacatcttgtgtaataaaagataacccgttctgtgagtttattacagttccttggatgaagcacttggtaggcagagttactcgtgtactaatagattacatggattatgttcctctgtgtgctaaactgaagtctgcactagaagtacagagagaatggccagaaatccgccaaatactagagaatccttgttcattgaagcatttgtgtcggttaaaaattcgaaggcttatgggtctccagaaactctgccagccagcctcagtggagaagcttcctctaccaccagctattcaaagatacatattatttaaagagtatgatctctatggacaagagctaaaattgacataacttaatattttaaaatgtgatttaaaaaaaatgttgaaatgtgattccctcagataatttcttgtaaccattttacatccttaattgtaaagtgtatttaaattcattgacagttttataggttatcatgtgttcttatgggaacaccatgatttatgtctttaaagacatttgcattttttaaagatagtattttgaacttagatttgtatctttgtttgctacaagtcatcaaactctccctatcaagtggctcctacaatatccacaatcaagtctctatgtttaaaaaacagataaccactttctcaaacccacatctgccagttgctggccagattctcctgtctttcacggtcttgctgtgtaaaagagctcctcctgcctgtaagttcacagactgtgatctggcatctgaccctccactgcttttctcaaggtccctgacaatctctttgttggtaaattcagtgaacattcttcagtccctcttccaatcgattcctacagcatctaacattgttgcctgttccttgcttgaaatgatatctctttccttgtttctcgcaaaacctgttctcttgggtgtcctcccacctccctggacactctgtctctggcttctttctgcctagctcatctctagccaatcttacagttatatatcttaagccctcttctctttgttctttaagttatatatcctaagccctctttgctttgttctctgggatattttatccacatccatggtcttaatcattttgctagagactacaaaatttccatccaaagctcagctctttctctcatgttctcctgacctatgtagacaattggcctcatgaacatttgaacacaaagacacctcaaattcaacatgtcc

SEQ ID NO: 107450 - DNA, 4788 bp, Homo sapiens
  Payload ID: 1088
  Gene Symbol: ASB15
  Gene Name: ankyrin repeat and SOCS box containing 15
  Uniprot ID: Q8WXK1
  ENST ID: ENST00000451558
  CDS Start-End: 522-2288
aaccctgggttcaggcttctgctgtatcatatttgctaaagacaccaaaactagatagagctatttgatcctgactaaggaaagcagtcaagacagtgcaggaggtgaggccatcttataggaagagcagttgtccagcctctggaagaaaaagctcagtggagatctgacagccttcctgggggatattaacagggctcctgtgttgcagaggaacactactttctcagtgtagctctgagaaagagaaccagaaaaaggatttctcttcagtagaaaaggcaaataccataaagaaggaatcgctgtaacttattgcttgataaatcctgatgattctctcagggacctctagtagattagctcaacactcgagaatcattgcagcttcaagggaccactgacagcagctgtttgcaatagttgacaaggagaaggaatagagggaaaagatagagaaaagaagagattttgtttcctctcagaaaaccaatggtccaagtgaaaacacaaacacaagaatggatactaatgatgaccctgatgaagaccatcttacaagttatgatattcagctaagtattcaagaatccattgaagccagcaagactgcactttgtcctgaaagatttgtacccctaagtgctcaaaacagaaaacttgtggaggccataaaacaaggtcacattcctgagctccaggagtatgtaaaatataaatatgcaatggatgaagctgatgaaaaaggatggtttccattgcatgaagctgttgttcaacccattcaacaaatacttgagattgttctggatgcatcctataagacactctgggaattcaagacctgtgatggagaaacacccttgactttggcagtcaaagctggtctggtggaaaatgtaagaactttattagaaaagggagtgtggcccaacacaaaaaatgataaaggagagaccccccttctgattgctgtgaaaaagggctcctatgacatggtgtcgactctgatcaaacataacactagcctagaccagccctgtgtcaagcgatggtcagcaatgcatgaagcagccaagcaaggccgaaaagatatcgtagctctgctgctgaaacatggaggcaatgtccacctgagagatggatttggagtcacaccactaggcgtcgctgccgagtatggtcactgtgacgtgttagaacatctaatccacaaaggtggtgatgtgcttgctttggcggatgatggggcgtcggtgctgtttgaggcagcaggaggtggcaatcccgactgcatttccctcctgctggaatatggaggaagcggaaatgtacctaaccgagcaggacatcttcctatacaccgagctgcctatgaggggcattatcttgcactgaaatatcttatcccagtaacatctaaaaatgcaattcggaaaagtgggctaacaccaattcactcagcagcagatggacaaaatgcacagtgtctagaactgctcattgaaaatggttttgatgtcaacactctacttgctgaccacatttcccagagctatgacgatgagaggaagactgcgctgtattttggcgtttctaataatgacgttcattgcacagaagtccttctggctgcaggtgcagacccaaacttagatcccctcaactgtctacttgttgcagtgagggccaataattatgaaattgtcaggctgcttctctcccatggagctaatgtcaattgttattttatgcatgtgaatgacactcgtttccccagtgtcattcaatatgctctaaacgacgaggtaatgctgaggctattgctgaataatggctatcaagtggagatgtgctttgactgcatgcatggtgacatctttggaaattcatttgtgtggtcagagatacaggaagaggtgctgccaggatggacatcttgtgtaataaaagataacccgttctgtgagtttattacagttccttggatgaagcacttggtaggcagagttactcgtgtactaatagattacatggattatgttcctctgtgtgctaaactgaagtctgcactagaagtacagagagaatggccagaaatccgccaaatactagagaatccttgttcattgaagcatttgtgtcggttaaaaattcgaaggcttatgggtctccagaaactctgccagccagcctcagtggagaagcttcctctaccaccagctattcaaagatacatattatttaaagagtatgatctctatggacaagagctaaaattgacataacttaatattttaaaatgtgatttaaaaaaaatgttgaaatgtgattccctcagataatttcttgtaaccattttacatccttaattgtaaagtgtatttaaattcattgacagttttataggttatcatgtgttcttatgggaacaccatgatttatgtctttaaagacatttgcattttttaaagatagtattttgaacttagatttgtatctttgtttgctacaagtcatcaaactctccctatcaagtggctcctacaatatccacaatcaagtctctatgtttaaaaaacagataaccactttctcaaacccacatctgccagttgctggccagattctcctgtctttcacggtcttgctgtgtaaaagagctcctcctgcctgtaagttcacagactgtgatctggcatctgaccctccactgcttttctcaaggtccctgacaatctctttgttggtaaattcagtgaacattcttcagtccctcttccaatcgattcctacagcatctaacattgttgcctgttccttgcttgaaatgatatctctttccttgtttctcgcaaaacctgttctcttgggtgtcctcccacctccctggacactctgtctctggcttctttctgcctagctcatctctagccaatcttacagttatatatcttaagccctcttctctttgttctttaagttatatatcctaagccctctttgctttgttctctgggatattttatccacatccatggtcttaatcattttgctagagactacaaaatttccatccaaagctcagctctttctctcatgttctcctgacctatgtagacaattggcctcatgaacatttgaacacaaagacacctcaaattcaacatgtccccagatgaactaaaaaaaaaaaaaaaaaaaaaacctctttcccgagctcagtagttagcacaatgctcaattcagtttccaaagaaaaaagcctggacattaggtttgaccatcccattttcctcacccaataagacaaatcaccaaatcctattaagtttatctcctgaagtcatcttccactcagcagccccccaccacccaccccgcatttggccctaagtctattatcttctttttcctgggataatacaatgctgcttatctggctcccctgactctgtcttgccctgtcccaaacactttctacatacagcatctcagaagagtcttttacaaatataatagagtttcacttctctgcttaagatcattcccattgctcttaaattccaaagttcttacttgaactttcatgatctaactcctgccttcttctttagcctcatctctggatgtctacctttcctcctttcccttgaaccttctagaattttattttttaaacactgattcccagacttcaaggtgtcatacactaataggttttattgtgtttatttttcaaaaagagtcattaaaaaataccatctactatcaccatcatttcataaaagaggggtcattttaatgccagaaagtaagatggtcataaattcagtcattcaagttgaatgacttttaccttgaaaagacctcacactgctctcatttccccattgacgagtgagaatttcactgtgggccatcaaatatctgaggacctttgtatggggaacctctgctgtagaatagaccatgctctcttttaacctcagggtcttcgcatttccttctctcatctggaactctctttccgctttttttgcaccctttcacctgatcaactcccacttaccctataggtctcagctgagatgttgcttcctctaggatgggaagcctcagcacagaacttgtcatgccatattatagatgcctgtgttccctgctgtcttcccactagactataagctctatgagggtaggttctatgtttgttttgttttccagtgctttctcagggccaaacacattccctagagcatggagttcaataattgtttgttgaaatatattgaataagtgacaaaaataatcagtgacatcatggtgaaataatagttttaaatttctgagtgagttatgtaatcttgtaattatttaatgctattattcttagattttaatagtgtatttttcttatatttatttttaccttgttaccgtattctttaaacagtaatatctcactggtctgtaaagttttcaagttgtatttagctttagttacctttgaaagataaataagtatgaaaaaaatcgtacaattagggctataattttaacttcttgtattccctagaggatatattttatatgtaagttaaactgtaatgtatttatatttaattgcaacatcttgtatacaagattttattattcttgtgttgcactcttagacgtggttaaatgtattgttacctaaaaatattactctaatgaataaaaaatcatattgaggttataagtctgctttatgatacttcatatattaaacttttgctcactaaa

SEQ ID NO: 107451 - DNA, 765 bp, Homo sapiens
  Payload ID: 1088
  Gene Symbol: ASB15
  Gene Name: ankyrin repeat and SOCS box containing 15
  ENST ID: ENST00000447789
  CDS Start-End: 43-765
gtagattagctcaacactcgagaatcattgcagcttcaaggaatggatactaatgatgaccctgatgaagaccatcttacaagttatgatattcagctaagtattcaagaatccattgaagccagcaagactgcactttgtcctgaaagatttgtacccctaagtgctcaaaacagaaaacttgtggaggccataaaacaaggtcacattcctgagctccaggagtatgtaaaatataaatatgcaatggatgaagctgatgaaaaaggatggtttccattgcatgaagctgttgttcaacccattcaacaaatacttgagattgttctggatgcatcctataagacactctgggaattcaagacctgtgatggagaaacacccttgactttggcagtcaaagctggtctggtggaaaatgtaagaactttattagaaaagggagtgtggcccaacacaaaaaatgataaaggagagaccccccttctgattgctgtgaaaaagggctcctatgacatggtgtcgactctgatcaaacataacactagcctagaccagccctgtgtcaagcgatggtcagcaatgcatgaagcagccaagcaaggccgaaaagatatcgtagctctgctgctgaaacatggaggcaatgtccacctgagagatggatttggagtcacaccactaggcgtcgctgccgagtatggtcactgtgacgtgttagaacatctaatccacaaaggtggtgatgtgcttgctttggcggat

SEQ ID NO: 107452 - DNA, 531 bp, Homo sapiens
  Payload ID: 1088
  Gene Symbol: ASB15
  Gene Name: ankyrin repeat and SOCS box containing 15
  ENST ID: ENST00000437535
  CDS Start-End: 240-531
tctgatttaggaaggcaagtccctggataagaatgacaagatgatcattccaaaaggaaagcagtcaagacagtgcaggaggtgaggccatcttataggaagagcagttgtccagcctctggaagaaaaagctcagtggagatctgacagccttcctgggggatattaacagggctcctgtgttgcagaggaacactactttctcagtgtagctctgagaaagagaaccagaaaaaggaatggatactaatgatgaccctgatgaagaccatcttacaagttatgatattcagctaagtattcaagaatccattgaagccagcaagactgcactttgtcctgaaagatttgtacccctaagtgctcaaaacagaaaacttgtggaggccataaaacaaggtcacattcctgagctccaggagtatgtaaaatataaatatgcaatggatgaagctgatgaaaaaggatggtttccattgcatgaagctgttgttcaacccattcaacaaatacttgagattgttctggatg

SEQ ID NO: 107453 - DNA, 2956 bp, Homo sapiens
  Payload ID: 1088
  Gene Symbol: ASB15
  Gene Name: ankyrin repeat and SOCS box containing 15
  Uniprot ID: Q8WXK1
  ENST ID: ENST00000451215
  CDS Start-End: 293-2059
aggaaggcaagtccctggataagaatgacaagatgatcattccaaaaggaaagcagtcaagacagtgcaggaggtgaggccatcttataggaagagcagttgtccagcctctggaagaaaaagctcagtggagatctgacagccttcctgggggatattaacagggctcctgtgttgcagaggaacactactttctcagtgtagctctgagaaagagaaccagaaaaaggatttctcttcagtagaaaaggcaaataccataaagaaggaatcgctgtaacttattgcttgaatggatactaatgatgaccctgatgaagaccatcttacaagttatgatattcagctaagtattcaagaatccattgaagccagcaagactgcactttgtcctgaaagatttgtacccctaagtgctcaaaacagaaaacttgtggaggccataaaacaaggtcacattcctgagctccaggagtatgtaaaatataaatatgcaatggatgaagctgatgaaaaaggatggtttccattgcatgaagctgttgttcaacccattcaacaaatacttgagattgttctggatgcatcctataagacactctgggaattcaagacctgtgatggagaaacacccttgactttggcagtcaaagctggtctggtggaaaatgtaagaactttattagaaaagggagtgtggcccaacacaaaaaatgataaaggagagaccccccttctgattgctgtgaaaaagggctcctatgacatggtgtcgactctgatcaaacataacactagcctagaccagccctgtgtcaagcgatggtcagcaatgcatgaagcagccaagcaaggccgaaaagatatcgtagctctgctgctgaaacatggaggcaatgtccacctgagagatggatttggagtcacaccactaggcgtcgctgccgagtatggtcactgtgacgtgttagaacatctaatccacaaaggtggtgatgtgcttgctttggcggatgatggggcgtcggtgctgtttgaggcagcaggaggtggcaatcccgactgcatttccctcctgctggaatatggaggaagcggaaatgtacctaaccgagcaggacatcttcctatacaccgagctgcctatgaggggcattatcttgcactgaaatatcttatcccagtaacatctaaaaatgcaattcggaaaagtgggctaacaccaattcactcagcagcagatggacaaaatgcacagtgtctagaactgctcattgaaaatggttttgatgtcaacactctacttgctgaccacatttcccagagctatgacgatgagaggaagactgcgctgtattttggcgtttctaataatgacgttcattgcacagaagtccttctggctgcaggtgcagacccaaacttagatcccctcaactgtctacttgttgcagtgagggccaataattatgaaattgtcaggctgcttctctcccatggagctaatgtcaattgttattttatgcatgtgaatgacactcgtttccccagtgtcattcaatatgctctaaacgacgaggtaatgctgaggctattgctgaataatggctatcaagtggagatgtgctttgactgcatgcatggtgacatctttggaaattcatttgtgtggtcagagatacaggaagaggtgctgccaggatggacatcttgtgtaataaaagataacccgttctgtgagtttattacagttccttggatgaagcacttggtaggcagagttactcgtgtactaatagattacatggattatgttcctctgtgtgctaaactgaagtctgcactagaagtacagagagaatggccagaaatccgccaaatactagagaatccttgttcattgaagcatttgtgtcggttaaaaattcgaaggcttatgggtctccagaaactctgccagccagcctcagtggagaagcttcctctaccaccagctattcaaagatacatattatttaaagagtatgatctctatggacaagagctaaaattgacataacttaatattttaaaatgtgatttaaaaaaaatgttgaaatgtgattccctcagataatttcttgtaaccattttacatccttaattgtaaagtgtatttaaattcattgacagttttataggttatcatgtgttcttatgggaacaccatgatttatgtctttaaagacatttgcattttttaaagatagtattttgaacttagatttgtatctttgtttgctacaagtcatcaaactctccctatcaagtggctcctacaatatccacaatcaagtctctatgtttaaaaaacagataaccactttctcaaacccacatctgccagttgctggccagattctcctgtctttcacggtcttgctgtgtaaaagagctcctcctgcctgtaagttcacagactgtgatctggcatctgaccctccactgcttttctcaaggtccctgacaatctctttgttggtaaattcagtgaacattcttcagtccctcttccaatcgattcctacagcatctaacattgttgcctgttccttgcttgaaatgatatctctttccttgtttctcgcaaaacctgttctcttgggtgtcctcccacctccctggacactctgtctctggcttctttctgcctagctcatctctagccaatcttacagttatatatcttaagccctcttctctttgttctttaagttatatatcctaagccctctttgctttgttctctgggatattttatccacatccatggtcttaatcattttgctagagactacaaaatttccatccaaagctcagctctttctctcatgttctcctgacctatgtagacaattggcctcatgaacatttgaacacaaagacacctcaaattcaacatgtccccagatgaact

SEQ ID NO: 107454 - DNA, 1651 bp, Homo sapiens
  Payload ID: 1088
  Gene Symbol: ASB15
  Gene Name: ankyrin repeat and SOCS box containing 15
  ENST ID: ENST00000540573
  CDS Start-End: 622-1371
aggataaatcctgatgattctctcagggacctctagtagattagctcaacactcgagaatcattgcagcttcaaggaatggatactaatgatgaccctgatgaagaccatcttacaagttatgatattcagctaagtattcaagaatccattgaagccagcaagactgcactttgtcctgaaagatttgtacccctaagtgctcaaaacagaaaacttgtggaggccataaaacaaggtcacattcctgagctccaggagtatgtaaaatataaatatgcaatggatgaagctgatgaaaaaggatggtttccattgcatgaagctgttgttcaacccattcaacaaatacttgagattgttctggatgcatcctataagacactctgggaattcaagacctgtgatggagaaacacccttgactttggcagtcaaagctggtctggtggaaaatgtaagaactttattagaaaagggagtgtggcccaacacaaaaaatgataaaggagagaccccccttctgattgctgtgaaaaagggctcctatgacatggtgtcgactctgatcaaacataacactagcctagaccagccctgtgtcaagcgatggtcagcaatgcatgaagcagccaagcaaggccgaatatggtcactgtgacgtgttagaacatctaatccacaaaggtggtgatgtgcttgctttggcggatgatggggcgtcggtgctgtttgaggcagcaggaggtggcaatcccgactgcatttccctcctgctggaatatggaggaagcggaaatgtacctaaccgagcaggacatcttcctatacaccgagctgcctatgaggggcattatcttgcactgaaatatcttatcccagtaacatctaaaaatgcaattcggaaaagtgggctaacaccaattcactcagcagcagatggacaaaatgcacagtgtctagaactgctcattgaaaatggttttgatgtcaacactctacttgctgaccacatttcccagagctatgacgatgagaggaagactgcgctgtattttggcgtttctaataatgacgttcattgcacagaagtccttctggctgcaggtgcagacccaaacttagatcccctcaactgtctacttgttgcagtgagggccaataattatgaaattgtcaggctgcttctctcccatggagctaatgtcaattgttattttatgcatgtgaatgacactcgtttccccagtgtcattcaatatgctctaaacgacgaggtaatgctgaggctattgctgaataatggctatcaagtggagatgtgctttgactgcatgcatggtgacatctttggaaattcatttgtgtgctaaactgaagtctgcactagaagtacagagagaatggccagaaatccgccaaatactagagaatccttgttcattgaagcatttgtgtcggttaaaaattcgaaggcttatgggtctccagaaactctgccagccagcctcagtggagaagcttcctctaccaccagctattcaaagatacatattatttaaagagtatgatctctatggacaagagctaaaattgacataacttaatattttaaaatgtgatttaaaaaaaatgttgaaatgtgattccctc

SEQ ID NO: 107455 - DNA, 2139 bp, Homo sapiens
  Payload ID: 1089
  Gene Symbol: ASB16
  Gene Name: ankyrin repeat and SOCS box containing 16
  Uniprot ID: Q96NS5
  ENST ID: ENST00000293414
  CDS Start-End: 85-1446
ggctcctcagagcaagggaggtagtcgggtcgagggaacctggctctgcccaggtgccactgcccaaacccctgggccccatccatggcaagagagaccttccccttcacctcctccatgctgcgctctctccgcctgcagcaggagtggctggaatgggaggaccggcggcgggcggctgcccagcagtgccggagccgcaggtgcccgtcaagtccccgggcccgactcactaggcctcaccgttcctgccgagacccagctgtccaccaagccctcttctccggcaacctgcagcaggtccaagccctgttccaagatgaagaggccgccaacatgattgtggagactgtgagcaaccagctggcctggtcggctgaacaggggttctgggtgctgacccccaagaccaagcagacggcacccctcgccatcgctacagcccgaggctacacagactgtgctcgacacctgatccggcagggagctgagctggatgcccgtgtcgggggtcgcgctgccttgcatgaggcctgtgcccgagcccagtttgactgtgtgcggctgctgctgaccttcggagccaaggctaatgtgctgactgaggagggcacgactcctttgcacctctgcacgatccccgagtccttgcagtgcgccaagttgctgctggaagcaggagcgacggtgaacctggcagcaggcgagagccaggagacgcccctgcacgtggcggcggcgcgcggcctggagcaacatgtggctctgtacctggagcatggcgccgacgtgggcctgcgcaccagccagggcgagactgcgctgaacacggcgtgcgctggggccgagggcccaggtagctgcaggcgacaccaggctgcggcgcgccggctcctggaggctggagctgatgcccgggcggccgggcgcaagcgccacacgccgctgcacaacgcttgtgccaacggctgcgggggcctggccgagctgctgctgcgttacggggcccgcgctgaggtccccaatggggcgggccacacgcccatggactgtgcgctgcaggccgtccaggactcccccaactgggagcctgaagtccttttcgccgcactgctggactacggggcgcagccagtgcgccctgagatgctgaaacactgcgccaacttccctcgggccctggaagtcctgcttaatgcctatccttgtgtcccatcctgtgagacctgggtggaggcggtgctcccagagctgtggaaggagcacgaagccttctacagctcggccctgtgcatggtgaaccagccaaggcagctgcagcacctggcccgactagctgtgcgcgctcggttgggaagccgctgccggcagggtgccacccggctgccactgcccccgctcctcagggactacctgctgctgcgtgtggaggggtgcatccagtgaaccccatgtcaggctgtcccatggtgtgttctgcccctcccacctgtccccgcctccaactgcggaggaccagttcctggccctcttttcttttctttttgagacctagtctcactctgttgcccaggctggagtgcagtggcgctatctcggctcactgcaacttctaccacctaggttcaagcgattcttgtgccccaaacttccgagtagctgggactacaggcatgagtcaccacacctggctgattttgtatttttagtagagacagggtctcaccatgttggccaggctggtctcacactgacctcaggtgatccacccgccttggcctcccaaagtgttgggattacaggcatgagccactgcgcctggttgcctgcccctcttttctgtactccacgtgctgtcctggtccacctcactcctccatgggcttcttgagacacctgctgacctctagccggacctgagcttcagaccctctctccagcaggaagggctgcagactcggcctgttcccagactcggccttcacctcccttctcctcctgtgtttaagtggatggcccctctatccatccaggtcccatgccaagaaccagtgattctagtggcccaccacctccctctcctgccacccttatacctgttcagcctcctaaagagggacaaactctgtctctgcgtgc

SEQ ID NO: 107456 - DNA, 1743 bp, Homo sapiens
  Payload ID: 1089
  Gene Symbol: ASB16
  Gene Name: ankyrin repeat and SOCS box containing 16
  ENST ID: ENST00000589618
  CDS Start-End: 67-888
aggtagtcgggtcgagggaacctggctctgcccaggtgccactgcccaaacccctgggccccatccatggcaagagagaccttccccttcacctcctccatgctgcgctctctccgcctgcagcaggagtggctggaatgggaggaccggcggcgggcggctgcccagcagtgccggagccgcaggtgcccgtcaagtccccgggcccgactcactaggcctcaccgttcctgccgagacccagctgtccaccaagccctcttctccggcaacctgcagcaggtccaagccctgttccaagatgaagaggccgccaacatgattgtggagactgtgagcaaccagctggcctggtcggctgaacaggggttctgggtgctgacccccaagaccaagcagacggcacccctcgccatcgctacagcccgaggctacacagactgtgctcgacacctgatccggcagggagctgagctggatgcccgtgtcgggggtcgcgctgccttgcatgaggcctgtgcccgagcccagtttgactgtgtgcggctgctgctgaccttcggagccaaggctaatgtgctgactgaggagggcacgactcctttgcacctctgcacgatccccgagtccttgcagtgcgccaagttgctgctggaagcaggagcgacggtgaacctggcagcaggcgagagccaggagacgcccctgcacgtggcggcggcgcgcggcctggagcaacatgtggctctgtacctggagcatggcgccgacgtgggcctgcgcaccagccagggcgagactgcgctgaacacggcgtgcgctggggccgagggcccagatgctgaaacactgcgccaacttccctcgggccctggaagtcctgcttaatgcctatccttgtgtcccatcctgtgagacctgggtggaggcggtgctcccagagctgtggaaggagcacgaagccttctacagctcggccctgtgcatggtgaaccagccaaggcagctgcagcacctggcccgactagctgtgcgcgctcggttgggaagccgctgccggcagggtgccacccggctgccactgcccccgctcctcagggactacctgctgctgcgtgtggaggggtgcatccagtgaaccccatgtcaggctgtcccatggtgtgttctgcccctcccacctgtccccgcctccaactgcggaggaccagttcctggccctcttttcttttctttttgagacctagtctcactctgttgcccaggctggagtgcagtggcgctatctcggctcactgcaacttctaccacctaggttcaagcgattcttgtgccccaaacttccgagtagctgggactacaggcatgagtcaccacacctggctgattttgtatttttagtagagacagggtctcaccatgttggccaggctggtctcacactgacctcaggtgatccacccgccttggcctcccaaagtgttgggattacaggcatgagccactgcgcctggttgcctgcccctcttttctgtactccacgtgctgtcctggtccacctcactcctccatgggcttcttgagacacctgctgacctctagccggacctgagcttcagaccctctctccagcaggaagggctgcagactcggcctgttcccagactcggccttcacctcccttctcctcctgtgtttaagtggatggcccctctatccatccaggtcccatgccaagaacca

SEQ ID NO: 107457 - DNA, 499 bp, Homo sapiens
  Payload ID: 1089
  Gene Symbol: ASB16
  Gene Name: ankyrin repeat and SOCS box containing 16
  ENST ID: ENST00000591700
  CDS Start-End: 287-499
aacccaagatgctcgctctagagatgaaggtggatgcagatgctggggttcgggggtggcctcagctgagggcctgctgaccaaccaaaggcaggagtggctggaatgggaggaccggcggcgggcggctgcccagcagtgccggagccgcaggtgcccgtcaagtccccgggcccgactcactaggcctcaccgttcctgccgagacccagctgtccaccaagccctcttctccggcaacctgcagcaggtccaagccctgttccaagatgaagaggccgccaacatgattgtggagactgtgagcaaccagctggcctggtcggctgaacaggggttctgggtgctgacccccaagaccaagcagacggcacccctcgccatcgctacagcccgaggctacacagactgtgctcgacacctgatccggcagggagctgagctggatgcccgtgtcgggggtcgcgctgccttgcatgaggcctgtgcccgagcccag

SEQ ID NO: 107458 - DNA, 1107 bp, Homo sapiens
  Payload ID: 1090
  Gene Symbol: ASB17
  Gene Name: ankyrin repeat and SOCS box containing 17
  Uniprot ID: Q8WXJ9
  ENST ID: ENST00000284142
  CDS Start-End: 141-1028
aatatttattttttctggttacagtttaaagggcacttctgtttgtggagtaaagcctgccacattgtcaaaatatgtaactggaggattacagtatgcttacctctgattttatttctacagtgctgctataagtaacaatgagtaaatctactaaattatgtggtaagacttcttgtccaagaagcaatatattctgcaatctccttgacaaaattgttaaaagaccctccctacagtttttgggtcagtggggatatcactgttacgaaccaaggatttacagatcactggcaaaaattctgaggtatgtggacttggatggttttgacgcactactcacagattacattgcatttgtggaaaaatcaggataccgttttgaagtaagttttaacctcgacttcactgaaatatgtgtgaatacaattctgtactgggtttttgccagaaaaggtaatcctgactttgtggaattgcttctcaagaagacaaaagactatgttcaagacagaagttgtaacctggcactgatatggagaactttcacaccagtatactgtccaagcccattaagtggcatcacacctctcttttatgtagctcagacaagacagtctaatatcttcaaaatactactgcaatatggaatcttagaaagagaaaaaaaccctatcaacattgtcttaacaatagtactctacccttcgagagtaagagtaatggttgatcgtgaattggctgacatccatgaagatgccaaaacatgtttggtactatgttccagagtgctttctgtcatttcagtcaaggaaataaagacacagctgagtttaggaagacatccaattatttcaaattggtttgattacattccttcaacaagatacaaagatccatgtgaactattacatctttgcagactaaccatcaggaatcaactattaaccaacaatatgctcccagatggaatattttcacttctaattcctgctcgtctacaaaactatctgaatttagaaatctaacatacgtcagtgtcctaagttccttaacaatgcttaccaatgtatggcttagaagttaataaaaattcacttcatgtaa

SEQ ID NO: 107459 - DNA, 1401 bp, Homo sapiens
  Payload ID: 1091
  Gene Symbol: ASB18
  Gene Name: ankyrin repeat and SOCS box containing 18
  Uniprot ID: Q6ZVZ8
  ENST ID: ENST00000409749
  CDS Start-End: 1-1401
atgtccaactcggattaccttcccgactacccactcaactcagatttagtgaagagattaaagtctgccctggatgccaaagatgaggagagagtgagggatttaatctgcactgaaatcacgcctgtggacgctgtgatagaactggccaatgacgactggatgaaagacccctcggctcagctgcccaccggcatgctgctaggggacctcgaccatctgaagcccctcatggaccagttcttccaggatgccaacgtggtgtttgagatcaataaggatgagatggaatggcaggtgaaatctccagccacgtttggactatcaggcctctggaccctggagtacaagcgtgagctcaccacgcccctgtgcatcgccgcggcccacggccacaccgcctgcgtgcgacacctgctcggccgcggcgcagacccagacgccagccccggcggccgcggcgccctgcacgaggcctgcctcgggggccacaccgcctgcgtccgcctgctgctgcagcaccgcgccgaccccgacctgctcagcgccgagggcctggcgcctctgcacctctgccgcacggccgcctcgctcgggtgcgcgcaggcgctgctggagcacggggcctcggtgcagcgcgtgggcggcacgggccgggacacgccgctgcacgtggcggcgcagcgcggcctggacgagcacgcgcgcctgtacctgggccgcggggcgcacgtggacgcgaggaacggccgcggagagacggctctgagcgcggcctgcggtgcggcgcggaggcccgacgagcacgggcgctgcctgcgcctgtgcgcgctgctgctgcggcgcggggcggaggcggacgcgcgcgacgaggacgagcgcagcccgctgcacaaagcctgcggccacgcgagccacagcctggcgcgcctcctactgcggcacggcgccgacgcgggcgcgctcgactatggcggggcctcgccgctgggccgcgtgctccagaccgcatcctgcgctctccaggcctcaccgcagcgcacggtgcaggcgctgctcaaccacggctctcccaccgtgtggcccgacgccttccccaaggtgctgaagacctgtgcatctgtccccgcagtcatcgaggtgcttttcaactcctaccctcagctctgcttgtcagagtcctggaaggaagtgattcctgaggaagtattccagatgcacaagccgttctaccagtccctctttgccttggccctcaccccacgctgcctgcagcatctttgccgctgtgctcttcgcagactgtttggcaaaaggtgctttgacctcatccccctgttacccttgccaaagcccctgcagaattacctacttttggagccacagggtgttttgcactga

SEQ ID NO: 107460 - DNA, 650 bp, Homo sapiens
  Payload ID: 1091
  Gene Symbol: ASB18
  Gene Name: ankyrin repeat and SOCS box containing 18
  ENST ID: ENST00000430053
  CDS Start-End: 65-650
gctgactttggagtcgctttagaggaagaaaagaagggctggtcactgcagaaacgacgtaacaatgtccaactcggattaccttcccgactacccactcaactcagatttagtgaagagattaaagtctgccctggatgccaaagatgaggagagagtgagggatttaatctgcactgaaatcacgcctgtggacgctgtgatagaactggccaatgacgactggatgaaagacccctcggctcagctgcccaccggcatgctgctaggcctctggaccctggagtacaagcgtgagctcaccacgcccctgtgcatcgccgcggcccacggccacaccgcctgcgtgcgacacctgctcggccgcggcgcagacccagacgccagccccggcggccgcggcgccctgcacgaggcctgcctcgggggccacaccgcctgcgtccgcctgctgctgcagcaccgcgccgaccccgacctgctcagcgccgagggcctggcgcctctgcacctctgccgcacggccgcctcgctcgggtgcgcgcaggcgctgctggagcacggggcctcggtgcagcgcgtgggcggcacgggccgggacacgccgctgcacgtggcggcgcagcgcggcctggacgagcacgcgcgcc

SEQ ID NO: 107461 - DNA, 568 bp, Homo sapiens
  Payload ID: 1091
  Gene Symbol: ASB18
  Gene Name: ankyrin repeat and SOCS box containing 18
  ENST ID: ENST00000447030
  CDS Start-End: 1-447
gcgcgcgacgaggacgagcgcagcccgctgcacaaagcctgcggccacgcgagccacagcctggcgcgcctcctactgcggcacggcgccgacgcgggcgcgctcgactatggcggggcctcgccgctgggccgcgtgctccagaccgcatcctgcgctctccaggcctcaccgcagcgcacggtgcaggcgctgctcaaccacggctctcccaccgtgtggcccgacgccttccccaaggtgctgaagacctgtgcatctgtccccgcagtcatcgaggtgcttttcaactcctaccctcagctctgcttgtcagagtcctggaaggaagtgattcctgaggaagtattccaggcaagagggctgcctttctgcccatctttagtacaaaacttttgtctgtttttgcttctttgcatggggagttttgcactgatattcggctaagtattatacatctgaaaaaggaagaatgggaaatgagggtgtatttgcacgtttctggttttttctggaggctccataatcacacagccaggagcttgttatagtagttgcggtgccatgg
